United States Patent 8,541,208 (PROCESS FOR THE PRODUCTION OF FINE CHEMICALS) - sequence listing, part 17

SEQ ID NO: 95127 - DNA, 960 bp, Microbulbifer degradans 2-40
  CDS (1)..(960)
atggcgggagtgactgacttaccctttaggcaaatctgtcgccactacggcgtagggctagccacatcggaaatggttactagcgacactcgactctggcagtcagataaaagccgcttacgccttacatacagtgccgaacttgcacctgtaagcgttcaaatagcgggtagcgaacctgacatgatggcccaagcagcgattgagtgcgtaaaactgggcgcccagatagttgatatcaatatgggttgcccagcaaaaaaagtgtgtaaaaaactggcaggttcggcactactgcaagacgaaaagcgtgttgccgaaatacttaccgccgtggttaacgctgtagatgtaccggttacccttaaaacccgaacagggtggtcaccagaaaacagaaacggcgtaaccatcgcccgcatggccgaaaatataggtatagccgcgctcaccgtacacggtagaacgcgagaatgccgattcaagggccaagcggagtacgacacactcgcagacattgttcaaaacgtatcgatcccggttattgcaaacggagatatcgactcgactgacaaagccaagcatgtgctcgactacaccggcgcccaagcggtaatggtaggtcgcgctgctttgggcaacccatggttgttacagtctattgcgcacacccttgaaggtggcaatacagagtccgtcgagaaaaaggcaccctcgtggatagaactaaacgaggtaataactgcccatttaggggagttacacaagttctacggtgaatatcaaggcgtgcgcattgcgcgaaaacacttgtcttggtacgcacaaaccctagcctctctaggggctgggaatttcgacacgcgacactttaacgcgctagaaacaccacagacgcaattcgaggcccttcgcgcttattttgaggggccaaattcatacgaggaaaaagcagcatga

SEQ ID NO: 95128 - protein, 319 aa, Microbulbifer degradans 2-40
MAGVTDLPFRQICRHYGVGLATSEMVTSDTRLWQSDKSRLRLTYSAELAPVSVQIAGSEPDMMAQAAIECVKLGAQIVDINMGCPAKKVCKKLAGSALLQDEKRVAEILTAVVNAVDVPVTLKTRTGWSPENRNGVTIARMAENIGIAALTVHGRTRECRFKGQAEYDTLADIVQNVSIPVIANGDIDSTDKAKHVLDYTGAQAVMVGRAALGNPWLLQSIAHTLEGGNTESVEKKAPSWIELNEVITAHLGELHKFYGEYQGVRIARKHLSWYAQTLASLGAGNFDTRHFNALETPQTQFEALRAYFEGPNSYEEKAA

SEQ ID NO: 95129 - DNA, 936 bp, Microbulbifer degradans 2-40
  CDS (1)..(936)
atggaaggtgttgttgatcaccatatgcgtaacattatctcctctgttggcggagtggatatttgtgtaaccgaattcattagggtgacagatcacgtactgcctaacaaaatattcaaaaaggcctgccccgagctagatgaaaacagcgaaacccctgcgctctatagaggcgcgcactgccctgtaagggttcaactacttggcagcaacccttcagccttagccgcaaatgcagccagagccgccgagctgggagcggtagctatagaccttaactttggctgccccgccaaaacagtaaataggcacaaaggcggagcctgcctactagacgaaacagacacagtattcgacatcgttaacgccgtgcgcaaagccacgccggcaagcacaccagttacggccaaaatacgcttaggttatttaaatagagacagctatttacgcaatgcgaaagcaattgaagccgctggcgcaaacgaactatgcgtgcacgcccgctcgaaaactgacggttaccaaccaccagcctactggcattatattggcgacattcgcgacaacctgagcattccggttgttgccaatggcgagatttggagcttagaggacttcaaacgctgtgcagagcaatctaaatgctctgacttcatgcttggcagggggctgctagccaaaccagatctcgcccttgaaataaaacaatacatggccggagaggcatttaacccgctctcttgggacgaggtttgtgcacacgtgagaacactgtttgaacgcaattgccaatcttacccacccaaatacctgggtaaccgggtgaaacagtggcttttttatttgcagcgccagtacagcgaagcggcagagttattcgaagcaatcaagcgcgagcgcgacgagcaagctctacgccgcgctctgggcttttaa

SEQ ID NO: 95130 - protein, 311 aa, Microbulbifer degradans 2-40
MEGVVDHHMRNIISSVGGVDICVTEFIRVTDHVLPNKIFKKACPELDENSETPALYRGAHCPVRVQLLGSNPSALAANAARAAELGAVAIDLNFGCPAKTVNRHKGGACLLDETDTVFDIVNAVRKATPASTPVTAKIRLGYLNRDSYLRNAKAIEAAGANELCVHARSKTDGYQPPAYWHYIGDIRDNLSIPVVANGEIWSLEDFKRCAEQSKCSDFMLGRGLLAKPDLALEIKQYMAGEAFNPLSWDEVCAHVRTLFERNCQSYPPKYLGNRVKQWLFYLQRQYSEAAELFEAIKRERDEQALRRALGF

SEQ ID NO: 95131 - DNA, 999 bp, Pediococcus pentosaceus ATCC 25745
  CDS (1)..(999)
atggaatggaaaattggggacattacaatcccaaatcaactagttgttgctccaatggccggtgtgactaatactgcttttcgaatgatctgtaaaaaattcggtgcgggattagtggtctgcgaaatgatatccgaccgaggaattatctatggaaacaaaaaaactctgagcatgatgacagttgatccaaatgaacatccaatgagtattcaaatttttggtggtactaaagaaacattagtagaagctgctaaatttgttgatcaaaatactgatgcagatattattgacatcaatatgggatgtcccgtaaacaaagttgttaatactgatgctggtgcccgttggttgctggatcctaataaggtatatgagatggtatcttacgtgacggatgcggttaaaaaaccagtaacagttaaaatgcgaactggttgggatgctaaccatattttagcggttgaaaatgcattagcagccgaacgtgcgggtgcttctgcgcttgctatgcacggtcgaactcgtaaacaaatgtatactggacaagcagattggaatattttaaaagaagttggaagtcagttacatattccatttatgggtaatggagatgtacggacacctgaagatgccaaaagaatgttggatgaagttggtgcggacgcggtaatgattggccgtgctgtactgggtaatccatgggaattacaacgaatttcagcttatttaaatgatggaacagttattgatgaacctacaccaagagaaaaaattgagattgcaaaagagcatttacacgctctagtagaattgaagggtgaaaatgtcggtccgcgagaattccgtggacaagctgcctactacctcaagggtattccacattcagctcgaaccaaggtggctgtaacgggagcagatactgagcaacaaatgattaatatttttgatagttttattgaaaaactcgaaactagaagagtaagaactttgaattaa

SEQ ID NO: 95132 - protein, 332 aa, Pediococcus pentosaceus ATCC 25745
MEWKIGDITIPNQLVVAPMAGVTNTAFRMICKKFGAGLVVCEMISDRGIIYGNKKTLSMMTVDPNEHPMSIQIFGGTKETLVEAAKFVDQNTDADIIDINMGCPVNKVVNTDAGARWLLDPNKVYEMVSYVTDAVKKPVTVKMRTGWDANHILAVENALAAERAGASALAMHGRTRKQMYTGQADWNILKEVGSQLHIPFMGNGDVRTPEDAKRMLDEVGADAVMIGRAVLGNPWELQRISAYLNDGTVIDEPTPREKIEIAKEHLHALVELKGENVGPREFRGQAAYYLKGIPHSARTKVAVTGADTEQQMINIFDSFIEKLETRRVRTLN

SEQ ID NO: 95133 - DNA, 1005 bp, Trichodesmium erythraeum IMS101
  CDS (1)..(1005)
atgactattctatctcctgaattaaagaaaaaattatctactccactaaaaattggcaactttgaagttaaaagtcgtgtccttcaatcaccattatcaggagtaacagacttagtatttcgtcgtctagtacgtcgtcatgctccagagtcaatgatgtacactgaaatggtaaatgctacagggttacattatgtaaaagaattacctcaaataatggaggttgataataatgagcgaccaataagtattcaattatttgattgtcgtccagatttcttagcagaagcagcagaaatggctgtaaaagaaggagctgatactgttgatattaatatgggttgtcctgttaataaaatcacaaaaaacggcgggggttcttcattattaagacaaccagaattagctggagaaattgttagtaaagttgttaaagctgttcctattcctgttactgtaaaaacaagaattggttggagtaatcaagaaattaatattctcgaatttgctcaaagaatggaagatgcaggtgcccaaatgttaactttacatggtcggactcgtgcccaaggatataatggcccggccagatgggaatggattacaaaagttaaggaaatactttctatcccagttattgctaatggagatattttctctgttgatgctgcaatacgttgtttggaggaaactagagcagatggagtaatgtgctcccgtggaactttaggttatccttttttagtgggagaaattgattattttttgaaaaatggtgtaaaaaaagtatcaccaactgcagcagaaaaactggagtgtgctaaagagcatttacgggcactatgggaatataaaggcgatcgcgggattcgtcaagctcgtaagcatttgacttggtattctaagggttttccaggagcaggtgagttgcggggtcagttggcaaaagtacaaactgtagcgcaaggttgtgatttgattgataaggtaattgaaaatttatag

SEQ ID NO: 95134 - protein, 334 aa, Trichodesmium erythraeum IMS101
MTILSPELKKKLSTPLKIGNFEVKSRVLQSPLSGVTDLVFRRLVRRHAPESMMYTEMVNATGLHYVKELPQIMEVDNNERPISIQLFDCRPDFLAEAAEMAVKEGADTVDINMGCPVNKITKNGGGSSLLRQPELAGEIVSKVVKAVPIPVTVKTRIGWSNQEINILEFAQRMEDAGAQMLTLHGRTRAQGYNGPARWEWITKVKEILSIPVIANGDIFSVDAAIRCLEETRADGVMCSRGTLGYPFLVGEIDYFLKNGVKKVSPTAAEKLECAKEHLRALWEYKGDRGIRQARKHLTWYSKGFPGAGELRGQLAKVQTVAQGCDLIDKVIENL

SEQ ID NO: 95135 - DNA, 1005 bp, Moorella thermoacetica ATCC 39073
  CDS (1)..(1005)
atgagcgcaacacttaaaatcggcccggtcaccctggccgcccccctgattatggctcccatggccggttatacggaccgcgttttccgcctcctggcccgggaggctggggcggccctgacttatacagaaatgatcagcgcccagggacttatttataacaacaaaaacacccatgccctcctagacctgaagggggaaccgggtccggtggcggtccagctcttcggccgggaaccggagatcatggccgcagcgacccgcatcgccgtagccgccggtgctgctatcattgacctgaatatgggctgccccacccccaagatcgtcaaaaatggcgagggttcggccctgatgcgggacctgccccgggcggcggccattgttgccgccatggtccgggccgccggcccggtgccggtaacggtaaaaatgcgcctgggctgggacgaggattccatcaatgtggtggaggcggcccgggcggtggtttatgccggcgcggcggcagtggccatccatggccgcaccaggagccagttttacagcggccgcgccgactggagctattttcgccgggtcaaggaggccgtggatgtgccggtaatcggcaacggcgacgtcagaacggcccgggacgctgtcaccatgctagcggaaacagggtgcgacggggtcatggtgggtcggggagcagtcggtaacccctggctgttgacggccatccgcgccgtcctggaaggccgaccggaaccgccgccagtagatgtcaggaccaggatgaccatggcctgccggcacttaaagctcctggtagaactcaaaggggagactaccgccgtcaaagagatgcgcaagcacctggcttgttacttccgcggtttgccaggggccgcccgcctgcggcagcaaatcaataccctcaccactgctgccgaagttatcgccgctatcaaagcctacctgcgtgactacccttgccaggactataactttttgctataa

SEQ ID NO: 95136 - protein, 334 aa, Moorella thermoacetica ATCC 39073
MSATLKIGPVTLAAPLIMAPMAGYTDRVFRLLAREAGAALTYTEMISAQGLIYNNKNTHALLDLKGEPGPVAVQLFGREPEIMAAATRIAVAAGAAIIDLNMGCPTPKIVKNGEGSALMRDLPRAAAIVAAMVRAAGPVPVTVKMRLGWDEDSINVVEAARAVVYAGAAAVAIHGRTRSQFYSGRADWSYFRRVKEAVDVPVIGNGDVRTARDAVTMLAETGCDGVMVGRGAVGNPWLLTAIRAVLEGRPEPPPVDVRTRMTMACRHLKLLVELKGETTAVKEMRKHLACYFRGLPGAARLRQQINTLTTAAEVIAAIKAYLRDYPCQDYNFLL

SEQ ID NO: 95137 - DNA, 1053 bp, Thiobacillus denitrificans ATCC 25259
  CDS (1)..(1053)
atgcgcatcggttcccacctcctgaaaaaccgcctgatcgtcgccccgatggccggcgtgaccgatcggccgtttcgccagctgtgcaagaagctcggcgcgggcatggcggtctcggaaatggtgacgtcgaactcgctgctgtacggctcggccaagacggcgcggcgcgccaaccacgaaggcgaggtcgacccgatcagcgtccagatcgccggcgccgatccgcggatgatggccgaggcggcgcgccacaacgccgaccgcggcgcccagatcatcgacatcaacatggggtgcccggcgaagaaggtctgcaacgtgatggccggctcggcgctgctgcaggacgaggcgctcgtcggacgcatcctcgacgccgtcgtcgcggccgtgcccgagctgccggtgacgctgaagatccgcaccggctgggatcgcgaacaccgcaacgcactcgccatcctcgggatcgccgagaacgccggcgtaaaggcgctcgcgatccacggccgcacacgcgcctgcggctactcgggcgaggccgaatacgacacgatccgcgcggtgaaggccgcggcgcggattccggtcatcgccaacggtgacatcacgaccccggaaaaagcgcgccacgtgctcgaacacacgggcgccgacgcggtcatgatcggccgcgccgcccaggggcggccctggatcttccgcgagatcgagcattacctgcgcaccggcgaacacctgccgcagcctgaagtggccgaaatccaccgcgtgctgctcgatcacctccacgacctctacggcttctacggcgaagtcaccggggtgcgcgtcgcgcgcaagcacatctcctggtacacgcgcgggctcgtcggcagcagcgcttttcgccacgccatgaaccggctcgactcggtcgccgagcagcttgccgtcgtcaacgactatttcgcccaggcggcgcgcgcggacgtccgcctccgctacgaagccggccaagacaacaataacgcggacgacctgctgccggcctcacggctcgcggcataa

SEQ ID NO: 95138 - protein, 350 aa, Thiobacillus denitrificans ATCC 25259
MRIGSHLLKNRLIVAPMAGVTDRPFRQLCKKLGAGMAVSEMVTSNSLLYGSAKTARRANHEGEVDPISVQIAGADPRMMAEAARHNADRGAQIIDINMGCPAKKVCNVMAGSALLQDEALVGRILDAVVAAVPELPVTLKIRTGWDREHRNALAILGIAENAGVKALAIHGRTRACGYSGEAEYDTIRAVKAAARIPVIANGDITTPEKARHVLEHTGADAVMIGRAAQGRPWIFREIEHYLRTGEHLPQPEVAEIHRVLLDHLHDLYGFYGEVTGVRVARKHISWYTRGLVGSSAFRHAMNRLDSVAEQLAVVNDYFAQAARADVRLRYEAGQDNNNADDLLPASRLAA

SEQ ID NO: 95139 - DNA, 933 bp, Silicibacter sp. TM1040
  CDS (1)..(933)
atggccgggatcactgaccgcccgtttcgggatctggtgcgctctttcggggcgggcctagtggtgagcgagatggtcgccagtcaggagatggttcaagccaagcccggcgtgcgcgagaaggcggaactgagcgccgatgtggagaatacctcggttcagatcgccgggcgcgacgcgtattggatggcagaggccgcgcgtcaggtggcagatcgtggggcgcggatgatcgacatcaacatgggatgtccggcaaagaaagtgaccaacggctattcgggctctgcgctcctgaagacccccgatcacgcgctgtcgttgattgaggcagtcgttcaggcggtggatgtgcctgtcacgctcaagacccggttggggtgggacgataactgtctcaatgccgctgatgtggcgcgccgcgccgaagccgcgggtgtccagatggtcactatccatggtcgtacccggtgccagttttacaaaggtcatgctgactgggctgcgatctcggagatcaagaatgcgatctctgttcccttgctggccaatggcgatattgtcgatgcaaaaagcgcgggcaaggcgctctcagactccggagcggatggcgtcatgatcgggcgcggtgtgcagggaagaccctggcttctggctcagatcgcgcatgatctctggggcacggctgctccggacgttcccgaagggcgcgcatttattgatctggtttcaaagcactacgaggcgatgcttgccttttatggggcggagttgggcctccgcgtcgcgcgcaagcacctaggctggtatatggatgaggccgggacacctgcggccctgcggcgcgaggttctgacggccaaatccccctctgatgtgttgcgattgctcccgagtgcgcttcagggaactgagcaggagactgccgcatga

SEQ ID NO: 95140 - protein, 310 aa, Silicibacter sp. TM1040
MAGITDRPFRDLVRSFGAGLVVSEMVASQEMVQAKPGVREKAELSADVENTSVQIAGRDAYWMAEAARQVADRGARMIDINMGCPAKKVTNGYSGSALLKTPDHALSLIEAVVQAVDVPVTLKTRLGWDDNCLNAADVARRAEAAGVQMVTIHGRTRCQFYKGHADWAAISEIKNAISVPLLANGDIVDAKSAGKALSDSGADGVMIGRGVQGRPWLLAQIAHDLWGTAAPDVPEGRAFIDLVSKHYEAMLAFYGAELGLRVARKHLGWYMDEAGTPAALRREVLTAKSPSDVLRLLPSALQGTEQETAA

SEQ ID NO: 95141 - DNA, 984 bp, Rickettsia akari str. Hartford
  CDS (1)..(984)
atgatcaaaatcggtaatatagaactttcttcaaatgtaatgcttgctccaatgtctgatattacggacttagaatttagaaaattggtaaaaagatttggggcagggcttgtagtttctgagatgatagcaagtcgtgcaatggttgtgaaatctaggcagtcaatgcaaaaatgtgctatcatgcatgacgatccgacaagtgcatgcgtgcagctagcaggctgtgagcctaatgtaatagctgaagctgctaaaatgaacgaggatatgggagcgaaaattatcgatcttaatttcggctgtccagcgaaaaaagtagtaggcggttatgcaggtgcggctctaatgagtgatgaacagctggcatctaagatttttgaagctaccgttaaagcggtgaagattccaataacggttaaaatgcgtatggggtgggatgataatacgaaaaacgctccgactttatctaaaattgctgaaaactcagggattcaaatggtcaccgttcacggtagaacgagatgtcagttttactccggtaatgccgattggaattttataagatcagttaaagaagcagtaaaaattccggttattgctaacggtgacatcactaattttgctaaagcaaaagaagccctgcagaaatccggtgcagatggtattatggtcggtagaggagcatacggcaaaccttggattatttcacaaattgatcattaccttaaaaccggtgaaagaaaacctgatccatctatagcagagcagctagatatcgtaaccgagcattgtgaggcaatacttgattattatggcaaatctgttggcatacctattgctcgtaagcatattagttggtatagtagcggtttaccaagttcagcagagtttagaggtgccgttaatttgatgcatgaccccgcagagttaaaagagaaaattgcagaattttatacgagcattatggatacgaataaatga

SEQ ID NO: 95142 - protein, 327 aa, Rickettsia akari str. Hartford
MIKIGNIELSSNVMLAPMSDITDLEFRKLVKRFGAGLVVSEMIASRAMVVKSRQSMQKCAIMHDDPTSACVQLAGCEPNVIAEAAKMNEDMGAKIIDLNFGCPAKKVVGGYAGAALMSDEQLASKIFEATVKAVKIPITVKMRMGWDDNTKNAPTLSKIAENSGIQMVTVHGRTRCQFYSGNADWNFIRSVKEAVKIPVIANGDITNFAKAKEALQKSGADGIMVGRGAYGKPWIISQIDHYLKTGERKPDPSIAEQLDIVTEHCEAILDYYGKSVGIPIARKHISWYSSGLPSSAEFRGAVNLMHDPAELKEKIAEFYTSIMDTNK

SEQ ID NO: 95143 - DNA, 999 bp, Azotobacter vinelandii
  CDS (1)..(999)
atgtcggcggtacgcatcggcccctacactttgcccaaccgattgatcctggcgcccatggccggtgtcaccgatcgaccgtttcgcgcgctgtgccgccggctcggcgccggcatgacggtttcggaaatgctcaccagcgacgttcgcctgtggaacagccgcaagtcgcgcctgcgcctgccgcacggcgacgagccggaaccgcgctcggtgcagatcgctggcggcgacccgcagcggctcgccgaggcggcccggcgcaacgtggaactgggcgcgcagatcatcgacatcaacatgggctgtccggcgaagaaggtctgcaacaaagccgccggctcggcgctgatgcgcgacgaggcgctggtcgccgagatcctccgggcggtggtgaccgccgtcgaggtcccggtgaccctgaagatccgcaccggctgggaccgggccaaccgcaacggggtcggcatcgcccggctcgccgagcaggccggcatcgccgccctcgccgtgcatggccggacccgtgccgacctctacggcggcgcggccgaatacgacaccattgccgccatcaagcgggcggtatcgattccggtgttcgccaacggcgacatcgactcgccggaaaaggcccgccaggtgctcgacgccaccggtgccgacggcctgctgatcggccgtgcggcccaggggcggccatggatcttccgcgagattgagcactacctgcgaaccggcgagcgcctgccggcgatgacggcgctcgaggtggagcccgttctgctggagcacttggccgcactgtaccgtttctacggggaggagctgggcgttcgcatcgcccgcaagcacgtcggctggtacctggcgagcctgccgggcgcgcaggagtttcgagcccagttcaaccgcttggataccacggacgcacagagcgcccacgtgcggcgattcttcgccgaacgtcacaaagatggagaaggggtggccgcatga

SEQ ID NO: 95144 - protein, 332 aa, Azotobacter vinelandii
MSAVRIGPYTLPNRLILAPMAGVTDRPFRALCRRLGAGMTVSEMLTSDVRLWNSRKSRLRLPHGDEPEPRSVQIAGGDPQRLAEAARRNVELGAQIIDINMGCPAKKVCNKAAGSALMRDEALVAEILRAVVTAVEVPVTLKIRTGWDRANRNGVGIARLAEQAGIAALAVHGRTRADLYGGAAEYDTIAAIKRAVSIPVFANGDIDSPEKARQVLDATGADGLLIGRAAQGRPWIFREIEHYLRTGERLPAMTALEVEPVLLEHLAALYRFYGEELGVRIARKHVGWYLASLPGAQEFRAQFNRLDTTDAQSAHVRRFFAERHKDGEGVAA

SEQ ID NO: 95145 - DNA, 960 bp, Dechloromonas aromatica RCB
  CDS (1)..(960)
atgtcccgcattcttctcgccccgatggaagggctcgccgacgatttgttgcgcggcgtgctgaccgatatcggcggttacgactggggcatttgcgaatttgttcgtgtttcgaacagcgttttgccagcgaaaacctacgagcggatttgtccggaactgctgaatggcagcaagactcggacgggtacgccgatgcgtgtgcaactgctcggctccgacccgcatttcatggcggaaaatgctcgccgtctggtggccctgaacccggctggcgttgatcttaattttggttgcccggcgccgacggtgtttcgtcatcgcggtggttcggcgctgctcggtgagccggaactattgaacgaaatcaccagcgccgtgcgctccgtcgtccccgcccacattccatttaccgccaagatgcgtctcggcattgacgataccagtcgggcgattgattgcgcccaggcactggaagccgccggcatcaacgaactgatcgtccatggccgcacccgatccgatggctatcgcccaccggcgcgctgggagtggatcgacaaggtgcgggacgccatccatattccactgatcgccaatggcgaggtctggaccgtcgaagatttccgtaactgccagctggcgacgggttgcgccgacatcatggtgggtcgcggcgcggtggctgacccgctgctggcgcgacgggtgcgcggcgaggaaaccggcggctgggatgagatcaggcccaccgtggccacctactggctgggcgtgcgcaagaaagtggtgccggtgcatgccggtggccgggtcaagcagtggctggccatgatgcggcgaaattatccggaggccgaggtgctttacgaacgtttgcggccgatcaagggcgctgccgacatcgatgctgcgctgattgccgaaggcctcctgactcctgaacagttggcggcatga

SEQ ID NO: 95146 - protein, 319 aa, Dechloromonas aromatica RCB
MSRILLAPMEGLADDLLRGVLTDIGGYDWGICEFVRVSNSVLPAKTYERICPELLNGSKTRTGTPMRVQLLGSDPHFMAENARRLVALNPAGVDLNFGCPAPTVFRHRGGSALLGEPELLNEITSAVRSVVPAHIPFTAKMRLGIDDTSRAIDCAQALEAAGINELIVHGRTRSDGYRPPARWEWIDKVRDAIHIPLIANGEVWTVEDFRNCQLATGCADIMVGRGAVADPLLARRVRGEETGGWDEIRPTVATYWLGVRKKVVPVHAGGRVKQWLAMMRRNYPEAEVLYERLRPIKGAADIDAALIAEGLLTPEQLAA

SEQ ID NO: 95147 - DNA, 1014 bp, Dechloromonas aromatica RCB
  CDS (1)..(1014)
atggattttgtcggtttccagcttcgcaacaacctgttcgtcgcccccatggccggcgtgacggatcgtcctttccgccagttgtgcaagaagatgggggctggcctggccgtgtccgaaatggtcacctccaattcattgctttatggcagcgccaagacgctgcgccgggccaatcacgaaggtgaggtcgccccgatctcggtgcagatcgccggcgccgatccgaaaatgatggccgaggcggccaaacacaacgtcgacaacggcgcccagatcatcgacatcaacatgggttgcccggccaagaaggtctgcaacgtgatggccggctcggcgctgatgcaggacgagcagcaggtcggacgcattctcgatgccgtcgttgctgcaatcccgaacaccccggtcacgctgaaattccgtaccggctggaatctggccaacaagaacgccccgaccatcgcgcgcatcgccgaatcggcgggcatccgtgccgtcgccatccacggccggacgcgctgccagcaatacaccggcgaggcggaatacgacaccatcgccatggtcaagacgctgatcagcatcccggtcatcgccaacggcgacatcacgaccccggaaaaggccaagcacgtgctcgacgtgaccggcgccgatggcgtcatgatcggccgcgccgcccagggtcgcccctggctgttccgcgagatcgaacactatctaaaaaccggcgagcacctgccaccggccgaggtcatggagattcacagcatcctgctggagcatctcgaagacctttacgctttctacggcccggaaacggggttcaaggtcgcccgcaagcacatctcctggtacaccaaggggttggttggctcggcggccttccgcaaggaaatgaacgtcctgcccagcatcgatcaacagatgcaggcagtgaacgacttcttcagccgactggcggctgagcatcagcatttgaaatacacagaggaggcgttggcagcatga

SEQ ID NO: 95148 - protein, 337 aa, Dechloromonas aromatica RCB
MDFVGFQLRNNLFVAPMAGVTDRPFRQLCKKMGAGLAVSEMVTSNSLLYGSAKTLRRANHEGEVAPISVQIAGADPKMMAEAAKHNVDNGAQIIDINMGCPAKKVCNVMAGSALMQDEQQVGRILDAVVAAIPNTPVTLKFRTGWNLANKNAPTIARIAESAGIRAVAIHGRTRCQQYTGEAEYDTIAMVKTLISIPVIANGDITTPEKAKHVLDVTGADGVMIGRAAQGRPWLFREIEHYLKTGEHLPPAEVMEIHSILLEHLEDLYAFYGPETGFKVARKHISWYTKGLVGSAAFRKEMNVLPSIDQQMQAVNDFFSRLAAEHQHLKYTEEALAA

SEQ ID NO: 95149 - DNA, 933 bp, Haemophilus influenzae R2846
  CDS (1)..(933)
atgcgtgttattcttgcgcctatgcaaggggttttagatccctttgtacgtgaacttctcaccgaagtgaatgactacgatttatgtataacagaatttgttcgcgtagttgatcaacttctccctgaaaaagtattttatcgtttatgccctgaattaaaaaatcagggctttacttcttctggtacgcctgtgcgagtgcagttgctagggcagcatccagaatgccttgctgaaaatgcgattcgtgcgatcgatcttggctctcatggcgttgatttaaattgtggttgcccttctaaaacagtgaatggcagcaatggtggtgcggcattattgaaacagcctgaattgatttatcgtgccactcaagccttacgccaagccgtgccaagtgaatttcccgttagtgtaaaagtgcggttaggttgggatgatatttctcaagcctttgaaatcgctgatgcggtagagcaaggcggcgtaaccgaaattacagttcatggacgcacaaaagctgatggttatcgtgctgatcgaattaattggaaaaaaattagcgaagtccgagagcgtttatccattccagttattgctaacggagaaatttggcattggcaagatgggcaagattgcttatctcaaacaggttgtcaggatttaatggtaggacgaggcgcgttgaatattccgaatttaagtcatgttctgaaatcaaatgcagaaaaaatgccttggtatgagattcaaaaaatcttgcaaaaatatgctaatgttgaaaatgaatatgacagtggtttttatcatgtggcacgaattaaacaatggttacgttatttgaataaggaatatgatgaggcgaaccaagtgtttgataagattaagacctgccaaactgctgaagatttgaaattacggttaaatgataaataa

SEQ ID NO: 95150 - protein, 310 aa, Haemophilus influenzae R2846
MRVILAPMQGVLDPFVRELLTEVNDYDLCITEFVRVVDQLLPEKVFYRLCPELKNQGFTSSGTPVRVQLLGQHPECLAENAIRAIDLGSHGVDLNCGCPSKTVNGSNGGAALLKQPELIYRATQALRQAVPSEFPVSVKVRLGWDDISQAFEIADAVEQGGVTEITVHGRTKADGYRADRINWKKISEVRERLSIPVIANGEIWHWQDGQDCLSQTGCQDLMVGRGALNIPNLSHVLKSNAEKMPWYEIQKILQKYANVENEYDSGFYHVARIKQWLRYLNKEYDEANQVFDKIKTCQTAEDLKLRLNDK

SEQ ID NO: 95151 - DNA, 1032 bp, Methylobacillus flagellatus KT
  CDS (1)..(1032)
atgcagatcggtccttataagctgaagaacaatctggtggtcgccccgatggcaggcgtaaccgaccggcctttccgcgtgctgtgcaagaaaatgggcgcaggcttggccgtcagcgagatggtaacctccaactcactcctatatggcagtgccaagaccttacgccgcgccaatcacgaaggcgaggttgacccgatttctgtgcagatcgcgggcgccgacccgaagatgatggcggaagccgccaagcacaacgtggacaacggcgcccaaatcatcgacatcaacatgggctgtcccgccaagaagatctgcaacgtcatggccgggtccgcactcctcaaggatgagccactggtcgcacaaatcctcaaggccgtggtcaatgccgtagaggttcccgtcaccctcaagatccgtaccggctgggacaaacacaaccgcaatgccgtcgccgtcgccaggatggcggaagacatcggagtacaggcgctcgctatccatggccgcacgcgcgcatgcctctacactggcgatgcggaatatgacaccattgccgccgtgaagcaggccatcaggattcccttgatcgccaatggcgatatcaccacgcccgaaaaggccaagttcgtgctcgactacaccaaggccgacgccgtgatgatcggtcgtgccgcgcaaggccgtccctggatattccgcgagaccgaacacttcctcaataccggcgagcacctacctgcgccggaagtcgaggaaatccaccaggtcatgcttgagcatatccacgacctttaccatttctacggcgaactcaccggcatgcgcgtcgcgcgcaagcatatttcctggtacaccaagggcctggtgggatcagccaacttccgccaccacatgaaccaattgcagagcattgaagagcaactgcaatccatcaatgatttcttcggcgagctcaagcaacgcaatgcgcgcctgcaatacgaggcagagtccgtcgccactgacgatgaggccatggcagcataa

SEQ ID NO: 95152 - protein, 343 aa, Methylobacillus flagellatus KT
MQIGPYKLKNNLVVAPMAGVTDRPFRVLCKKMGAGLAVSEMVTSNSLLYGSAKTLRRANHEGEVDPISVQIAGADPKMMAEAAKHNVDNGAQIIDINMGCPAKKICNVMAGSALLKDEPLVAQILKAVVNAVEVPVTLKIRTGWDKHNRNAVAVARMAEDIGVQALAIHGRTRACLYTGDAEYDTIAAVKQAIRIPLIANGDITTPEKAKFVLDYTKADAVMIGRAAQGRPWIFRETEHFLNTGEHLPAPEVEEIHQVMLEHIHDLYHFYGELTGMRVARKHISWYTKGLVGSANFRHHMNQLQSIEEQLQSINDFFGELKQRNARLQYEAESVATDDEAMAA

SEQ ID NO: 95153 - DNA, 1053 bp, Chloroflexus aurantiacus
  CDS (1)..(1053)
atgaacaacaacataacgctcgaagaaattgcgcgcctgcccacgtcatatcaggtcgcgcacatccgaatcgaaccaaatatcatcctcgccccgatggccggggtcaccgatagcatctttcgccgcatgatcttgcggctgggtggctgtggcctggtgagtaccgagatgaccaatgcggccagtgttagccccaaagccctgcgccgacatcggttgctcgactatttgcctgaagagcggcctttgacgatgcaaatctccggcaacgatcctgatctggtggcaaatgcggcgcgggtcgtcgaacaattgggggccgacattatcgacatcaactgtggctgcccatcacccaaagtgaccggtggtggccacggatcagcgctgctgcgcgatctaccgaagatggaacggctcttgcgcgccgtgcgcgaggcggtccagattccggtcaccctcaagtttcgtgccggctgggacgaacagagcctcaactttattgaagccgggaagcgggctgaagcagccggcgtatctgcactggccctgcatccacggacgcgcgaacaggggtacaaaggtcaggccgactggtcgcgggtagctgcactcaaacaggccgtctccatcccggtgatcggaagtggcgacgtgaccagcgctcacgacgcgcttatccgtctgcgcgacagcggtgccgacggtgtcatgatcggacggggagcaatggccaacccctggatatttcgccagatcgccgatctgaggcggggagtgacgccatacgtaccgacgccggcagacaaacgcaacctcttgatcgaatacatgaccatttgcgccgaggaactgccagagcggctggcgcttaacaagatcaaacagttgatcggtcagtttcatgttggcctgcccggcagcaaccacctgcgggtagccgttcacacatcaaccagcctggccgaggcacgtgacgccatcgaacgattttttgccccattcctcgaatcagaccgagtcgtgcaggaaatggtagcggcggattag

SEQ ID NO: 95154 - protein, 350 aa, Chloroflexus aurantiacus
MNNNITLEEIARLPTSYQVAHIRIEPNIILAPMAGVTDSIFRRMILRLGGCGLVSTEMTNAASVSPKALRRHRLLDYLPEERPLTMQISGNDPDLVANAARVVEQLGADIIDINCGCPSPKVTGGGHGSALLRDLPKMERLLRAVREAVQIPVTLKFRAGWDEQSLNFIEAGKRAEAAGVSALALHPRTREQGYKGQADWSRVAALKQAVSIPVIGSGDVTSAHDALIRLRDSGADGVMIGRGAMANPWIFRQIADLRRGVTPYVPTPADKRNLLIEYMTICAEELPERLALNKIKQLIGQFHVGLPGSNHLRVAVHTSTSLAEARDAIERFFAPFLESDRVVQEMVAAD

SEQ ID NO: 95155 - DNA, 1035 bp, Polaromonas sp. JS666
  CDS (1)..(1035)
atgaaagctgaaccgcacgccacagtcttgctggcaccgatggaaggcctgctggactttgtcctgcgcgacatcctgacgcgggtcggcggcatagaccgctgcgtctccgaattcatccgcatcactgaccagctcttgcccgagcgcgtgttcacccgcatcgtgcccgagctgcacaacggtggccgcacgctggccggcgtgccggtgcgcgcgcaactgctcggttctgacccggcctgcatggccgagaacgcggcgcggctggctacgctcggcccggcaggcattgacctcaatttcggttgccccgccgctgtcgtcaaccgccacggcggcggtgcatccctgctcaaggagcccgaaaccctgttggccatcgtcagcgcggtgcgccgcgccgtgccggctggcatgccggtttcggccaagatgcggctgggctacaacgacgactcgcgtgcggtcgaatgcgcactggccattgccgaaggcggcgccggcgagctggtggtgcatgcccgcaccaaggcgcaggcctacaagccgcccgcctactgggagcgcattgccgacatccgcgccgcggtgcagatacccgttgtcgccaatggcgaaatctggacggtggacgatgcgcgccgctgccgcgaagcctcgggctgcagcatgctgatgattggccgcggcgccgtggcagaccctggcctggggctggccatcaaggcggctatgagtcacccggccgctggcgggcaggagccgggcatcacgtgggcagaacttgtgccgctgctggctgatttctggcacgtggtgtgcgcccgcctggatgcgcgtgcccggcccggccggctcaagcagtggctgaattttttgcgccgccgttttccgcaagccgaagccgcctaccaggtgctcaagaccatcaccgacccggccttgattgacgagtggctggcagccttggtggaggcggacgcccggcgcagcgctgacttgctggagcgcgctgaactcctgcctgcctga

SEQ ID NO: 95156 - protein, 344 aa, Polaromonas sp. JS666
MKAEPHATVLLAPMEGLLDFVLRDILTRVGGIDRCVSEFIRITDQLLPERVFTRIVPELHNGGRTLAGVPVRAQLLGSDPACMAENAARLATLGPAGIDLNFGCPAAVVNRHGGGASLLKEPETLLAIVSAVRRAVPAGMPVSAKMRLGYNDDSRAVECALAIAEGGAGELVVHARTKAQAYKPPAYWERIADIRAAVQIPVVANGEIWTVDDARRCREASGCSMLMIGRGAVADPGLGLAIKAAMSHPAAGGQEPGITWAELVPLLADFWHVVCARLDARARPGRLKQWLNFLRRRFPQAEAAYQVLKTITDPALIDEWLAALVEADARRSADLLERAELLPA

SEQ ID NO: 95157 - DNA, 1071 bp, Polaromonas sp. JS666
  CDS (1)..(1071)
atgaacattggcccctacgctttggcaaacagactgtttgttgcgcccatggctggtgtgacggaccggccgtttcgccagctgtgcaaaaagctgggggcgggctatgcggtcagcgagatggtgacctcgcgccgcgatttgtgggacagcctgaagacttcgcgccgtgccaaccatgccggcgaggctgcgccgattgcggtgcagattgccggcaccgacgcgcagatgatggccgaagctgcggcctacaacgtggaccgcggcgctcaaatcatcgacatcaacatgggttgcccggccaagaaggtgtgcaacaaatgggccggctcggccctgatgcaggacgaaacgctggcgctgcagattgtggaggccgtcgtcgccgcctgcgccccccatggcgttcctgtcacgctcaagatgcgcaccggctggtgccaggcccacaaaaacgccctggcgattgcgcgcgcggctgaaagcgccggcgtgcagatggttaccgtgcatggccgcacgcgcgagcagggatacaagggcttggccgaatatgacaccattgccgcggtgaagtcggccttgcgcattccggtggtggccaatggcgatatcagcagtccggaaaaagcccgcgatgtgctggcttacaccggtgccgatgccgtgatgattggtcgtgcggcccagggacggccctggattttccgcgaggtggcgcatttcctggccacgggcacgcatcttgcgccgccgctggtcgcggaagtcagacgcctgttgctcgatcatttgctggatcactatgatctgtatggccaatacaccggtgtgcgcaccgcacgcaagcacatcggctggtatgtcaagaccttgccgggtggtgaggtgtttcgcgcaaagatgaatctgctggaagactgcgaggcacagctgcgcgcagtcggggattttttcgaggcgcttggcgaccggatggaccgcattccggcaactggggacgccgggagcgggccgaggcaggcatggatgaacaaagataaaaatcaggaggaagctgctgcatga

SEQ ID NO: 95158 - protein, 356 aa, Polaromonas sp. JS666
MNIGPYALANRLFVAPMAGVTDRPFRQLCKKLGAGYAVSEMVTSRRDLWDSLKTSRRANHAGEAAPIAVQIAGTDAQMMAEAAAYNVDRGAQIIDINMGCPAKKVCNKWAGSALMQDETLALQIVEAVVAACAPHGVPVTLKMRTGWCQAHKNALAIARAAESAGVQMVTVHGRTREQGYKGLAEYDTIAAVKSALRIPVVANGDISSPEKARDVLAYTGADAVMIGRAAQGRPWIFREVAHFLATGTHLAPPLVAEVRRLLLDHLLDHYDLYGQYTGVRTARKHIGWYVKTLPGGEVFRAKMNLLEDCEAQLRAVGDFFEALGDRMDRIPATGDAGSGPRQAWMNKDKNQEEAAA

SEQ ID NO: 95159 - DNA, 927 bp, Campylobacter coli RM2228
  CDS (1)..(927): transl_table=11
atgatagattttagcaaaaagcctttatttttagctcctatggcgggtttttcagacctgccttttcgcaatgtggtaaaaaaatttggtgcagatatcacaataagtgaaatgataagttccaatgctttagtttatgaaagctctaaaaccttacatatgctagaaagagctgaacttgaaaacccttatatagtccaagttgcagggggcgataaagaagtgcttaaaaaagcagttcaaatgcttaatgaaatggattttgtagatggcattgactttaattgtggttgtcctgtaaataaagtcgtcaaacaatgtgcaggaagtgctctgctagaaaatttagagctttttaaaagccttgtgggagtgattaaagaaaacaataaaaaaagccttacaagtgttaaatttcgcttaggctttaatgaaaaatatcccgaaaaaatggctaaaatttgcgaaagcttgggggtggattttgtaagtattcatggacgcacaagaaaacagctttatagtggaaaagcggattatgaatccattgccaatgctaaagcaagcgtgaaaattcctgtgatcgcaaatggtgatatcaatgctcaaaatgctaaagaggtttatgagatcacaaaatgtgatggacttatgatagggcgtgcaagtgtgggaaatccttggatattttatgaaatcaaaagtggtaaaaatgtagatgaaaaactcaaaaaagaaatcatactcactcattttgacgaaatgataaaacactataaagatcaaggtgtgagtatatttcgtaaacatttacacgagtattccaaaggccataaagatgcttcagcctttagagatagtgttaatcgcatcgacaatgtcgaagaaatgcgaaaaaaaatagaagaattttttagtttaacttga

SEQ ID NO: 95160 - protein, 308 aa, Campylobacter coli RM2228
MIDFSKKPLFLAPMAGFSDLPFRNVVKKFGADITISEMISSNALVYESSKTLHMLERAELENPYIVQVAGGDKEVLKKAVQMLNEMDFVDGIDFNCGCPVNKVVKQCAGSALLENLELFKSLVGVIKENNKKSLTSVKFRLGFNEKYPEKMAKICESLGVDFVSIHGRTRKQLYSGKADYESIANAKASVKIPVIANGDINAQNAKEVYEITKCDGLMIGRASVGNPWIFYEIKSGKNVDEKLKKEIILTHFDEMIKHYKDQGVSIFRKHLHEYSKGHKDASAFRDSVNRIDNVEEMRKKIEEFFSLT

SEQ ID NO: 95161 - DNA, 927 bp, Campylobacter lari RM2100
  CDS (1)..(927): transl_table=11
atgatagattttagtaaaaagcctttatttttagctcctatggcaggtttttcagacttgccattaagaaatttagtaaagcaatttggagctgatataaccattagtgaaatgataagttctaatgccttagtatatgagagctcaaaaactcttaaaatgctagaaaaagccgaacttgaaaatccttacatagttcaaattgcaggctcagatgaaagcgtaatttgcaaagcagtagaaattttaaatcgttttgattttatagatggtattgattttaattgtggttgccctgtgaataaggttataaaacaatgtgcaggtagcgctcttttacaagatcttgataaattacaaagaattttagaacttatcaaaaaaacaagtaataaaaaatcaactagcgtcaaagtaagattaggatttgataaaaaagatcccattgccatcgctaaagcgtgtgaaaatgctggagtagattttatcagtatgcatggtcgcactagaaaacaaatgtatagtggaaatgctgattatgaagccatagctttagccaaagaaaatatcaaaattcctttagttgcaaatggtgatattagcgaagataatgccaaagaggtgtttaaaataacaaattgtgatgctttgatgatagggcgtgcaagtgtaggaaaaccttggatattttatgagataaaaactggtaaaaaaatcgaaaaggctatgaaaaataaaatcatttttgcacattttgaagaaatgttaaagcattataaagaacaaggcataagcatctttagaaaacatttgcatgagtattctaaaggttatgatgatgcttctaattttagagattgtgttaatcgcattaatgacgcagaaattatgcgaaaatatattcaagaatttttcaataaggaatga

SEQ ID NO: 95162 - protein, 308 aa, Campylobacter lari RM2100
MIDFSKKPLFLAPMAGFSDLPLRNLVKQFGADITISEMISSNALVYESSKTLKMLEKAELENPYIVQIAGSDESVICKAVEILNRFDFIDGIDFNCGCPVNKVIKQCAGSALLQDLDKLQRILELIKKTSNKKSTSVKVRLGFDKKDPIAIAKACENAGVDFISMHGRTRKQMYSGNADYEAIALAKENIKIPLVANGDISEDNAKEVFKITNCDALMIGRASVGKPWIFYEIKTGKKIEKAMKNKIIFAHFEEMLKHYKEQGISIFRKHLHEYSKGYDDASNFRDCVNRINDAEIMRKYIQEFFNKE

SEQ ID NO: 95163 - DNA, 927 bp, Xenopus laevis
  CDS (1)..(927)
atgaaatatttaacacaaaatgcaatggatttatttcgttctgataacttagttcggatatctgctcctatggttcgatattcaaagctggccttcaggacactggtgagaaagtatgactgcgatttatgttatactccaatgatcattgctgctgattttgtcaaatctgtgaaagcaagagacagcgaatttacaacaaatcaaggtgattgtccactgatagttcagtttgctgctaaagaagcccaggtattagcagatgctgcaagccttgtctctccatttgccagtggaatagacctcaactgtggctgtcctcagaggtgggcaatggctgaaggatatggtgcttgcttaataaataacccagagttggttagtgatatggtgagacaagttcgcaaccaagttggcagttcagagtttacgatatcaatcaagatcaggatccatgcagacatctccagaacagttgacctctgccgaaaggctgaagcggctggtgtatcttggattacagtacatgggagaactcatgatgaaagacatcagccagtgcactacaatgcaataaaaaatattaaagaaagcttgtctatacctattgttgccaatggggatattaaaagtttaaaagaagcggagaatattcatcaaataacaggggcagatggtgttatggctgccagggggcttctcgctaatcctgccatgtttgcagggtatgaagaaactccactggcatgtatacaagactgggttgacattgcactggaacatggaaccccttttacttgtttacatcatcatttgatgtatatgatggaaaggataacatcaaaacaagagaaaagaatttttaatatcttatctagcacatctgcagttttagattatttaagagaccattacgaaatacaatag

SEQ ID NO: 95164 - protein, 308 aa, Xenopus laevis
MKYLTQNAMDLFRSDNLVRISAPMVRYSKLAFRTLVRKYDCDLCYTPMIIAADFVKSVKARDSEFTTNQGDCPLIVQFAAKEAQVLADAASLVSPFASGIDLNCGCPQRWAMAEGYGACLINNPELVSDMVRQVRNQVGSSEFTISIKIRIHADISRTVDLCRKAEAAGVSWITVHGRTHDERHQPVHYNAIKNIKESLSIPIVANGDIKSLKEAENIHQITGADGVMAARGLLANPAMFAGYEETPLACIQDWVDIALEHGTPFTCLHHHLMYMMERITSKQEKRIFNILSSTSAVLDYLRDHYEIQ

SEQ ID NO: 95165 - DNA, 939 bp, Klebsiella pneumoniae
  CDS (1)..(939): transl_table=11
atgcgtgtattactggcgccgatggaaggcgtgctcgattcgctggtgcgcgagctgctgaccgaagtgaatgattacgatctctgcatcaccgaattcttgcgcgtggtggatcagctcctgccggtaaaatcgttctacaggctgtgtccggaactgcataacaacagcctgacgccgtccggcacccgcgtgcgcgtgcagctgctcgggcagtatccgcagtggctggcggaaaacgccgctcgcgcggtcgagctcggttcctggggcgttgacctcaactgcggctgcccgtcaaagctggtgaacggcagcggcggcggggcgacgctgctgaaagaccctgagcttatctatcgcggcgcgaaagcgatgcgcgaggcggttcccacccatctgccggtcacggtaaaagtacggcttggctgggacagcggcgagcggcgatttgaaattgccgatgcggtccagcaggcgggcgccagcgagctggtggtgcacggccgcaccaaagaggacggctataaagcggagcgcatcgactggcaggccatcggcgaaatccgtcagcgcctgactattccggtggtggccaacggtgaaatctgggactggcaaagcgcccaggattgcctggccgcgaccggctgcgactcggtgatgattggccgcggcgccctgaacgttccaaacctgagccgggtgataaaatataacgaaccacgtatgccctggccgcaggtggtcgaactgctgcaaaaatatacccgcctggaaaagcagggcgacaccggtctttatcacgtcgcgcgtatcaaacagtggctgagctatttgcgtaaagaataccttgaggctgctgagctgttcagcgcggtgcgcaccctacaggattcaaccagcattgcgcgcacgattaacgactggcgtagctaa

SEQ ID NO: 95166 - protein, 312 aa, Klebsiella pneumoniae
MRVLLAPMEGVLDSLVRELLTEVNDYDLCITEFLRVVDQLLPVKSFYRLCPELHNNSLTPSGTRVRVQLLGQYPQWLAENAARAVELGSWGVDLNCGCPSKLVNGSGGGATLLKDPELIYRGAKAMREAVPTHLPVTVKVRLGWDSGERRFEIADAVQQAGASELVVHGRTKEDGYKAERIDWQAIGEIRQRLTIPVVANGEIWDWQSAQDCLAATGCDSVMIGRGALNVPNLSRVIKYNEPRMPWPQVVELLQKYTRLEKQGDTGLYHVARIKQWLSYLRKEYLEAAELFSAVRTLQDSTSIARTINDWRS

SEQ ID NO: 95167 - DNA, 1191 bp, Oryza sativa
  CDS (1)..(1191)
atgtcgccgccggccgccgcccacctcgccaccgcctccgatcccgacgaggacctctgcttcaccaccgaatcggtcgcgcccgcggaggagaccgccccgcccttgcccgcccctccgccgccggtgtccgcggaggagagggtggagcgcgcgtgggcgcactggaggcggctgggctccccgaagatggtggtggcgcccatggtggacaactcggagctccccttccgcatgctgtgccgccgctacggggcgaccggggcatacacgcccatgctccactcccgcatcttctccgagaacgagaagcacagggccatggagttcaccacatgcaaggaggaccgtccactttttgttcagttttgtgcaaatgatcctgacattttgttacaagcagcaaagattgtggaaccgtactgcgactatgtcgatatcaattttggatgcccacagcgcattgctagaagggggtactatggtgcgtttctcatgaacaaccttcctctcgtaaaatcccttgtacagaatctatcagcaaacctccatgttccagtatcatgcaagattcgcatattcccgcgactggaggacacactggcctacgcaaagatgcttgaagaagctggtgcttctctggtagctgtgcatgggcggactagagatgagaaggatgggaagaaatttcgagctgactgggatgccattaaagctgtcaaagatgctcttaggatacctgtacttgcaaatggaaacattcgccatttggatgatgtgaaggattgccttgaacatactggtgctgatggtgtgctttcagctgaaactcttctagaaaatccagcattgtttgctggtttccggacaaaggaatggaaagaaaatggtgatgaagatgaagctagtggcttagaccaggctgatctagtcattgagtatttgaaactgtgcgagcagtaccctgttccatggagaatggttcgatcccatgttcacaagatgctaggggactggtttagggtgcatcctcaagtgagggaggaactcaatgctcagtccaagctcactttcgagtggttgcatgatatggtaaagaggctgaaggatcttggtggaggaataccgctttacagaaacaataatgctttacagactacatcaaatgggctagctgcaagcaacgcctga

SEQ ID NO: 95168 - protein, 396 aa, Oryza sativa
MSPPAAAHLATASDPDEDLCFTTESVAPAEETAPPLPAPPPPVSAEERVERAWAHWRRLGSPKMVVAPMVDNSELPFRMLCRRYGATGAYTPMLHSRIFSENEKHRAMEFTTCKEDRPLFVQFCANDPDILLQAAKIVEPYCDYVDINFGCPQRIARRGYYGAFLMNNLPLVKSLVQNLSANLHVPVSCKIRIFPRLEDTLAYAKMLEEAGASLVAVHGRTRDEKDGKKFRADWDAIKAVKDALRIPVLANGNIRHLDDVKDCLEHTGADGVLSAETLLENPALFAGFRTKEWKENGDEDEASGLDQADLVIEYLKLCEQYPVPWRMVRSHVHKMLGDWFRVHPQVREELNAQSKLTFEWLHDMVKRLKDLGGGIPLYRNNNALQTTSNGLAASNA

SEQ ID NO: 95169 - DNA, 978 bp, Acetobacter diazotrophicus
  CDS (1)..(978): transl_table=11
gtgacggacctgccgttccgccggctggcgcggcggctgggcgcgggcctggtcatttcggaaatgatcgcctcgtgggccatggtgcgggagaaccaggccaccctgcgcatggccgaggtcgccgatgatgacggcccgaacgcggtgcagctggccggctgcgagcccgaggccatggcccaggcggcgcggatcgcggtcgatcgcggcgcggacatggtcgacatcaatttcggctgcccggtcaagaaggtggcggtcggccagcaggcgggctcggcgctgatgcgggacgaagccctggccgcgcggctgctggatgccgttgtgcgggccgtggacgtgccggtgacgctgaagatgcgcatgggctgggaccatgccagcctgaacgcgccggccctggcccgcatcgcggaacagacgggcatccgcatggtcaccgtgcatggccgcacgcgccagcaattctataacggcaccgccgactggtccttcgtccggcaggtgaaggacgcggtatcgctgccggtgatcgtcaacggcgatatccagacggtcgacgacgcgcggcaggccctggcgctgtcgggggcggacggggtgatgatcgggcgcggctgctatggccggccgtggttcctggcccaggtcgcgcaggcgctgacgaccggcgacatcgtgcccgaccccgacctggcgacggaaaaggcgatcgtgctggatcattacgacatgatgctgtcgcatttcggcgcccatcccgggctgcgcctggcgcgcaagcatgtcgcctggtattccgccggcctgccggattcggccggattccgcgccgccatcaaccgggtggaccaggcccaggaggccatcgggatgatctccgccttctatgaccggcacatcgctgccggttcccaccgcgcgcggcgcggcacggcggcgggcggtcaggatgccgcccaggcggcttga

SEQ ID NO: 95170 - protein, 325 aa, Acetobacter diazotrophicus
MTDLPFRRLARRLGAGLVISEMIASWAMVRENQATLRMAEVADDDGPNAVQLAGCEPEAMAQAARIAVDRGADMVDINFGCPVKKVAVGQQAGSALMRDEALAARLLDAVVRAVDVPVTLKMRMGWDHASLNAPALARIAEQTGIRMVTVHGRTRQQFYNGTADWSFVRQVKDAVSLPVIVNGDIQTVDDARQALALSGADGVMIGRGCYGRPWFLAQVAQALTTGDIVPDPDLATEKAIVLDHYDMMLSHFGAHPGLRLARKHVAWYSAGLPDSAGFRAAINRVDQAQEAIGMISAFYDRHIAAGSHRARRGTAAGGQDAAQAA

SEQ ID NO: 95171 - DNA, 1035 bp, Zymomonas mobilis
  CDS (1)..(1035): transl_table=11
atgaacagccctgaacataatcctacccataatctgatttcgcctattcagataggctctgtccgaattgataatccggttattctagctccgatgacaggcgttacggatttgccttttcgtcggattgtccgccgttatggttcgggattgaatgtgacggaaatgattgccagtcaggcgatgattcgggaaacgcgccaatcgttacaaaaatcgacatgggatccctatgaagagcccatttcggttcagttggttggctgcacgccggatgatatggccgaatcagccaaactgaatcaggatcgtggtgccgctattattgacatcaatatgggctgtcctgtcagaaaagttgtcagtggtgatgctggctcggctttgatgcgtgatttgaaactggcggcctcgattatcgaagcaaccgtcaaagcggtttctcttcctgtcaccttaaaaatgcggatgggctgggacctaaacagtctgaatgcaccagaacttgcgcgtattgcccaagatatcggggttcagatggtaacggtgcatggccgtactcgtaaccagctttataaaggtcatgcggattgggcttttgttcgccaagtcaaagacgccgtgtcgatacctgttattgtgaatggcgatatcaatagccttgatgatgctaaaacagccctgcaacaatccggtgctgatggcattatggttggacgaggcagctatggtaaaccgtggcttttatcccagttgatgcagggattgactgatggtgaaatggaaaaagcaccgtcgatagatgaacaatatcgcaccattaccgaacattatgaccatatgttaagctattacggtacgatcacgggcgtcaatatcgctcgcaaacatatcggatggtataccaaaggcctgcctgcttcggcagaatttcggaataaaatcaaccgtgaagaagaccccgacagggtaaaaagaaatgctggccgaattttaccgaccttggctcagccaaatagccgcctgacggattga

SEQ ID NO: 95172 - protein, 344 aa, Zymomonas mobilis
MNSPEHNPTHNLISPIQIGSVRIDNPVILAPMTGVTDLPFRRIVRRYGSGLNVTEMIASQAMIRETRQSLQKSTWDPYEEPISVQLVGCTPDDMAESAKLNQDRGAAIIDINMGCPVRKVVSGDAGSALMRDLKLAASIIEATVKAVSLPVTLKMRMGWDLNSLNAPELARIAQDIGVQMVTVHGRTRNQLYKGHADWAFVRQVKDAVSIPVIVNGDINSLDDAKTALQQSGADGIMVGRGSYGKPWLLSQLMQGLTDGEMEKAPSIDEQYRTITEHYDHMLSYYGTITGVNIARKHIGWYTKGLPASAEFRNKINREEDPDRVKRNAGRILPTLAQPNSRLTD

SEQ ID NO: 95173 - DNA, 1002 bp, Bacillus subtilis
  CDS (1)..(1002): transl_table=11
ttgttcaaaatcggagatattcaattgaaaaaccgggttgtgctcgcacctatggctggtgtctgcaactctgcgttcagattgactgtaaaggaattcggagccggattggtatgcgctgaaatggtcagtgacaaagcgatcctttacaacaatgcaagaacaatgggtatgctttatattgatgaacgtgagaaaccactgagccttcaaattttcggaggaaaaaaggaaacccttgtggaagcggcgaagtttgtagaccaaaacacaactgctgatatcattgatattaacatgggatgtcccgtgccgaagattacaaaatgcgatgcgggagccaaatggcttctcgatcctgataagatttacgaaatggtttctgcagtagtggatgctgttaataagccagttacagtgaaaatgagaatgggctgggatgaagaccacattttcgcagtgaaaaatgcacaggctgtagaacgtgcgggcggtaaagcagtggcgcttcacggccgtacgagagtgcagatgtacgaaggaacggcaaactgggatatcatcaaagaagtaaaacaatcagtatcgattccggttatcggaaacggcgatgttaagacaccgcaggatgctaagcgtatgctcgatgagacaggagtagacggggtcatgatcggacgcgctgcattgggtaacccgtggatgatttaccgtacggttcagtatcttgaaacaggtaaattaaaagaagagccgcaagtacgcgaaaaaatggccgtatgcaaactgcatcttgaccgcctgattgacttaaaaggtgaaaacgtagcggtaagagaaatgagaaagcacgctgcatggtatctgaaaggcgtgaaaggcaatgcgaacgttcgtaatgaaatcaatcattgcgagacgagagaagagtttgtacagcttttagatgcatttacggttgaagttgaggcaaaagagcttcaaaatgcaaaagtaggataa

SEQ ID NO: 95174 - protein, 333 aa, Bacillus subtilis
MFKIGDIQLKNRVVLAPMAGVCNSAFRLTVKEFGAGLVCAEMVSDKAILYNNARTMGMLYIDEREKPLSLQIFGGKKETLVEAAKFVDQNTTADIIDINMGCPVPKITKCDAGAKWLLDPDKIYEMVSAVVDAVNKPVTVKMRMGWDEDHIFAVKNAQAVERAGGKAVALHGRTRVQMYEGTANWDIIKEVKQSVSIPVIGNGDVKTPQDAKRMLDETGVDGVMIGRAALGNPWMIYRTVQYLETGKLKEEPQVREKMAVCKLHLDRLIDLKGENVAVREMRKHAAWYLKGVKGNANVRNEINHCETREEFVQLLDAFTVEVEAKELQNAKVG

SEQ ID NO: 95175 - DNA, 966 bp, Klebsiella pneumoniae
  CDS (1)..(966): transl_table=11
atgcgcatcggacactaccagctcaggaatcgactcatcgcagcgcctatggctggcattactgacagaccattccggacgttgtgttacgagatgggagcaggattgaccgtatccgagatgatgtcctccaacccgcaggtttgggagagcgacaagtcccgcttacggatggtgcacgttgatgagcccggtattcgtaccgtgcaaatcgccggcagcgtgccgaaggagatggctgcagccgcccgtattaacgtggaaagcggcgcccagattattgatatcaatatggggtgtccggctaaaaaggtgaatcgtaagcttgcaggttcagccctcttgcagtaccccgaccaggtgaagtccatcctgacggcggtcgtcaaagcagtggacgttcccgtaactctcaagattcgcaccggttgggaaccggaacaccgtaactgtgtagaaattgcccaactggctgaagaatgtggcattcaggctctgactattcacggacgcacgcgcgcctgcttgtttaacggagatgctgagtacgacagtattcgggcagttaagcagaaagtttccattccggttatcgcgaatggcgacattactgacccgcttaaagccagagctgtgctcgactatacgggggcagatgcccttatgataggccgtgccgctcagggaagaccctggatctttcgggaaatccagcactatctggacactggagagctgctgcccccgctgccgttggcagaggttaagcgcttgctttgtgcacacgttcgggaactgcatggcttttatggccaggcaaaagggtaccgaatcgcacgcaaacacgtatcctggtatctgcaggaacacgctccagatgaccagtttcggcgcacattcaacgccatagaagattccagcgaacagctggaggcgttggaggcatacttcgaaaattttgcgtaa

SEQ ID NO: 95176 - protein, 321 aa, Klebsiella pneumoniae
MRIGHYQLRNRLIAAPMAGITDRPFRTLCYEMGAGLTVSEMMSSNPQVWESDKSRLRMVHVDEPGIRTVQIAGSVPKEMAAAARINVESGAQIIDINMGCPAKKVNRKLAGSALLQYPDQVKSILTAVVKAVDVPVTLKIRTGWEPEHRNCVEIAQLAEECGIQALTIHGRTRACLFNGDAEYDSIRAVKQKVSIPVIANGDITDPLKARAVLDYTGADALMIGRAAQGRPWIFREIQHYLDTGELLPPLPLAEVKRLLCAHVRELHGFYGQAKGYRIARKHVSWYLQEHAPDDQFRRTFNAIEDSSEQLEALEAYFENFA

SEQ ID NO: 95177 - DNA, 999 bp, Pasteurella multocida
  CDS (1)..(999)
atgcggataggttcttatcagcttaaaaatcgcatttttcttgctcctatggctggcatcactgaccaaccatttcggcgaatctgcactcattatggggcaggtttaactttttctgaaatgatgtcaacgaatccgcaagtctggcataccgaaaaatcgaaactgcgcttggctcatcatcaagaagcaggaattaatgctgtgcaaatagctggttgtgatcccgatgagatggcgaaagctgctcaaatcaatgtagaatatggggcagaaattattgatatcaatatgggctgcccagccaaaaaagtgaatcgtaaaatggcgggctctgcgctgttacaatatcctgatttggtcaaacaaattcttaataaagttgtgaaatctgttactgtaccagtgacattaaagataagaacaggctgggataaagacaaccgaaattgtttagaaatcgctaaaattgcagagcaatgtggtattcaagcactgaccatccacggacgaacaaggagttgtatgtttgagggggaggctgaatatgacaatatcaaggcggtcaaagagcaactttctattccgattattgccaatggcgatattacttccgctgaaaaagcaaagtatgttcttgattataccaacgcagatgcaataatgatcggacgtggttcattaggcaatccgtggcttttccgagttatggaaagcttaattgaaaaagactcgattgttttagagccaagtttaaacgagaaatgtaatgtgattttacagcatatccaagaactgcatcaattttatggtgtggagaaaggatgtcgtattgcacgtaaacacgttgcttggtatttacagggaatccaacctaatcccgtttttagacaggcttttaatgcaattactgatcccaaagaacaattaattgctttagaaggtttttttaatttgattctgatggataaagaaaaaaatgttagaacaacaacgtaa

SEQ ID NO: 95178 - protein, 332 aa, Pasteurella multocida
MRIGSYQLKNRIFLAPMAGITDQPFRRICTHYGAGLTFSEMMSTNPQVWHTEKSKLRLAHHQEAGINAVQIAGCDPDEMAKAAQINVEYGAEIIDINMGCPAKKVNRKMAGSALLQYPDLVKQILNKVVKSVTVPVTLKIRTGWDKDNRNCLEIAKIAEQCGIQALTIHGRTRSCMFEGEAEYDNIKAVKEQLSIPIIANGDITSAEKAKYVLDYTNADAIMIGRGSLGNPWLFRVMESLIEKDSIVLEPSLNEKCNVILQHIQELHQFYGVEKGCRIARKHVAWYLQGIQPNPVFRQAFNAITDPKEQLIALEGFFNLILMDKEKNVRTTT

SEQ ID NO: 95179 - DNA, 972 bp, Proteus vulgaris
  CDS (1)..(972): transl_table=11
atgcgaatcggacagtatcagttaaaaaattgccttatcgcggctcccatggctggcgttacagaccgaccttttcggtcgctttgctatgatatgggtgcgggtatgacagtttctgaaatgctttcttccaatcctcaggtttggcagactgacaagtctcggttacgaatggtacatagtgatgaattggggatccgctccgtacaaattgcaggaagtgatcccgttgatatggcggccgctgcgaaaataaacgcagatagtggcgctcaaattatcgacattaatatgggttgccctgcaaaaaaggtgaataaaaagctagcgggttcagcactacttcgtcatcctgaccttgtcgcagagatcctctctgctgtggttaacgcggtagatgtacctgttactctcaagatccgtactggctggtcacctgatgaacgtaactgtgtagagattgccaaattggctgaacgttgtggtattcaggctcttactattcatggacgtacacgcgagtgtttgttcaaaggggaagccgaatacgacagcattcggacagttaagcagaatgtttctattcccattattgcgaatggagacataacagacccgctaaaagccagagcagtattagactacactggagccgatgctttaatgatcggtcgcgctgctcagggaagaccctggatctttcgggaaatccagcactatctggacacaggtgaactgttgccccctctgccgattgcagaggtacaacaaataatgcaaaagcatgtgcgtgagttgcacgacttttacggtcaaggcaaaggaactcgcattgcacgcaagcatgtctcttggtatctcaaggaacatgcccctgatgaccagtttcggcgctccttcaacgccatagaggatgccagcgaacagctggaggcgttggaagcatatttcgaaaattttttgcgtaaataa

SEQ ID NO: 95180 - protein, 323 aa, Proteus vulgaris
MRIGQYQLKNCLIAAPMAGVTDRPFRSLCYDMGAGMTVSEMLSSNPQVWQTDKSRLRMVHSDELGIRSVQIAGSDPVDMAAAAKINADSGAQIIDINMGCPAKKVNKKLAGSALLRHPDLVAEILSAVVNAVDVPVTLKIRTGWSPDERNCVEIAKLAERCGIQALTIHGRTRECLFKGEAEYDSIRTVKQNVSIPIIANGDITDPLKARAVLDYTGADALMIGRAAQGRPWIFREIQHYLDTGELLPPLPIAEVQQIMQKHVRELHDFYGQGKGTRIARKHVSWYLKEHAPDDQFRRSFNAIEDASEQLEALEAYFENFLRK

SEQ ID NO: 95181 - DNA, 966 bp, Salmonella typhi
  CDS (1)..(966)
atgcgcatcggacaatatcagctcagaaatcgcctgatcgcagcgcccatggctggcattactgacagacctttccggacgctgtgctatgagatgggagcaggattgacagtatccgagatgatgtcttctaacccgcaagtgtgggaaagcgataaatctcgtttacggatggtgcacgttgatgagccaggaattcgcacggtgcaaattgccggtagcgaccctgttgagatggccgatgccgcacgtattaacgtggaaagcggcgcccagattattgatatcaatatggggtgcccggcgaagaaagtgaatcgtaagctggcaggttcagccctcttgcagtacccggatttagtgaagtctatactcatcggggtcgtaaacgcggtggacgttcctgtgactctcaagattcgcaccggctgggcgccggaacaccgtaactgcgtagagattgcccaactggctgaagattgtggtattcaggccctgaccatccatggccgcacccgcgcctgtttgttcaacggagaagctgaatacgacagtattcgggcagttaagcagaaagtttccattccgattatcgcgaatggcgacattactaacccgcataaagccagagctgttctcgactatacaggggcggatgccctgatgataggccgcgcagctcagggaagaccctggatctttcgggaaatccagcattatctggacactggggagctgcttccgccgctgccgctggcagaggtaaagcgcttgctttgcacgcatgttcgggaactgcatgacttttacggtcaggcaaaagggtaccgaatcgcgcgtaaacacgtctcctggtatctccaggaacacgctccagacgaccagtttcggcgcacattcaacgctattgaggacgccagcgaacagctggaggcgttggaggcatacttcgaaaattttgcgtaa

SEQ ID NO: 95182 - protein, 321 aa, Salmonella typhi
MRIGQYQLRNRLIAAPMAGITDRPFRTLCYEMGAGLTVSEMMSSNPQVWESDKSRLRMVHVDEPGIRTVQIAGSDPVEMADAARINVESGAQIIDINMGCPAKKVNRKLAGSALLQYPDLVKSILIGVVNAVDVPVTLKIRTGWAPEHRNCVEIAQLAEDCGIQALTIHGRTRACLFNGEAEYDSIRAVKQKVSIPIIANGDITNPHKARAVLDYTGADALMIGRAAQGRPWIFREIQHYLDTGELLPPLPLAEVKRLLCTHVRELHDFYGQAKGYRIARKHVSWYLQEHAPDDQFRRTFNAIEDASEQLEALEAYFENFA

SEQ ID NO: 95183 - DNA, 969 bp, Shewanella oneidensis
  CDS (1)..(969): transl_table=11
atgcagattggaccctatcaactgaagaatcagctgatcgtggcaccaatggcaggtgtcaccgatcaagctttccgtaatctctgtcttcgttatggtgcagccttagcggtgtcggagatgctttcatccaatcctgaggtttgggatacggataagagccgccagcgtatgacacattctggtgaggaaggtattcgctcagtgcaaattgcaggtgcagatccagagttaatggcgcaggccgcccagttcaacgttgaacaaggtgcccatatcattgatatcaacatgggatgtcctgcaaaaaaagtgaataaaaagctggctggctcagccctaatgcaaaatccgcccctcgtaaaagacattttacaagccgtggttgccgcagtagatgtgcccgttacgttaaaaattcgcacaggctgggagcctgaacacaggaacggtgttcaaatcgcccagattgccgaggattgtggcatcgcctcgctggccgttcatggccgcacgagacaatgcatgtacaaaggcaacgccgagtacgacaccattaaagcaattaaacagaatgtctcgattcctgttgtcgcaaacggggatatcgacagtccggagaaagcccgctttgtgctggattacaccggtgtcgacgctctgatgataggacggggtgctcaaggacggccttggattttcagagaaatccagcactacttggagacgggtaataagctagcgcccattgaggtggcagaacagcgtcaagtgatgctggaacacctcaccaaactttatgatttgtatggtgaatataagggtatccgcttcgccagaaaacatattggatggtacctagaccaggaggatcagcgccagttccgggctgactttaatcagctggaaaccgctgcagaacagtattccctcgtggaatattattttgatgaattagtacagaattaa

SEQ ID NO: 95184 - protein, 322 aa, Shewanella oneidensis
MQIGPYQLKNQLIVAPMAGVTDQAFRNLCLRYGAALAVSEMLSSNPEVWDTDKSRQRMTHSGEEGIRSVQIAGADPELMAQAAQFNVEQGAHIIDINMGCPAKKVNKKLAGSALMQNPPLVKDILQAVVAAVDVPVTLKIRTGWEPEHRNGVQIAQIAEDCGIASLAVHGRTRQCMYKGNAEYDTIKAIKQNVSIPVVANGDIDSPEKARFVLDYTGVDALMIGRGAQGRPWIFREIQHYLETGNKLAPIEVAEQRQVMLEHLTKLYDLYGEYKGIRFARKHIGWYLDQEDQRQFRADFNQLETAAEQYSLVEYYFDELVQN

SEQ ID NO: 95185 - DNA, 969 bp, Vibrio cholerae
  CDS (1)..(969)
atgaaaattggaaactatcaacttaagaacaatctgatcgtcgccccaatggcgggtgtcaccgacagaccctttcgagagttgtgtttacgctacggggcaggaatggcggtcagtgaaatgatgtcgtgcaatcctgcgttgtggaaaacggccaaatcgcaaaaccgcatggtacatgaaggcgaatcgggcattcgctcagtacaaattgcgggcagcgatccacagctgatggccgaagccgcgcagttcagcgttgaaaacggtgcgcaaatcatcgatatcaacatgggctgcccagccaaaaaagtaaataaaaagctcgcgggttctgcactgctgcgctatccggatgtgattgaagacatcttgaaagcggtagtgaatgcagtgaatgtgccagtcacactcaaaacccgaacgggttgggatacagacaataaaaactgtctctcgattgctcaattagccgaagactgcggcatacaagcactggctctccatggacgaactcgtgcctgcatgtacaaaggtgaggcggaatacgacagcattaaagcggtcaaagcggctgtgagcattccggttatcgctaacggtgatatcgatagcccggagaaagcacgctacgtactggagtacaccggtgcagacgctttaatgattggccgtcctgcccaaggacgaccatggatttttcaggaaatccaacactttttggaacacggcaccacaatgccagaacttccaatttcggaagtgaaagacatcatgcttggtcatgtaaccgcactccatcagttttatggagagtacttaggcccacgaattgcgcgcaaacacgtgagttggtacctgcaagagcatgaacaagcgagtgcgtttcgccgtaccttcaacgccattgagactgctgaccagcaactcgatgcgctcgaagggtattttgataacgttgcatcataa

SEQ ID NO: 95186 - protein, 322 aa, Vibrio cholerae
MKIGNYQLKNNLIVAPMAGVTDRPFRELCLRYGAGMAVSEMMSCNPALWKTAKSQNRMVHEGESGIRSVQIAGSDPQLMAEAAQFSVENGAQIIDINMGCPAKKVNKKLAGSALLRYPDVIEDILKAVVNAVNVPVTLKTRTGWDTDNKNCLSIAQLAEDCGIQALALHGRTRACMYKGEAEYDSIKAVKAAVSIPVIANGDIDSPEKARYVLEYTGADALMIGRPAQGRPWIFQEIQHFLEHGTTMPELPISEVKDIMLGHVTALHQFYGEYLGPRIARKHVSWYLQEHEQASAFRRTFNAIETADQQLDALEGYFDNVAS

SEQ ID NO: 95187 - DNA, 999 bp, Xanthomonas axonopodis
  CDS (1)..(999): transl_table=11
atgcagatcggcccctactccatcgctcccaaggtgatcctcgcgcccatggcgggcgtcaccgacaagccgttccggctgctgtgcaagcggctgggcgcgggcctggcggtgtcggaaatgaccatttccgacccgcgcttctggggcacgcgcaaatcgctgcaccgcatggaccatgccggcgagccggacccgatcagcgtgcagatcgccggcaccgagccgcagcaactggccgaggcggcgcgctacaacgtcgaccacggtgcgcagttgatcgacatcaacatgggctgcccggccaagaaagtgtgcaatgcctgggccggctcggcactgatgcgcgatgaagagctggtggcacgcatcctgaccgcggtggtgcaggcagtgaacgtgccggtgacgttgaagatccgcaccggttgggattgcgaccaccgcaacggcccgacgatcgcgcggatcgcgcaggactgcggtatcgccgcgctcgccgtacacgggcgcacacgcgaccagcactacaccggcagcgccgagtacgcgacgattgcgcagatcaaggccgcgctgcagatcccggtggttgccaatggcgatatcgactcgccgcagaaagccgcccaggtgctgcgcgaaaccggcgccgatgccgtgatgatcggccgcgccgcgcaaggccgcccgtggatcttcggcgaggtggcgcattttttggccaccggcgaggtattgccgccgccgtcgctggcgttcgtgcgcgacaccttgctcggccacctggaggcgctgcacgcgttttatggccaaccgcaaggcgtgcgcatcgcacgcaagcatctgggttggtacgccaaggaccacccgcaaagcgccgacttccgggcggtggtcaatcgcgccgaaacccccgacgcgcagttggccctgacgcgcgattacttcgatgccttgatcgccggcgtgccgcccgcactatcggacgctgcctga

SEQ ID NO: 95188 - protein, 332 aa, Xanthomonas axonopodis
MQIGPYSIAPKVILAPMAGVTDKPFRLLCKRLGAGLAVSEMTISDPRFWGTRKSLHRMDHAGEPDPISVQIAGTEPQQLAEAARYNVDHGAQLIDINMGCPAKKVCNAWAGSALMRDEELVARILTAVVQAVNVPVTLKIRTGWDCDHRNGPTIARIAQDCGIAALAVHGRTRDQHYTGSAEYATIAQIKAALQIPVVANGDIDSPQKAAQVLRETGADAVMIGRAAQGRPWIFGEVAHFLATGEVLPPPSLAFVRDTLLGHLEALHAFYGQPQGVRIARKHLGWYAKDHPQSADFRAVVNRAETPDAQLALTRDYFDALIAGVPPALSDAA

SEQ ID NO: 95189 - DNA, 966 bp, Yersinia pestis
  CDS (1)..(966): transl_table=11
atgcgtattggacacttccagcttacaaattgcctgattgccgccccgatggcgggtatcacagatcgccccttcagagcgctatgtcatggtatgggggctgggatggctgtatctgaaatgctctcctctaatccagaggtttggcgaacggataagtcgcgtttacgcatggtccatgttgatgaacccgggattcgtaacgtgcaaattgccggtaacgatccagatgagatggcagcagccgccagaatcaatgtggcgagtggtgcccaaatcatcgatatcaatatgggatgtccagccaagaaagtgaaccgcaaactggcgggttctgcattattgcagcatcctgatctggtcaaacagatcctctccgcagtggttaatgcggtagatgtgccggtgacgttgaagatccggacgggttggtcaccagaacaccgtaactgtatagaaattgcccaactggccgaaaattgtggtatacaagccctgacgattcatggccgaacccgttcttgcctgtttaatggtgaggcggaatacgacagtattcgagcagttaagcagactgtttccattcccgttatcgcgaatggtgacatcactgacccgcataaagccagagcggtactcgactacactggagctgatgctctgatgataggccgtgccgctcagggaagaccgtggatcttccgggaaatccagcattatctggacactggggaactgctgccaccgatgccacttggcgaagtgcagcgtttgttagacgggcatatacgggaattgcacgacttttatggtccaggcaagggatttcgtattgcacgtaagcacgtctcttggtatctccaagagcacgcccctaacgaccagtttcggcgcacattcaacgccattgaggatgccagcgaacagctggaggcgttggaggcatatttcgaaaatcttgcgtaa

SEQ ID NO: 95190 - protein, 321 aa, Yersinia pestis
MRIGHFQLTNCLIAAPMAGITDRPFRALCHGMGAGMAVSEMLSSNPEVWRTDKSRLRMVHVDEPGIRNVQIAGNDPDEMAAAARINVASGAQIIDINMGCPAKKVNRKLAGSALLQHPDLVKQILSAVVNAVDVPVTLKIRTGWSPEHRNCIEIAQLAENCGIQALTIHGRTRSCLFNGEAEYDSIRAVKQTVSIPVIANGDITDPHKARAVLDYTGADALMIGRAAQGRPWIFREIQHYLDTGELLPPMPLGEVQRLLDGHIRELHDFYGPGKGFRIARKHVSWYLQEHAPNDQFRRTFNAIEDASEQLEALEAYFENLA

SEQ ID NO: 95191 - DNA, 969 bp, Alcaligenes eutrophus
  CDS (1)..(969): transl_table=11
atgagccggctgttcctggcccccatggaagggcttgccgactacgtcttgcgcgacgtgctgaccgacactggcggctacgacggctgtgtgtccgagttcgtccgggtgaccggttcgttgcttcccgcccgcgtctacgagcgcgaaacgcccgaaatcctcgccggcggctatacccgcagcggcacgccgatggtgatccagttgctcggcagcgatccggaatggctggcgcgcaatgccgcctatgccgcgaccttgtcgccgcatggcatcgacctgaacttcggctgccccgccaaggtcgtcaaccggcatggcggcggtgccatgctgctgacgaatcctgagttgttgaaccggatcgtcgcgtccgtgcgcgcggcggtgccggcccatatcgccgtgacggcaaaaatgcggctgggcgtttccgatgcctcgctggccattgattgcgccacggcgctggccgaaggcggcgcggcttcgctcgtcgtgcatgcccggacgcgggaccatggctaccggccgccggcccactgggactggatcgcgcgcattgcggcggcggtggacgtgccggtgattgccaacggagatgtctggaccgtcgccgactgggagcgttgccgggccgtcagcggttgcgccgacgtgatgatcgggcgcggcgccgtgtccgatcctttcctggccttgcgcattcgcgggctgatggacggttcgccgtcggaccaggagtggccgctggtgctgcgccagatcgccacctacctgaaaaagctgcatgcccgtatcgcgtcgtgccatgagcatgggcgcgtgaaactgtggctcagctatttcaagcggacctggccacaggccgccgaactgcatgcggccatccggcgcatgcaggactcgctggagatagagcgggtcctggaaggcctgccgggagccgcgaccgcgccggaatga

SEQ ID NO: 95192 - protein, 322 aa, Alcaligenes eutrophus
MSRLFLAPMEGLADYVLRDVLTDTGGYDGCVSEFVRVTGSLLPARVYERETPEILAGGYTRSGTPMVIQLLGSDPEWLARNAAYAATLSPHGIDLNFGCPAKVVNRHGGGAMLLTNPELLNRIVASVRAAVPAHIAVTAKMRLGVSDASLAIDCATALAEGGAASLVVHARTRDHGYRPPAHWDWIARIAAAVDVPVIANGDVWTVADWERCRAVSGCADVMIGRGAVSDPFLALRIRGLMDGSPSDQEWPLVLRQIATYLKKLHARIASCHEHGRVKLWLSYFKRTWPQAAELHAAIRRMQDSLEIERVLEGLPGAATAPE

SEQ ID NO: 95193 - DNA, 948 bp, Escherichia coli
  CDS (1)..(948): transl_table=11
atgcgtgtgttactggcaccgatggagggagtgcttgactctctggtgcgtgaattgctgaccgaagttaacgactacgatctgtgcatcaccgagtttgtccgcgtggtggatcaactgctgccggtaaaagtctttcatcgcatttgccctgagctacaaaacgccagccggacaccatctggtacgctggtgcgcgtgcagttgttaggtcagttcccacaatggctggcagagaacgccgcccgtgcggtggagttaggttcctggggcgtggatctcaattgcggctgcccgtcgaaaacggttaacggtagcggcggcggggcgacgttactcaaagatcctgaactcatctaccagggtgcaaaagcgatgcgtgaagctgtaccggcgcatttgcccgtcagcgtgaaagtgcgtctgggctgggacagcggtgagaagaaatttgaaatcgccgatgcggttcaacaggctggcgctacggagctggtggtgcatgggcggacgaaagagcagggttaccgcgcggagcatattgactggcaggcgattggcgatattcgccagcggctgaatattccggtgattgccaacggtgaaatctgggactggcagagcgcgcaacaatgcatggcgatcagcggctgcgacgcagtgatgattggtcgcggggcgctcaatattcccaacctgagccgggtggtaaaatataacgaaccgcgaatgccgtggccggaggtggttgctttgctgcaaaaatatacccgtctggaaaagcagggcgataccgggttatatcacgttgcgcggattaaacagtggttgagttatttgcgtaaagaatacgatgaagcaacggaattatttcagcatgttcgggtgttgaataattcccctgatattgcaagggctattcaggcaattgatatcgagaaactctaa

SEQ ID NO: 95194 - protein, 315 aa, Escherichia coli
MRVLLAPMEGVLDSLVRELLTEVNDYDLCITEFVRVVDQLLPVKVFHRICPELQNASRTPSGTLVRVQLLGQFPQWLAENAARAVELGSWGVDLNCGCPSKTVNGSGGGATLLKDPELIYQGAKAMREAVPAHLPVSVKVRLGWDSGEKKFEIADAVQQAGATELVVHGRTKEQGYRAEHIDWQAIGDIRQRLNIPVIANGEIWDWQSAQQCMAISGCDAVMIGRGALNIPNLSRVVKYNEPRMPWPEVVALLQKYTRLEKQGDTGLYHVARIKQWLSYLRKEYDEATELFQHVRVLNNSPDIARAIQAIDIEKL

SEQ ID NO: 95195 - DNA, 939 bp, Salmonella typhimurium
  CDS (1)..(939): transl_table=11
atgcgtgttttactggcgccgatggaaggcgtgctcgacgcgttagtgcgcgagctgctgaccgaagtgaatgattacgatctctgcatcaccgaatttgtgcgcgtggtggatcagctgctgccggtaaaagtgtttcatcgcatctgcccggagttgcatcacgccagccgcacgccgtccggcacgccggtgcgtattcagcttctgggccagcatccgcagtggctggcggaaaacgccgcgcgggcgacggcgttgggatcgtatggcgtggacctgaactgcggctgtccgtcaaaagtggtgaacggcagcggcggcggcgcgacattgctcaaagatcccgaactcatctatcagggcgcgaaagcgatgcgggccgcggtaccgtcgcatcttccggtgacggtaaaagtgcgtctcggctgggatagcggcgatagaaaatttgaaatcgccgatgcggtgcagcaggctggcgccagtgaactggtggtgcatggtcgtaccaaagcgcagggctaccgcgccgagcatatcgactggcaggcgatcggcgaaatacgccagcgtctgactattccggttatcgcgaatggcgaaatcttggactggcagagcgcgcaggcatgtatggcgaccagcggctgcgatgcggtgatgattggccgtggggcgttaaatattcctaacctgagccgggtggtgaagtataacgagccgcgtatgccgtggccggaagtggtgacgttattacaaaaatatacccgactggaaaagcagggcgataccggtttatatcatgtcgcgcgtattaaacagtggctgggatatttacgtaaggaatatattgaggcgacggaactctttcagtcgattcgggcgttaaaccgttcgtccgagattgcgcgggcgattcaggctattaaaatctaa

SEQ ID NO: 95196 - protein, 312 aa, Salmonella typhimurium
MRVLLAPMEGVLDALVRELLTEVNDYDLCITEFVRVVDQLLPVKVFHRICPELHHASRTPSGTPVRIQLLGQHPQWLAENAARATALGSYGVDLNCGCPSKVVNGSGGGATLLKDPELIYQGAKAMRAAVPSHLPVTVKVRLGWDSGDRKFEIADAVQQAGASELVVHGRTKAQGYRAEHIDWQAIGEIRQRLTIPVIANGEILDWQSAQACMATSGCDAVMIGRGALNIPNLSRVVKYNEPRMPWPEVVTLLQKYTRLEKQGDTGLYHVARIKQWLGYLRKEYIEATELFQSIRALNRSSEIARAIQAIKI

SEQ ID NO: 95197 - DNA, 969 bp, Vibrio parahaemolyticus
  CDS (1)..(969): transl_table=11
atgcgagttgtattaggcccaatggaaggcgttttagaccatttgatgcgccaaatcctgaccgaaataaacgactatgatctgtgtgtgacggagttcgttcgagtgatcgatcaagtcctgccagaccatgtctttcatcgcttatgtccggagcttatgcaaggctctcagaccacttctggtgtgcctgtacatgttcaactactaggccaagagcctcactggatggcggaaaacgcaatccgagcagcagagcttggcgcgcgcggcatcgacctaaattttggttgcccagcaaaaatggttaacaaaagcaaaggaggagcggcgctattgcagcatcctgagttgattcatagcgtggtaaaagcatgccgtgacgcagtgcctgcgaatatccctgtctccgcaaaaattcgtctgggctgggaaaaccctgaagactgttttgaaatcgtggatgcgattcaatctgcgggagcgaatgaactgaccgttcacgcacgtactaagcaaggcggttataaagcatctgaaatcaagtgggaatacatcaataaaattcgcgagcgattctccatccctttgattgccaatggtgaaatctggaatttcgaagatggtcaacgctgcattgaaaccactggtgtcgactctctgatggtgtgccgtggcgcgttcaacattcctaacctgggtaacatggtaaaacacaaccacacgccaatggtttggtctgatgtggttgacctgctgatctactactcaaagtttgaaatgaaaggcgataaaggtttgtactatccaaaccgcgtgaagcaatggttcgcttacctgcgccaatcttacccagaagctaacgaattattccgcgaaatccgaacatttaataaagcagcaccgattgttgagcacatccagcgctaccgcgatgaactccaatcgcgtcaaagccaagtggcttaa

SEQ ID NO: 95198 - protein, 322 aa, Vibrio parahaemolyticus
MRVVLGPMEGVLDHLMRQILTEINDYDLCVTEFVRVIDQVLPDHVFHRLCPELMQGSQTTSGVPVHVQLLGQEPHWMAENAIRAAELGARGIDLNFGCPAKMVNKSKGGAALLQHPELIHSVVKACRDAVPANIPVSAKIRLGWENPEDCFEIVDAIQSAGANELTVHARTKQGGYKASEIKWEYINKIRERFSIPLIANGEIWNFEDGQRCIETTGVDSLMVCRGAFNIPNLGNMVKHNHTPMVWSDVVDLLIYYSKFEMKGDKGLYYPNRVKQWFAYLRQSYPEANELFREIRTFNKAAPIVEHIQRYRDELQSRQSQVA

SEQ ID NO: 95199 - DNA, 951 bp, Aquifex aeolicus
  CDS (1)..(951): transl_table=11
atgaacttcaaaaagggagaggtaattctcgcacctatggcctcttacacccactccgcattcaggagactttgcaggagactgggagcggatagaacttacacggaacttataagtgcggtcggtgtcctcagaaacggaattcccatgaagctcgcttactttacagaagaagaaagaccaatacatattcaggttttcggaagcaatccggaagaaatagcacaagcaagcgttgtaatagcgaaagaattaaagcccgactttatagacataaacttcggatgttctgttcccaaggttctgagaaacaaagctgccggttacatgctccagtgtccacctctcatgggagaagtggtaaaggagactgtagaggcgttgaagccctacggtattcccgtttctgcaaaaatcagacttggttttgaaaaggacgaggtggagaggatagtagaggaactccagaaagcgggagtctctttaatagctattcacgcgagaaccgcaaagcagggatttagcgggaaagccctctggcacaggataaaggaagccaaaaaggttgcaagcgtacccataatagggagtggagacgtaaagagctggagggatatcgagagaatgtttgaagaaacggagtgcgacggtgttatggtggggcgtgcagccctttcaaacccgtggatatttaaagagttcaaagaaaaaagggacatagaggtaggtctaaaagagagaatggactttatccttgaagagctttctatgatgacggagtatatgagcagggaaaaagcgtgtgcggaaataaaatctcaaatagttcaaatactcaaaggtgttcccaattcaagggaattgaagacctacatagtgcatgcggaaaactgcaaggaacttgtaaaaaggatagaggaggcgaaggagagggaattactttatgcctaa

SEQ ID NO: 95200 - protein, 316 aa, Aquifex aeolicus
MNFKKGEVILAPMASYTHSAFRRLCRRLGADRTYTELISAVGVLRNGIPMKLAYFTEEERPIHIQVFGSNPEEIAQASVVIAKELKPDFIDINFGCSVPKVLRNKAAGYMLQCPPLMGEVVKETVEALKPYGIPVSAKIRLGFEKDEVERIVEELQKAGVSLIAIHARTAKQGFSGKALWHRIKEAKKVASVPIIGSGDVKSWRDIERMFEETECDGVMVGRAALSNPWIFKEFKEKRDIEVGLKERMDFILEELSMMTEYMSREKACAEIKSQIVQILKGVPNSRELKTYIVHAENCKELVKRIEEAKERELLYA

SEQ ID NO: 95201 - DNA, 987 bp, Azospirillum brasilense
  CDS (1)..(987): transl_table=11
atggccattcaaatcggcaccatctcgcttgagggtccggtgatcctcgcccctatgtccggcgttaccgacctgccgttccggaggctggtaaagcagtcgggctgcggactggtcgtctccgagatggtcgcgagccaggcgatgatccgcgagaaccgccagacgctgcgcatggtcgagtgcgaaccggagcagttccccatggccgtccaactcgccggctgcgagcccgacgtgatggccgaagcggcaaagctgaacgaggaccgcggggcggccatcatcgacatcaacttcggctgtcccgtgaagaaggtggtcaacgggcacgccggctcctccctgatgcgcgacgaggcgctcgccgcccgcatcctggaagccacggcgaaggcggtcacgatcccggtgacgctgaagatgcgcaagggttgggacgacagcagcctgaacgcgccccgtctagcccgcatcgccgaggagtgcgggatcaagctggtcaccgtccacggccgcacccgcgagcagttctacaacggcaccgccgactggtccttcatccgctccgtgaaggaggcggtgtcgatcccggtggtggtcaacggcgacatcacatccttcgacgccgtggatcgtgcgctcgccgagtccggcgccgacggggtgatgatcgggcgcggcgcctacgggcgcccctggttccccgcccaggttatgcattacatccgcaccggcgagcggttgcccgacccgccgctccacgagcagctcgacacgctgctggagcattacgacgccatgctgacccattacggcgtcgaaggcgggcttcgcgtcgcccgcaagcacatctcctggtactcaacgggcctgcgcgactccgccgaattccgctcggaggtcaaccgcatgtccgatcccgaacgagtgcgcggcttcatccgcgacttctacgccccggcgatcgaaaggatggctgcctga

SEQ ID NO: 95202 - protein, 328 aa, Azospirillum brasilense
MAIQIGTISLEGPVILAPMSGVTDLPFRRLVKQSGCGLVVSEMVASQAMIRENRQTLRMVECEPEQFPMAVQLAGCEPDVMAEAAKLNEDRGAAIIDINFGCPVKKVVNGHAGSSLMRDEALAARILEATAKAVTIPVTLKMRKGWDDSSLNAPRLARIAEECGIKLVTVHGRTREQFYNGTADWSFIRSVKEAVSIPVVVNGDITSFDAVDRALAESGADGVMIGRGAYGRPWFPAQVMHYIRTGERLPDPPLHEQLDTLLEHYDAMLTHYGVEGGLRVARKHISWYSTGLRDSAEFRSEVNRMSDPERVRGFIRDFYAPAIERMAA

SEQ ID NO: 95203 - DNA, 987 bp, Helicobacter pylori J99
  CDS (1)..(987): transl_table=11
atggactttaagaataaaaaatggctttttttagcccctctagcaggctatacggatttgcctttcaggagcgtggtgaaaaaatttggcgtggacgttaccacaagcgaaatggtgagctcgcattcgttggtgtatgcgtttgataaaacttctaaaatgttggaaaaatcccctttagaagatcatttcatggcgcaaatttcaggctctaaagaaagcgtagtcaaagaagcggtggagaaaatcaacgctttagatcatgtgagcgggattgattttaattgcggttgtcctgcccctaaagtggctaatcatggtaacgggagcgggctattgaaggacttaaaccacttggtggagattttaaaagtgattagagaaaacaccaataaaaaaatcacaagcgtgaaagtgcgtttaggttttgaaaagaaaatccctaaagaaatcgctcatgccttaaatgacgcgccggtggattatgtggtggtacatgggaggacacgaagcgataggtatcaaaaagacaaaatagattatgaaagcatcgctttaatgaaaaagattttaaaaaagcctgtgatagccaatggcgaaattgacagcgtgaaaaaagcttttgaagttttacaaatcactcaagcggatgggctaatgatagggcgagcgaccttaagagccccatggatattttggcaaatcagaaacaacaccaccgaattacccgcagtcgtgaaaaaagacctggttttagaacattttgataaaatggtggagttttatggggataggggggtgatcatgttcaggaaaaacttgcatgcttacgctaagggtgaaatgcaagcgagcgcgtttcgcaactgcgtcaatacccttacagaaataaagagcatgcgagagagcatagaggaattttttaatcaagagatgttacaaagtgaagtgccattatgggtagaattgaatcaaaaaagcgtttga

SEQ ID NO: 95204 - protein, 328 aa, Helicobacter pylori J99
MDFKNKKWLFLAPLAGYTDLPFRSVVKKFGVDVTTSEMVSSHSLVYAFDKTSKMLEKSPLEDHFMAQISGSKESVVKEAVEKINALDHVSGIDFNCGCPAPKVANHGNGSGLLKDLNHLVEILKVIRENTNKKITSVKVRLGFEKKIPKEIAHALNDAPVDYVVVHGRTRSDRYQKDKIDYESIALMKKILKKPVIANGEIDSVKKAFEVLQITQADGLMIGRATLRAPWIFWQIRNNTTELPAVVKKDLVLEHFDKMVEFYGDRGVIMFRKNLHAYAKGEMQASAFRNCVNTLTEIKSMRESIEEFFNQEMLQSEVPLWVELNQKSV

SEQ ID NO: 95205 - DNA, 954 bp, Rhizobium leguminosarum
  CDS (1)..(954): transl_table=11
gtgtccgtgcggaaccgcgttgtgctggcgccgatgtccggcgtcacggacatgcccttccgcgagctagcctggcgcttcggcgccggcctggtcgtcaccgaaatggtggcgagccgcgagctggtcaatgacaccgccgaatcctggtcgcggctgaaggccgccggcttccggccgcacatggtccagctcgccggccgcgaggcgcattggatggcagaagcggcgaagatcgccgccgatcatggcgccgatatcatcgacatcaacatgggctgtccggcaaagaaggtgatcggcggttattccggctcggcgctgatgcgcgatcccgatcacgcactcggcctgatcgaggcgacggtcaaggccgtcgacattccggtgacgctgaagatgcgcctcggctgggacgagaattcgatcaacgcgcccgatattgcacgccgcgccgaggcgtccggcattcagctcgtgaccatccatggccgcacccgcatgcagttttacgaaggccgcgccgactgggatgcgatccgcgccgtccgtgaggtgatctccgttccgctcatcgccaatggagatgtcgagaccgcgcacgatgcgcaggaaatcctgcgccgctccggcgccgatgccgtcatgatcggccggggctgccaaggcaggccgtggcatgccggcgtgcttgccggtgcggcggagccgcggcgcgaagacattgccgatatcgccgtcgaacactaccggatgatgctcgatttctacggcgaggcggtggcgatccgccatgcccgcaagcatctcggctggtatctcgagcgtttcgcccccgcgcttgccggcaccgagaaggctgggatcatgacctcgcgtgacccgcgtgaggtggccgcgcgcctttatcacgcgcttgatgcaggtgcgctcgacggccgggaggcggcatga

SEQ ID NO: 95206 - protein, 317 aa, Rhizobium leguminosarum
MSVRNRVVLAPMSGVTDMPFRELAWRFGAGLVVTEMVASRELVNDTAESWSRLKAAGFRPHMVQLAGREAHWMAEAAKIAADHGADIIDINMGCPAKKVIGGYSGSALMRDPDHALGLIEATVKAVDIPVTLKMRLGWDENSINAPDIARRAEASGIQLVTIHGRTRMQFYEGRADWDAIRAVREVISVPLIANGDVETAHDAQEILRRSGADAVMIGRGCQGRPWHAGVLAGAAEPRREDIADIAVEHYRMMLDFYGEAVAIRHARKHLGWYLERFAPALAGTEKAGIMTSRDPREVAARLYHALDAGALDGREAA

SEQ ID NO: 95207 - DNA, 975 bp, Rhodobacter capsulatus
  CDS (1)..(975): transl_table=11
gtgacgatcagcctcgatagccttcgcctcgaccctccggtgcttctggcgccgatggcgggcatcaccgatctgccgttccggcgcatggtggcgcggttcggcgcggggcttgtcgtgtcggaaatggtggccagcggcgagatgctgaccgccaagccctcggtccgggccaaggcgcaggcggaactgacggccggtctgccgacctcggtgcagctggcgggccgagaagcggcgccgatggccgaggcggcaaagatcgtcgccgacatgggcgccgagatcatcgacatcaacatgggctgtccggcgaaaaaggtgacgggcgggctttcgggcgcggcgctgatgcgcaatcccgatcatgccttgcggctgatcgaggcggtggtgggcgcggtcgatctgccggtgacgctgaagatgcggctgggctgggacgaagaccagctgaacgcggccgagatcgccgcccgggccgaagcggccggggtgaagatgatcgtcattcacggccgcacccggatgcagttctacaccggcgcggcggattggcgggcgattgcggccgtgcgtgcggcggtttcggtgccggtggtggcgaatggcgacatcaccgatgccgcctcggcgcggagggcgctggatcagagcggcgccgcgggcgtgatggtcgggcgcggcgcgcagggggcgccctggcggctggcgcagatcgccgccgcgctttttggcaaagcagatcccaaacttccctccggttccgaattttccgacttcgtgtcagagcactacgaggcgatcctcagtttttacggccgcgatctgggcttgcgcatcgcgcgcaagcatctgggctggtatgccgaggccgccgccgcgccgctgcgcgccgaaatgatgcgtgcgaccgatcccgctgccacgcttgcgctgatccgcagcgccttttccgaaagggaggccgcatga

SEQ ID NO: 95208 - protein, 324 aa, Rhodobacter capsulatus
MTISLDSLRLDPPVLLAPMAGITDLPFRRMVARFGAGLVVSEMVASGEMLTAKPSVRAKAQAELTAGLPTSVQLAGREAAPMAEAAKIVADMGAEIIDINMGCPAKKVTGGLSGAALMRNPDHALRLIEAVVGAVDLPVTLKMRLGWDEDQLNAAEIAARAEAAGVKMIVIHGRTRMQFYTGAADWRAIAAVRAAVSVPVVANGDITDAASARRALDQSGAAGVMVGRGAQGAPWRLAQIAAALFGKADPKLPSGSEFSDFVSEHYEAILSFYGRDLGLRIARKHLGWYAEAAAAPLRAEMMRATDPAATLALIRSAFSEREAA

SEQ ID NO: 95209 - DNA, 1023 bp, Treponema pallidum
  CDS (1)..(1023): transl_table=11
atgcaacaacacgccttatatcatccggtttctattggcccgttgtctctcaaggggaatgtgttttttgctcccgttgcaggctattctgacagtgcgtttcgttcaattgccattgaatgggaagcaagcttcacctacaccgaaatggtttcgtctgaggcgatggtgcgcgattcactcaataccaaacgtttgattcggcgcgcgtcaaatgagacgcattacgctatccagatttttggttctaatcctgcagtaatggcagagacggcaaaactaatcgtcgatagcgcgcagccgtcctgtatcgacatcaacgcgggatgtcctatgcctaaaatcactaaaacaggagccggagccgcactcacccgagaaccgacgcgcctctatgaagtggtaaaggcggtcgccgatgctgtgtacgcgcaagacgcgcgtatcccagtgacagtaaaaattcgtgctgggtgggaagaggcacacctgacatggaaggaagctgcgcgtgcggcagtagacgcaggagcacaagcgcttgcgttgcacccgcgcacctgcgcgcagtgttacgcgggagaggcaaactgggacataatcgcagacctcgtgcagtgcgcgcgtgggtggggagaggttcccgtgttcggctcaggggatctgcatgcgcctgaagacgcacgggcaatgttagaacacaccgcatgcgcgggggttatgtttgcccgcggtgctatgggcaacccgtttattttcagacaaacccgtcagcttttaactgaaggatactacacgcccgtgacgtttgagcaaaagctacgcgcagcctggcgcgagcttcaccttctggcacaagacgtgggagaaagctcagcctgcaagcagatgcgcaagcgttttgtttcgtatgcaaagggtgagcggggtaaaacgcaatggtgtcagcgcgcggtgcatgcgtcttccttcgcagactttgcagcagtcattcgtgacgcgtgtccatgtattggtttataa

SEQ ID NO: 95210 - protein, 340 aa, Treponema pallidum
MQQHALYHPVSIGPLSLKGNVFFAPVAGYSDSAFRSIAIEWEASFTYTEMVSSEAMVRDSLNTKRLIRRASNETHYAIQIFGSNPAVMAETAKLIVDSAQPSCIDINAGCPMPKITKTGAGAALTREPTRLYEVVKAVADAVYAQDARIPVTVKIRAGWEEAHLTWKEAARAAVDAGAQALALHPRTCAQCYAGEANWDIIADLVQCARGWGEVPVFGSGDLHAPEDARAMLEHTACAGVMFARGAMGNPFIFRQTRQLLTEGYYTPVTFEQKLRAAWRELHLLAQDVGESSACKQMRKRFVSYAKGERGKTQWCQRAVHASSFADFAAVIRDACPCIGL

SEQ ID NO: 95211 - DNA, 22 bp, Primer
atgcgcatcggacaatatcagc

SEQ ID NO: 95212 - DNA, 25 bp, Primer
ttacgcaaaattttcgaagtatgcc

SEQ ID NO: 95213 - protein, 279 aa, consensus
  MISC_FEATURE (1)..(279): consensus for the disclosure of xaa see table XV
APMXGXXXXXXRXXXXXXXXXXXXXXXXXXXXEMXXXXXXXXXXXXXXXXXXXXXXXXXXXXXXXXXXXXXXXXXXXQXXGXXXXXXXXXAXXXXXXXXXXXXXDXNXGCPXXXXXXXXXXGXXLXXXXXXXXXXXXXXXXXXXXXXXXXPVTXKXRXGXXXXXXXXXXXXXXXXXXXXXGXXXXXXHGRTXXXXXXXXXXXXXXXXAXXXXIXXXXXXXXXXXXXXXXXXXXXXXXXXPXXXNGXXXXDXXXXXXXXXXXXXXXXDXXMXGRXXXXXP

SEQ ID NO: 95214 - protein, 83 aa, consensus
  MISC_FEATURE (1)..(83): consensus for the disclosure of xaa see table XV
XQXXXXXXXXXXXXXXXXXXXXXXXXXXXXNXGCXXXXXXXXXXXXXXXXXXXXXXXXXXXXXXXXXXXXXXXXXXXXKXRXX

SEQ ID NO: 95215 - protein, 101 aa, consensus
  MISC_FEATURE (1)..(101): consensus for the disclosure of xaa see table XV
XXXXXXXHXRXXXXXXXXXXXXXXXXXXXXXXXXXXXXXXXXXXXXXXXXXXXXXXXXXPXXXXGXXXXXXXXXXXXXXXXXXXXXXXXXXXXXXXXXPXX

SEQ ID NO: 95216 - DNA, 1275 bp, Escherichia coli; identical to SEQ ID NO: 56045
  CDS (1)..(1275)

SEQ ID NO: 95217 - protein, 424 aa, Escherichia coli; identical to SEQ ID NO: 56046

SEQ ID NO: 95218 - DNA, 1284 bp, Thermotoga maritima MSB8; identical to SEQ ID NO: 56047
  CDS (1)..(1284): transl_table=11

SEQ ID NO: 95219 - protein, 427 aa, Thermotoga maritima MSB8; identical to SEQ ID NO: 56048

SEQ ID NO: 95220 - DNA, 1284 bp, Vibrio cholerae O1 biovar eltor str. N16961; identical to SEQ ID NO: 56049
  CDS (1)..(1284): transl_table=11

SEQ ID NO: 95221 - protein, 427 aa, Vibrio cholerae O1 biovar eltor str. N16961; identical to SEQ ID NO: 56050

SEQ ID NO: 95222 - DNA, 1362 bp, Vibrio cholerae O1 biovar eltor str. N16961; identical to SEQ ID NO: 56051
  CDS (1)..(1362): transl_table=11

SEQ ID NO: 95223 - protein, 453 aa, Vibrio cholerae O1 biovar eltor str. N16961; identical to SEQ ID NO: 56052

SEQ ID NO: 95224 - DNA, 1305 bp, Bacillus halodurans C-125; identical to SEQ ID NO: 56053
  CDS (1)..(1305): transl_table=11

SEQ ID NO: 95225 - protein, 434 aa, Bacillus halodurans C-125; identical to SEQ ID NO: 56054

SEQ ID NO: 95226 - DNA, 1281 bp, Bacillus halodurans C-125; identical to SEQ ID NO: 56055
  CDS (1)..(1281): transl_table=11

SEQ ID NO: 95227 - protein, 426 aa, Bacillus halodurans C-125; identical to SEQ ID NO: 56056

SEQ ID NO: 95228 - DNA, 1269 bp, Bacillus halodurans C-125; identical to SEQ ID NO: 56057
  CDS (1)..(1269): transl_table=11

SEQ ID NO: 95229 - protein, 422 aa, Bacillus halodurans C-125; identical to SEQ ID NO: 56058

SEQ ID NO: 95230 - DNA, 1284 bp, Pasteurella multocida subsp. multocida str. Pm70; identical to SEQ ID NO: 56059
  CDS (1)..(1284): transl_table=11

SEQ ID NO: 95231 - protein, 427 aa, Pasteurella multocida subsp. multocida str. Pm70; identical to SEQ ID NO: 56060

SEQ ID NO: 95232 - DNA, 1281 bp, Pasteurella multocida subsp. multocida str. Pm70; identical to SEQ ID NO: 56061
  CDS (1)..(1281): transl_table=11

SEQ ID NO: 95233 - protein, 426 aa, Pasteurella multocida subsp. multocida str. Pm70; identical to SEQ ID NO: 56062

SEQ ID NO: 95234 - DNA, 1293 bp, Pasteurella multocida subsp. multocida str. Pm70; identical to SEQ ID NO: 56063
  CDS (1)..(1293): transl_table=11

SEQ ID NO: 95235 - protein, 430 aa, Pasteurella multocida subsp. multocida str. Pm70; identical to SEQ ID NO: 56064

SEQ ID NO: 95236 - DNA, 1281 bp, Pasteurella multocida subsp. multocida str. Pm70; identical to SEQ ID NO: 56065
  CDS (1)..(1281): transl_table=11

SEQ ID NO: 95237 - protein, 426 aa, Pasteurella multocida subsp. multocida str. Pm70; identical to SEQ ID NO: 56066

SEQ ID NO: 95238 - DNA, 1905 bp, Pasteurella multocida subsp. multocida str. Pm70; identical to SEQ ID NO: 56067
  CDS (1)..(1905): transl_table=11

SEQ ID NO: 95239 - protein, 634 aa, Pasteurella multocida subsp. multocida str. Pm70; identical to SEQ ID NO: 56068

SEQ ID NO: 95240 - DNA, 1284 bp, Pseudomonas aeruginosa PAO1; identical to SEQ ID NO: 56069
  CDS (1)..(1284): transl_table=11

SEQ ID NO: 95241 - protein, 427 aa, Pseudomonas aeruginosa PAO1; identical to SEQ ID NO: 56070

SEQ ID NO: 95242 - DNA, 1281 bp, Pseudomonas aeruginosa PAO1; identical to SEQ ID NO: 56071
  CDS (1)..(1281): transl_table=11

SEQ ID NO: 95243 - protein, 426 aa, Pseudomonas aeruginosa PAO1; identical to SEQ ID NO: 56072

SEQ ID NO: 95244 - DNA, 1464 bp, Agrobacterium tumefaciens str. C58; identical to SEQ ID NO: 56073
  CDS (1)..(1464): transl_table=11

SEQ ID NO: 95245 - protein, 487 aa, Agrobacterium tumefaciens str. C58; identical to SEQ ID NO: 56074

SEQ ID NO: 95246 - DNA, 1869 bp, Sinorhizobium meliloti 1021; identical to SEQ ID NO: 56075
  CDS (1)..(1869): transl_table=11

SEQ ID NO: 95247 - protein, 622 aa, Sinorhizobium meliloti 1021; identical to SEQ ID NO: 56076

SEQ ID NO: 95248 - DNA, 1260 bp, Sinorhizobium meliloti 1021; identical to SEQ ID NO: 56077
  CDS (1)..(1260): transl_table=11

SEQ ID NO: 95249 - protein, 419 aa, Sinorhizobium meliloti 1021; identical to SEQ ID NO: 56078

SEQ ID NO: 95250 - DNA, 1281 bp, Caulobacter crescentus CB15; identical to SEQ ID NO: 56079
  CDS (1)..(1281): transl_table=11

SEQ ID NO: 95251 - protein, 426 aa, Caulobacter crescentus CB15; identical to SEQ ID NO: 56080

SEQ ID NO: 95252 - DNA, 2601 bp, Sinorhizobium meliloti 1021; identical to SEQ ID NO: 56081
  CDS (1)..(2601): transl_table=11

SEQ ID NO: 95253 - protein, 866 aa, Sinorhizobium meliloti 1021; identical to SEQ ID NO: 56082

SEQ ID NO: 95254 - DNA, 1278 bp, Sinorhizobium meliloti 1021; identical to SEQ ID NO: 56083
  CDS (1)..(1278): transl_table=11

SEQ ID NO: 95255 - protein, 425 aa, Sinorhizobium meliloti 1021; identical to SEQ ID NO: 56084

SEQ ID NO: 95256 - DNA, 1281 bp, Sinorhizobium meliloti 1021; identical to SEQ ID NO: 56085
  CDS (1)..(1281): transl_table=11

SEQ ID NO: 95257 - protein, 426 aa, Sinorhizobium meliloti 1021; identical to SEQ ID NO: 56086

SEQ ID NO: 95258 - DNA, 1281 bp, Sinorhizobium meliloti 1021; identical to SEQ ID NO: 56087
  CDS (1)..(1281): transl_table=11

SEQ ID NO: 95259 - protein, 426 aa, Sinorhizobium meliloti 1021; identical to SEQ ID NO: 56088

SEQ ID NO: 95260 - DNA, 1266 bp, Sinorhizobium meliloti 1021; identical to SEQ ID NO: 56089
  CDS (1)..(1266): transl_table=11

SEQ ID NO: 95261 - protein, 421 aa, Sinorhizobium meliloti 1021; identical to SEQ ID NO: 56090

SEQ ID NO: 95262 - DNA, 1278 bp, Sinorhizobium meliloti 1021; identical to SEQ ID NO: 56091
  CDS (1)..(1278): transl_table=11

SEQ ID NO: 95263 - protein, 425 aa, Sinorhizobium meliloti 1021; identical to SEQ ID NO: 56092

SEQ ID NO: 95264 - DNA, 1407 bp, Sinorhizobium meliloti 1021; identical to SEQ ID NO: 56093
  CDS (1)..(1407): transl_table=11

SEQ ID NO: 95265 - protein, 468 aa, Sinorhizobium meliloti 1021; identical to SEQ ID NO: 56094

SEQ ID NO: 95266 - DNA, 1284 bp, Sinorhizobium meliloti 1021; identical to SEQ ID NO: 56095
  CDS (1)..(1284): transl_table=11

SEQ ID NO: 95267 - protein, 427 aa, Sinorhizobium meliloti 1021; identical to SEQ ID NO: 56096

SEQ ID NO: 95268 - DNA, 1314 bp, Sinorhizobium meliloti 1021; identical to SEQ ID NO: 56097
  CDS (1)..(1314): transl_table=11

SEQ ID NO: 95269 - protein, 437 aa, Sinorhizobium meliloti 1021; identical to SEQ ID NO: 56098

SEQ ID NO: 95270 - DNA, 1281 bp, Sinorhizobium meliloti 1021; identical to SEQ ID NO: 56099
  CDS (1)..(1281): transl_table=11

SEQ ID NO: 95271 - protein, 426 aa, Sinorhizobium meliloti 1021; identical to SEQ ID NO: 56100

SEQ ID NO: 95272 - DNA, 1257 bp, Haemophilus influenzae Rd KW20; identical to SEQ ID NO: 56101
  CDS (1)..(1257): transl_table=11

SEQ ID NO: 95273 - protein, 418 aa, Haemophilus influenzae Rd KW20; identical to SEQ ID NO: 56102

SEQ ID NO: 95274 - DNA, 1338 bp, Synechocystis sp. PCC 6803; identical to SEQ ID NO: 56103
  CDS (1)..(1338): transl_table=11

SEQ ID NO: 95275 - protein, 445 aa, Synechocystis sp. PCC 6803; identical to SEQ ID NO: 56104

SEQ ID NO: 95276 - DNA, 1278 bp, Salmonella typhimurium LT2; identical to SEQ ID NO: 56105
  CDS (1)..(1278): transl_table=11

SEQ ID NO: 95277 - protein, 425 aa, Salmonella typhimurium LT2; identical to SEQ ID NO: 56106

SEQ ID NO: 95278 - DNA, 1308 bp, Salmonella typhimurium LT2; identical to SEQ ID NO: 56107
  CDS (1)..(1308): transl_table=11

SEQ ID NO: 95279 - protein, 435 aa, Salmonella typhimurium LT2; identical to SEQ ID NO: 56108

SEQ ID NO: 95280 - DNA, 1278 bp, Agrobacterium tumefaciens str. C58; identical to SEQ ID NO: 56109
  CDS (1)..(1278): transl_table=11

SEQ ID NO: 95281 - protein, 425 aa, Agrobacterium tumefaciens str. C58; identical to SEQ ID NO: 56110

SEQ ID NO: 95282 - DNA, 1281 bp, Agrobacterium tumefaciens str. C58; identical to SEQ ID NO: 56111
  CDS (1)..(1281): transl_table=11

SEQ ID NO: 95283 - protein, 426 aa, Agrobacterium tumefaciens str. C58; identical to SEQ ID NO: 56112

SEQ ID NO: 95284 - DNA, 1281 bp, Agrobacterium tumefaciens str. C58; identical to SEQ ID NO: 56113
  CDS (1)..(1281): transl_table=11

SEQ ID NO: 95285 - protein, 426 aa, Agrobacterium tumefaciens str. C58; identical to SEQ ID NO: 56114

SEQ ID NO: 95286 - DNA, 1851 bp, Agrobacterium tumefaciens str. C58; identical to SEQ ID NO: 56115
  CDS (1)..(1851): transl_table=11

SEQ ID NO: 95287 - protein, 616 aa, Agrobacterium tumefaciens str. C58; identical to SEQ ID NO: 56116

SEQ ID NO: 95288 - DNA, 1290 bp, Agrobacterium tumefaciens str. C58; identical to SEQ ID NO: 56117
  CDS (1)..(1290): transl_table=11

SEQ ID NO: 95289 - protein, 429 aa, Agrobacterium tumefaciens str. C58; identical to SEQ ID NO: 56118

SEQ ID NO: 95290 - DNA, 1314 bp, Corynebacterium glutamicum ATCC 13032; identical to SEQ ID NO: 56119
  CDS (1)..(1314): transl_table=11

SEQ ID NO: 95291 - protein, 437 aa, Corynebacterium glutamicum ATCC 13032; identical to SEQ ID NO: 56120

SEQ ID NO: 95292 - DNA, 1854 bp, Fusobacterium nucleatum subsp. nucleatum ATCC 25586; identical to SEQ ID NO: 56121
  CDS (1)..(1854): transl_table=11

SEQ ID NO: 95293 - protein, 617 aa, Fusobacterium nucleatum subsp. nucleatum ATCC 25586; identical to SEQ ID NO: 56122

SEQ ID NO: 95294 - DNA, 1284 bp, Xanthomonas campestris pv. campestris str. ATCC 33913; identical to SEQ ID NO: 56123
  CDS (1)..(1284): transl_table=11

SEQ ID NO: 95295 - protein, 427 aa, Xanthomonas campestris pv. campestris str. ATCC 33913; identical to SEQ ID NO: 56124

SEQ ID NO: 95296 - DNA, 1293 bp, Yersinia pestis KIM; identical to SEQ ID NO: 56125
  CDS (1)..(1293): transl_table=11

SEQ ID NO: 95297 - protein, 430 aa, Yersinia pestis KIM; identical to SEQ ID NO: 56126

SEQ ID NO: 95298 - DNA, 1263 bp, Oceanobacillus iheyensis HTE831; identical to SEQ ID NO: 56127
  CDS (1)..(1263): transl_table=11

SEQ ID NO: 95299 - protein, 420 aa, Oceanobacillus iheyensis HTE831; identical to SEQ ID NO: 56128

SEQ ID NO: 95300 - DNA, 1287 bp, Oceanobacillus iheyensis HTE831; identical to SEQ ID NO: 56129
  CDS (1)..(1287): transl_table=11

SEQ ID NO: 95301 - protein, 428 aa, Oceanobacillus iheyensis HTE831; identical to SEQ ID NO: 56130

SEQ ID NO: 95302 - DNA, 1308 bp, Oceanobacillus iheyensis HTE831; identical to SEQ ID NO: 56131
  CDS (1)..(1308): transl_table=11

SEQ ID NO: 95303 - protein, 435 aa, Oceanobacillus iheyensis HTE831; identical to SEQ ID NO: 56132

SEQ ID NO: 95304 - DNA, 1305 bp, Oceanobacillus iheyensis HTE831; identical to SEQ ID NO: 56133
  CDS (1)..(1305): transl_table=11

SEQ ID NO: 95305 - protein, 434 aa, Oceanobacillus iheyensis HTE831; identical to SEQ ID NO: 56134

SEQ ID NO: 95306 - DNA, 1275 bp, Oceanobacillus iheyensis HTE831; identical to SEQ ID NO: 56135
  CDS (1)..(1275): transl_table=11

SEQ ID NO: 95307 - protein, 424 aa, Oceanobacillus iheyensis HTE831; identical to SEQ ID NO: 56136

SEQ ID NO: 95308 - DNA, 1308 bp, Oceanobacillus iheyensis HTE831; identical to SEQ ID NO: 56137
  CDS (1)..(1308): transl_table=11

SEQ ID NO: 95309 - protein, 435 aa, Oceanobacillus iheyensis HTE831; identical to SEQ ID NO: 56138

SEQ ID NO: 95310 - DNA, 1302 bp, Shigella flexneri 2a str. 301; identical to SEQ ID NO: 56139
  CDS (1)..(1302): transl_table=11

SEQ ID NO: 95311 - protein, 433 aa, Shigella flexneri 2a str. 301; identical to SEQ ID NO: 56140

SEQ ID NO: 95312 - DNA, 1293 bp, Shigella flexneri 2a str. 301; identical to SEQ ID NO: 56141
  CDS (1)..(1293): transl_table=11

SEQ ID NO: 95313 - protein, 430 aa, Shigella flexneri 2a str. 301; identical to SEQ ID NO: 56142

SEQ ID NO: 95314 - DNA, 1398 bp, Shewanella oneidensis MR-1; identical to SEQ ID NO: 56143
  CDS (1)..(1398): transl_table=11

SEQ ID NO: 95315 - protein, 465 aa, Shewanella oneidensis MR-1; identical to SEQ ID NO: 56144

SEQ ID NO: 95316 - DNA, 1317 bp, Corynebacterium efficiens YS-314; identical to SEQ ID NO: 56145
  CDS (1)..(1317): transl_table=11

SEQ ID NO: 95317 - protein, 438 aa, Corynebacterium efficiens YS-314; identical to SEQ ID NO: 56146

SEQ ID NO: 95318 - DNA, 1281 bp, Pseudomonas putida KT2440; identical to SEQ ID NO: 56147
  CDS (1)..(1281): transl_table=11

SEQ ID NO: 95319 - protein, 426 aa, Pseudomonas putida KT2440; identical to SEQ ID NO: 56148

SEQ ID NO: 95320 - DNA, 1347 bp, Escherichia coli CFT073; identical to SEQ ID NO: 56149
  CDS (1)..(1347): transl_table=11

SEQ ID NO: 95321 - protein, 448 aa, Escherichia coli CFT073; identical to SEQ ID NO: 56150

SEQ ID NO: 95322 - DNA, 1278 bp, Escherichia coli CFT073; identical to SEQ ID NO: 56151
  CDS (1)..(1278): transl_table=11

SEQ ID NO: 95323 - protein, 425 aa, Escherichia coli CFT073; identical to SEQ ID NO: 56152

SEQ ID NO: 95324 - DNA, 1893 bp, Bradyrhizobium japonicum USDA 110; identical to SEQ ID NO: 56153
  CDS (1)..(1893)

SEQ ID NO: 95325 - protein, 630 aa, Bradyrhizobium japonicum USDA 110; identical to SEQ ID NO: 56154

SEQ ID NO: 95326 - DNA, 2040 bp, Bradyrhizobium japonicum USDA 110; identical to SEQ ID NO: 56155
  CDS (1)..(2040)

SEQ ID NO: 95327 - protein, 679 aa, Bradyrhizobium japonicum USDA 110; identical to SEQ ID NO: 56156

SEQ ID NO: 95328 - DNA, 1266 bp, Bradyrhizobium japonicum USDA 110; identical to SEQ ID NO: 56157
  CDS (1)..(1266)

SEQ ID NO: 95329 - protein, 421 aa, Bradyrhizobium japonicum USDA 110; identical to SEQ ID NO: 56158

SEQ ID NO: 95330 - DNA, 1293 bp, Bradyrhizobium japonicum USDA 110; identical to SEQ ID NO: 56159
  CDS (1)..(1293)

SEQ ID NO: 95331 - protein, 430 aa, Bradyrhizobium japonicum USDA 110; identical to SEQ ID NO: 56160

SEQ ID NO: 95332 - DNA, 1860 bp, Bradyrhizobium japonicum USDA 110; identical to SEQ ID NO: 56161
  CDS (1)..(1860)

SEQ ID NO: 95333 - protein, 619 aa, Bradyrhizobium japonicum USDA 110; identical to SEQ ID NO: 56162

SEQ ID NO: 95334 - DNA, 1290 bp, Bradyrhizobium japonicum USDA 110; identical to SEQ ID NO: 56163
  CDS (1)..(1290)

SEQ ID NO: 95335 - protein, 429 aa, Bradyrhizobium japonicum USDA 110; identical to SEQ ID NO: 56164

SEQ ID NO: 95336 - DNA, 1407 bp, Bradyrhizobium japonicum USDA 110; identical to SEQ ID NO: 56165
  CDS (1)..(1407)

SEQ ID NO: 95337 - protein, 468 aa, Bradyrhizobium japonicum USDA 110; identical to SEQ ID NO: 56166

SEQ ID NO: 95338 - DNA, 1305 bp, Bradyrhizobium japonicum USDA 110; identical to SEQ ID NO: 56167
  CDS (1)..(1305)

SEQ ID NO: 95339 - protein, 434 aa, Bradyrhizobium japonicum USDA 110; identical to SEQ ID NO: 56168

SEQ ID NO: 95340 - DNA, 1320 bp, Bradyrhizobium japonicum USDA 110; identical to SEQ ID NO: 56169
  CDS (1)..(1320)

SEQ ID NO: 95341 - protein, 439 aa, Bradyrhizobium japonicum USDA 110; identical to SEQ ID NO: 56170

SEQ ID NO: 95342 - DNA, 1281 bp, Pseudomonas syringae pv. tomato str. DC3000; identical to SEQ ID NO: 56171
  CDS (1)..(1281): transl_table=11

SEQ ID NO: 95343 - protein, 426 aa, Pseudomonas syringae pv. tomato str. DC3000; identical to SEQ ID NO: 56172

SEQ ID NO: 95344 - DNA, 1362 bp, Vibrio parahaemolyticus RIMD 2210633; identical to SEQ ID NO: 56173
  CDS (1)..(1362): transl_table=11

SEQ ID NO: 95345 - protein, 453 aa, Vibrio parahaemolyticus RIMD 2210633; identical to SEQ ID NO: 56174

SEQ ID NO: 95346 - DNA, 1296 bp, Enterococcus faecalis V583; identical to SEQ ID NO: 56175
  CDS (1)..(1296): transl_table=11

SEQ ID NO: 95347 - protein, 431 aa, Enterococcus faecalis V583; identical to SEQ ID NO: 56176

SEQ ID NO: 95348 - DNA, 1275 bp, Helicobacter hepaticus ATCC 51449; identical to SEQ ID NO: 56177
  CDS (1)..(1275): transl_table=11

SEQ ID NO: 95349 - protein, 424 aa, Helicobacter hepaticus ATCC 51449; identical to SEQ ID NO: 56178

SEQ ID NO: 95350 - DNA, 1194 bp, Bordetella pertussis Tohama I; identical to SEQ ID NO: 56179
  CDS (1)..(1194): transl_table=11

SEQ ID NO: 95351 - protein, 397 aa, Bordetella pertussis Tohama I; identical to SEQ ID NO: 56180

SEQ ID NO: 95352 - DNA, 1269 bp, Bordetella pertussis Tohama I; identical to SEQ ID NO: 56181
  CDS (1)..(1269): transl_table=11

SEQ ID NO: 95353 - protein, 422 aa, Bordetella pertussis Tohama I; identical to SEQ ID NO: 56182

SEQ ID NO: 95354 - DNA, 1293 bp, Bordetella parapertussis 12822; identical to SEQ ID NO: 56183
  CDS (1)..(1293)

SEQ ID NO: 95355 - protein, 430 aa, Bordetella parapertussis 12822; identical to SEQ ID NO: 56184

SEQ ID NO: 95356 - DNA, 1287 bp, Bordetella parapertussis 12822; identical to SEQ ID NO: 56185
  CDS (1)..(1287)

SEQ ID NO: 95357 - protein, 428 aa, Bordetella parapertussis 12822; identical to SEQ ID NO: 56186

SEQ ID NO: 95358 - DNA, 1299 bp, Bordetella parapertussis 12822; identical to SEQ ID NO: 56187
  CDS (1)..(1299)

SEQ ID NO: 95359 - protein, 432 aa, Bordetella parapertussis 12822; identical to SEQ ID NO: 56188

SEQ ID NO: 95360 - DNA, 1281 bp, Bordetella parapertussis 12822; identical to SEQ ID NO: 56189
  CDS (1)..(1281)

SEQ ID NO: 95361 - protein, 426 aa, Bordetella parapertussis 12822; identical to SEQ ID NO: 56190

SEQ ID NO: 95362 - DNA, 1293 bp, Bordetella bronchiseptica RB50; identical to SEQ ID NO: 56191
  CDS (1)..(1293)

SEQ ID NO: 95363 - protein, 430 aa, Bordetella bronchiseptica RB50; identical to SEQ ID NO: 56192

SEQ ID NO: 95364 - DNA, 1287 bp, Bordetella bronchiseptica RB50; identical to SEQ ID NO: 56193
  CDS (1)..(1287)

SEQ ID NO: 95365 - protein, 428 aa, Bordetella bronchiseptica RB50; identical to SEQ ID NO: 56194

SEQ ID NO: 95366 - DNA, 1287 bp, Bordetella bronchiseptica RB50; identical to SEQ ID NO: 56195
  CDS (1)..(1287)

SEQ ID NO: 95367 - protein, 428 aa, Bordetella bronchiseptica RB50; identical to SEQ ID NO: 56196

SEQ ID NO: 95368 - DNA, 1269 bp, Bordetella bronchiseptica RB50; identical to SEQ ID NO: 56197
  CDS (1)..(1269)

SEQ ID NO: 95369 - protein, 422 aa, Bordetella bronchiseptica RB50; identical to SEQ ID NO: 56198

SEQ ID NO: 95370 - DNA, 1299 bp, Bordetella bronchiseptica RB50; identical to SEQ ID NO: 56199
  CDS (1)..(1299)

SEQ ID NO: 95371 - protein, 432 aa, Bordetella bronchiseptica RB50; identical to SEQ ID NO: 56200

SEQ ID NO: 95372 - DNA, 1284 bp, Bordetella bronchiseptica RB50; identical to SEQ ID NO: 56201
  CDS (1)..(1284)

SEQ ID NO: 95373 - protein, 427 aa, Bordetella bronchiseptica RB50; identical to SEQ ID NO: 56202

SEQ ID NO: 95374 - DNA, 1299 bp, Bordetella bronchiseptica RB50; identical to SEQ ID NO: 56203
  CDS (1)..(1299)

SEQ ID NO: 95375 - protein, 432 aa, Bordetella bronchiseptica RB50; identical to SEQ ID NO: 56204

SEQ ID NO: 95376 - DNA, 1302 bp, Bordetella bronchiseptica RB50; identical to SEQ ID NO: 56205
  CDS (1)..(1302)

SEQ ID NO: 95377 - protein, 433 aa, Bordetella bronchiseptica RB50; identical to SEQ ID NO: 56206

SEQ ID NO: 95378 - DNA, 1278 bp, Bordetella bronchiseptica RB50; identical to SEQ ID NO: 56207
  CDS (1)..(1278)

SEQ ID NO: 95379 - protein, 425 aa, Bordetella bronchiseptica RB50; identical to SEQ ID NO: 56208

SEQ ID NO: 95380 - DNA, 1275 bp, Bordetella bronchiseptica RB50; identical to SEQ ID NO: 56209
  CDS (1)..(1275)

SEQ ID NO: 95381 - protein, 424 aa, Bordetella bronchiseptica RB50; identical to SEQ ID NO: 56210

SEQ ID NO: 95382 - DNA, 2103 bp, Bordetella bronchiseptica RB50; identical to SEQ ID NO: 56211
  CDS (1)..(2103)

SEQ ID NO: 95383 - protein, 700 aa, Bordetella bronchiseptica RB50; identical to SEQ ID NO: 56212

SEQ ID NO: 95384 - DNA, 1329 bp, Chromobacterium violaceum ATCC 12472; identical to SEQ ID NO: 56213
  CDS (1)..(1329): transl_table=11

SEQ ID NO: 95385 - protein, 442 aa, Chromobacterium violaceum ATCC 12472; identical to SEQ ID NO: 56214

SEQ ID NO: 95386 - DNA, 1287 bp, Wolinella succinogenes DSM 1740; identical to SEQ ID NO: 56215
  CDS (1)..(1287): transl_table=11

SEQ ID NO: 95387 - protein, 428 aa, Wolinella succinogenes DSM 1740; identical to SEQ ID NO: 56216

SEQ ID NO: 95388 - DNA, 1314 bp, Photorhabdus luminescens subsp. laumondii TTO1; identical to SEQ ID NO: 56217
  CDS (1)..(1314): transl_table=11

SEQ ID NO: 95389 - protein, 437 aa, Photorhabdus luminescens subsp. laumondii TTO1; identical to SEQ ID NO: 56218

SEQ ID NO: 95390 - DNA, 1362 bp, Vibrio vulnificus YJ016; identical to SEQ ID NO: 56219
  CDS (1)..(1362): transl_table=11

SEQ ID NO: 95391 - protein, 453 aa, Vibrio vulnificus YJ016; identical to SEQ ID NO: 56220

SEQ ID NO: 95392 - DNA, 1299 bp, Vibrio vulnificus YJ016; identical to SEQ ID NO: 56221
  CDS (1)..(1299): transl_table=11

SEQ ID NO: 95393 - protein, 432 aa, Vibrio vulnificus YJ016; identical to SEQ ID NO: 56222

SEQ ID NO: 95394 - DNA, 1281 bp, Vibrio vulnificus YJ016; identical to SEQ ID NO: 56223
  CDS (1)..(1281): transl_table=11

SEQ ID NO: 95395 - protein, 426 aa, Vibrio vulnificus YJ016; identical to SEQ ID NO: 56224

SEQ ID NO: 95396 - DNA, 1308 bp, Rhodopseudomonas palustris CGA009; identical to SEQ ID NO: 56225
  CDS (1)..(1308): transl_table=11

SEQ ID NO: 95397 - protein, 435 aa, Rhodopseudomonas palustris CGA009; identical to SEQ ID NO: 56226

SEQ ID NO: 95398 - DNA, 1326 bp, Rhodopseudomonas palustris CGA009; identical to SEQ ID NO: 56227
  CDS (1)..(1326): transl_table=11

SEQ ID NO: 95399 - protein, 441 aa, Rhodopseudomonas palustris CGA009; identical to SEQ ID NO: 56228

SEQ ID NO: 95400 - DNA, 1884 bp, Rhodopseudomonas palustris CGA009; identical to SEQ ID NO: 56229
  CDS (1)..(1884): transl_table=11

SEQ ID NO: 95401 - protein, 627 aa, Rhodopseudomonas palustris CGA009; identical to SEQ ID NO: 56230

SEQ ID NO: 95402 - DNA, 1290 bp, Rhodopseudomonas palustris CGA009; identical to SEQ ID NO: 56231
  CDS (1)..(1290): transl_table=11

SEQ ID NO: 95403 - protein, 429 aa, Rhodopseudomonas palustris CGA009; identical to SEQ ID NO: 56232

SEQ ID NO: 95404 - DNA, 1266 bp, Geobacter sulfurreducens PCA; identical to SEQ ID NO: 56233
  CDS (1)..(1266): transl_table=11

SEQ ID NO: 95405 - protein, 421 aa, Geobacter sulfurreducens PCA; identical to SEQ ID NO: 56234

SEQ ID NO: 95406 - DNA, 1848 bp, Treponema denticola ATCC 35405; identical to SEQ ID NO: 56235
  CDS (1)..(1848): transl_table=11

SEQ ID NO: 95407 - protein, 615 aa, Treponema denticola ATCC 35405; identical to SEQ ID NO: 56236

SEQ ID NO: 95408 - DNA, 1314 bp, Thermus thermophilus HB27; identical to SEQ ID NO: 56237
  CDS (1)..(1314): transl_table=11

SEQ ID NO: 95409 - protein, 437 aa, Thermus thermophilus HB27; identical to SEQ ID NO: 56238

SEQ ID NO: 95410 - DNA, 1284 bp, Thermus thermophilus HB27; identical to SEQ ID NO: 56239
  CDS (1)..(1284): transl_table=11

SEQ ID NO: 95411 - protein, 427 aa, Thermus thermophilus HB27; identical to SEQ ID NO: 56240

SEQ ID NO: 95412 - DNA, 1281 bp, Desulfovibrio vulgaris subsp. vulgaris str. Hildenborough; identical to SEQ ID NO: 56241
  CDS (1)..(1281): transl_table=11

SEQ ID NO: 95413 - protein, 426 aa, Desulfovibrio vulgaris subsp. vulgaris str. Hildenborough; identical to SEQ ID NO: 56242

SEQ ID NO: 95414 - DNA, 1284 bp, Desulfovibrio vulgaris subsp. vulgaris str. Hildenborough; identical to SEQ ID NO: 56243
  CDS (1)..(1284): transl_table=11

SEQ ID NO: 95415 - protein, 427 aa, Desulfovibrio vulgaris subsp. vulgaris str. Hildenborough; identical to SEQ ID NO: 56244

SEQ ID NO: 95416 - DNA, 1776 bp, Desulfovibrio vulgaris subsp. vulgaris str. Hildenborough; identical to SEQ ID NO: 56245
  CDS (1)..(1776): transl_table=11

SEQ ID NO: 95417 - protein, 591 aa, Desulfovibrio vulgaris subsp. vulgaris str. Hildenborough; identical to SEQ ID NO: 56246

SEQ ID NO: 95418 - DNA, 1293 bp, Erwinia carotovora subsp. atroseptica SCRI1043; identical to SEQ ID NO: 56247
  CDS (1)..(1293)

SEQ ID NO: 95419 - protein, 430 aa, Erwinia carotovora subsp. atroseptica SCRI1043; identical to SEQ ID NO: 56248

SEQ ID NO: 95420 - DNA, 1263 bp, Desulfotalea psychrophila LSv54; identical to SEQ ID NO: 56249
  CDS (1)..(1263): transl_table=11

SEQ ID NO: 95421 - protein, 420 aa, Desulfotalea psychrophila LSv54; identical to SEQ ID NO: 56250

SEQ ID NO: 95422 - DNA, 1305 bp, Desulfotalea psychrophila LSv54; identical to SEQ ID NO: 56251
  CDS (1)..(1305): transl_table=11

SEQ ID NO: 95423 - protein, 434 aa, Desulfotalea psychrophila LSv54; identical to SEQ ID NO: 56252

SEQ ID NO: 95424 - DNA, 1305 bp, Desulfotalea psychrophila LSv54; identical to SEQ ID NO: 56253
  CDS (1)..(1305): transl_table=11

SEQ ID NO: 95425 - protein, 434 aa, Desulfotalea psychrophila LSv54; identical to SEQ ID NO: 56254

SEQ ID NO: 95426 - DNA, 1287 bp, Desulfotalea psychrophila LSv54; identical to SEQ ID NO: 56255
  CDS (1)..(1287): transl_table=11

SEQ ID NO: 95427 - protein, 428 aa, Desulfotalea psychrophila LSv54; identical to SEQ ID NO: 56256

SEQ ID NO: 95428 - DNA, 1287 bp, Desulfotalea psychrophila LSv54; identical to SEQ ID NO: 56257
  CDS (1)..(1287): transl_table=11

SEQ ID NO: 95429 - protein, 428 aa, Desulfotalea psychrophila LSv54; identical to SEQ ID NO: 56258

SEQ ID NO: 95430 - DNA, 1302 bp, Desulfotalea psychrophila LSv54; identical to SEQ ID NO: 56259
  CDS (1)..(1302): transl_table=11

SEQ ID NO: 95431 - protein, 433 aa, Desulfotalea psychrophila LSv54; identical to SEQ ID NO: 56260

SEQ ID NO: 95432 - DNA, 1281 bp, Desulfotalea psychrophila LSv54; identical to SEQ ID NO: 56261
  CDS (1)..(1281): transl_table=11

SEQ ID NO: 95433 - protein, 426 aa, Desulfotalea psychrophila LSv54; identical to SEQ ID NO: 56262

SEQ ID NO: 95434 - DNA, 1869 bp, Desulfotalea psychrophila LSv54; identical to SEQ ID NO: 56263
  CDS (1)..(1869): transl_table=11

SEQ ID NO: 95435 - protein, 622 aa, Desulfotalea psychrophila LSv54; identical to SEQ ID NO: 56264

SEQ ID NO: 95436 - DNA, 1278 bp, Mannheimia succiniciproducens MBEL55E; identical to SEQ ID NO: 56265
  CDS (1)..(1278): transl_table=11

SEQ ID NO: 95437 - protein, 425 aa, Mannheimia succiniciproducens MBEL55E; identical to SEQ ID NO: 56266

SEQ ID NO: 95438 - DNA, 1293 bp, Mannheimia succiniciproducens MBEL55E; identical to SEQ ID NO: 56267
  CDS (1)..(1293): transl_table=11

SEQ ID NO: 95439 - protein, 430 aa, Mannheimia succiniciproducens MBEL55E; identical to SEQ ID NO: 56268

SEQ ID NO: 95440 - DNA, 1302 bp, Mannheimia succiniciproducens MBEL55E; identical to SEQ ID NO: 56269
  CDS (1)..(1302): transl_table=11

SEQ ID NO: 95441 - protein, 433 aa, Mannheimia succiniciproducens MBEL55E; identical to SEQ ID NO: 56270

SEQ ID NO: 95442 - DNA, 1317 bp, Mannheimia succiniciproducens MBEL55E; identical to SEQ ID NO: 56271
  CDS (1)..(1317): transl_table=11

SEQ ID NO: 95443 - protein, 438 aa, Mannheimia succiniciproducens MBEL55E; identical to SEQ ID NO: 56272

SEQ ID NO: 95444 - DNA, 1296 bp, Bacillus licheniformis ATCC 14580; identical to SEQ ID NO: 56273
  CDS (1)..(1296): transl_table=11

SEQ ID NO: 95445 - protein, 431 aa, Bacillus licheniformis ATCC 14580; identical to SEQ ID NO: 56274

SEQ ID NO: 95446 - DNA, 1284 bp, Photobacterium profundum SS9; identical to SEQ ID NO: 56275
  CDS (1)..(1284): transl_table=11

SEQ ID NO: 95447 - protein, 427 aa, Photobacterium profundum SS9; identical to SEQ ID NO: 56276

SEQ ID NO: 95448 - DNA, 1308 bp, Photobacterium profundum SS9; identical to SEQ ID NO: 56277
  CDS (1)..(1308): transl_table=11

SEQ ID NO: 95449 - protein, 435 aa, Photobacterium profundum SS9; identical to SEQ ID NO: 56278

SEQ ID NO: 95450 - DNA, 1302 bp, Photobacterium profundum SS9; identical to SEQ ID NO: 56279
  CDS (1)..(1302): transl_table=11

SEQ ID NO: 95451 - protein, 433 aa, Photobacterium profundum SS9; identical to SEQ ID NO: 56280

SEQ ID NO: 95452 - DNA, 1404 bp, Photobacterium profundum SS9; identical to SEQ ID NO: 56281
  CDS (1)..(1404): transl_table=11

SEQ ID NO: 95453 - protein, 467 aa, Photobacterium profundum SS9; identical to SEQ ID NO: 56282

SEQ ID NO: 95454 - DNA, 1284 bp, Thermus thermophilus HB8; identical to SEQ ID NO: 56283
  CDS (1)..(1284): transl_table=11

SEQ ID NO: 95455 - protein, 427 aa, Thermus thermophilus HB8; identical to SEQ ID NO: 56284

SEQ ID NO: 95456 - DNA, 1284 bp, Geobacillus kaustophilus HTA426; identical to SEQ ID NO: 56285
  CDS (1)..(1284): transl_table=11

SEQ ID NO: 95457 - protein, 427 aa, Geobacillus kaustophilus HTA426; identical to SEQ ID NO: 56286

SEQ ID NO: 95458 - DNA, 1308 bp, Salmonella enterica subsp. enterica serovar Paratypi A str. ATCC; identical to SEQ ID NO: 56287
  CDS (1)..(1308): transl_table=11

SEQ ID NO: 95459 - protein, 435 aa, Salmonella enterica subsp. enterica serovar Paratypi A str. ATCC; identical to SEQ ID NO: 56288

SEQ ID NO: 95460 - DNA, 1284 bp, Azoarcus sp. EbN1; identical to SEQ ID NO: 56289
  CDS (1)..(1284): transl_table=11

SEQ ID NO: 95461 - protein, 427 aa, Azoarcus sp. EbN1; identical to SEQ ID NO: 56290

SEQ ID NO: 95462 - DNA, 1281 bp, Silicibacter pomeroyi DSS-3; identical to SEQ ID NO: 56291
  CDS (1)..(1281): transl_table=11

SEQ ID NO: 95463 - protein, 426 aa, Silicibacter pomeroyi DSS-3; identical to SEQ ID NO: 56292

SEQ ID NO: 95464 - DNA, 1266 bp, Silicibacter pomeroyi DSS-3; identical to SEQ ID NO: 56293
  CDS (1)..(1266): transl_table=11

SEQ ID NO: 95465 - protein, 421 aa, Silicibacter pomeroyi DSS-3; identical to SEQ ID NO: 56294

SEQ ID NO: 95466 - DNA, 1353 bp, Silicibacter pomeroyi DSS-3; identical to SEQ ID NO: 56295
  CDS (1)..(1353): transl_table=11

SEQ ID NO: 95467 - protein, 450 aa, Silicibacter pomeroyi DSS-3; identical to SEQ ID NO: 56296

SEQ ID NO: 95468 - DNA, 1287 bp, Silicibacter pomeroyi DSS-3; identical to SEQ ID NO: 56297
  CDS (1)..(1287): transl_table=11

SEQ ID NO: 95469 - protein, 428 aa, Silicibacter pomeroyi DSS-3; identical to SEQ ID NO: 56298

SEQ ID NO: 95470 - DNA, 1278 bp, Silicibacter pomeroyi DSS-3; identical to SEQ ID NO: 56299
  CDS (1)..(1278): transl_table=11

SEQ ID NO: 95471 - protein, 425 aa, Silicibacter pomeroyi DSS-3; identical to SEQ ID NO: 56300

SEQ ID NO: 95472 - DNA, 1260 bp, Silicibacter pomeroyi DSS-3; identical to SEQ ID NO: 56301
  CDS (1)..(1260): transl_table=11

SEQ ID NO: 95473 - protein, 419 aa, Silicibacter pomeroyi DSS-3; identical to SEQ ID NO: 56302

SEQ ID NO: 95474 - DNA, 1362 bp, Silicibacter pomeroyi DSS-3; identical to SEQ ID NO: 56303
  CDS (1)..(1362): transl_table=11

SEQ ID NO: 95475 - protein, 453 aa, Silicibacter pomeroyi DSS-3; identical to SEQ ID NO: 56304

SEQ ID NO: 95476 - DNA, 1314 bp, Silicibacter pomeroyi DSS-3; identical to SEQ ID NO: 56305
  CDS (1)..(1314): transl_table=11

SEQ ID NO: 95477 - protein, 437 aa, Silicibacter pomeroyi DSS-3; identical to SEQ ID NO: 56306

SEQ ID NO: 95478 - DNA, 1398 bp, Silicibacter pomeroyi DSS-3; identical to SEQ ID NO: 56307
  CDS (1)..(1398): transl_table=11

SEQ ID NO: 95479 - protein, 465 aa, Silicibacter pomeroyi DSS-3; identical to SEQ ID NO: 56308

SEQ ID NO: 95480 - DNA, 1302 bp, Bacillus clausii KSM-K16; identical to SEQ ID NO: 56309
  CDS (1)..(1302): transl_table=11

SEQ ID NO: 95481 - protein, 433 aa, Bacillus clausii KSM-K16; identical to SEQ ID NO: 56310

SEQ ID NO: 95482 - DNA, 1284 bp, Bacillus clausii KSM-K16; identical to SEQ ID NO: 56311
  CDS (1)..(1284): transl_table=11

SEQ ID NO: 95483 - protein, 427 aa, Bacillus clausii KSM-K16; identical to SEQ ID NO: 56312

SEQ ID NO: 95484 - DNA, 1305 bp, Bacillus clausii KSM-K16; identical to SEQ ID NO: 56313
  CDS (1)..(1305): transl_table=11

SEQ ID NO: 95485 - protein, 434 aa, Bacillus clausii KSM-K16; identical to SEQ ID NO: 56314

SEQ ID NO: 95486 - DNA, 1284 bp, Bacillus clausii KSM-K16; identical to SEQ ID NO: 56315
  CDS (1)..(1284): transl_table=11

SEQ ID NO: 95487 - protein, 427 aa, Bacillus clausii KSM-K16; identical to SEQ ID NO: 56316

SEQ ID NO: 95488 - DNA, 1332 bp, Bacillus clausii KSM-K16; identical to SEQ ID NO: 56317
  CDS (1)..(1332): transl_table=11

SEQ ID NO: 95489 - protein, 443 aa, Bacillus clausii KSM-K16; identical to SEQ ID NO: 56318

SEQ ID NO: 95490 - DNA, 1272 bp, Bacillus clausii KSM-K16; identical to SEQ ID NO: 56319
  CDS (1)..(1272): transl_table=11

SEQ ID NO: 95491 - protein, 423 aa, Bacillus clausii KSM-K16; identical to SEQ ID NO: 56320

SEQ ID NO: 95492 - DNA, 1275 bp, Bacillus clausii KSM-K16; identical to SEQ ID NO: 56321
  CDS (1)..(1275): transl_table=11

SEQ ID NO: 95493 - protein, 424 aa, Bacillus clausii KSM-K16; identical to SEQ ID NO: 56322

SEQ ID NO: 95494 - DNA, 1161 bp, Rhodobacter sphaeroides 2.4.1; identical to SEQ ID NO: 56323
  CDS (1)..(1161)

SEQ ID NO: 95495 - protein, 386 aa, Rhodobacter sphaeroides 2.4.1; identical to SEQ ID NO: 56324

SEQ ID NO: 95496 - DNA, 1326 bp, Rhodobacter sphaeroides 2.4.1; identical to SEQ ID NO: 56325
  CDS (1)..(1326)

SEQ ID NO: 95497 - protein, 441 aa, Rhodobacter sphaeroides 2.4.1; identical to SEQ ID NO: 56326

SEQ ID NO: 95498 - DNA, 1341 bp, Rhodobacter sphaeroides 2.4.1; identical to SEQ ID NO: 56327
  CDS (1)..(1341)

SEQ ID NO: 95499 - protein, 446 aa, Rhodobacter sphaeroides 2.4.1; identical to SEQ ID NO: 56328

SEQ ID NO: 95500 - DNA, 1329 bp, Magnetospirillum magnetotacticum MS-1; identical to SEQ ID NO: 56329
  CDS (1)..(1329)

SEQ ID NO: 95501 - protein, 442 aa, Magnetospirillum magnetotacticum MS-1; identical to SEQ ID NO: 56330

SEQ ID NO: 95502 - DNA, 1284 bp, Azotobacter vinelandii; identical to SEQ ID NO: 56331
  CDS (1)..(1284)

SEQ ID NO: 95503 - protein, 427 aa, Azotobacter vinelandii; identical to SEQ ID NO: 56332

SEQ ID NO: 95504 - DNA, 1782 bp, Desulfitobacterium hafniense DCB-2; identical to SEQ ID NO: 56333
  CDS (1)..(1782)

SEQ ID NO: 95505 - protein, 593 aa, Desulfitobacterium hafniense DCB-2; identical to SEQ ID NO: 56334

SEQ ID NO: 95506 - DNA, 1143 bp, Desulfitobacterium hafniense DCB-2; identical to SEQ ID NO: 56335
  CDS (1)..(1143)

SEQ ID NO: 95507 - protein, 380 aa, Desulfitobacterium hafniense DCB-2; identical to SEQ ID NO: 56336

SEQ ID NO: 95508 - DNA, 1281 bp, Haemophilus somnus 129PT; identical to SEQ ID NO: 56337
  CDS (1)..(1281)

SEQ ID NO: 95509 - protein, 426 aa, Haemophilus somnus 129PT; identical to SEQ ID NO: 56338

SEQ ID NO: 95510 - DNA, 1221 bp, Haemophilus somnus 129PT; identical to SEQ ID NO: 56339
  CDS (1)..(1221)

SEQ ID NO: 95511 - protein, 406 aa, Haemophilus somnus 129PT; identical to SEQ ID NO: 56340

SEQ ID NO: 95512 - DNA, 1281 bp, Pseudomonas syringae pv. syringae B728a; identical to SEQ ID NO: 56341
  CDS (1)..(1281)

SEQ ID NO: 95513 - protein, 426 aa, Pseudomonas syringae pv. syringae B728a; identical to SEQ ID NO: 56342

SEQ ID NO: 95514 - DNA, 1302 bp, Desulfovibrio desulfuricans G20; identical to SEQ ID NO: 56343
  CDS (1)..(1302)

SEQ ID NO: 95515 - protein, 433 aa, Desulfovibrio desulfuricans G20; identical to SEQ ID NO: 56344

SEQ ID NO: 95516 - DNA, 1284 bp, Desulfovibrio desulfuricans G20; identical to SEQ ID NO: 56345
  CDS (1)..(1284)

SEQ ID NO: 95517 - protein, 427 aa, Desulfovibrio desulfuricans G20; identical to SEQ ID NO: 56346

SEQ ID NO: 95518 - DNA, 1269 bp, Haemophilus somnus 2336; identical to SEQ ID NO: 56347
  CDS (1)..(1269)

SEQ ID NO: 95519 - protein, 422 aa, Haemophilus somnus 2336; identical to SEQ ID NO: 56348

SEQ ID NO: 95520 - DNA, 1857 bp, Haemophilus somnus 2336; identical to SEQ ID NO: 56349
  CDS (1)..(1857)

SEQ ID NO: 95521 - protein, 618 aa, Haemophilus somnus 2336; identical to SEQ ID NO: 56350

SEQ ID NO: 95522 - DNA, 1665 bp, Fusobacterium nucleatum subsp. vincentii ATCC 49256; identical to SEQ ID NO: 56351
  CDS (1)..(1665): transl_table=11

SEQ ID NO: 95523 - protein, 554 aa, Fusobacterium nucleatum subsp. vincentii ATCC 49256; identical to SEQ ID NO: 56352

SEQ ID NO: 95524 - DNA, 1275 bp, Fusobacterium nucleatum subsp. vincentii ATCC 49256; identical to SEQ ID NO: 56353
  CDS (1)..(1275): transl_table=11

SEQ ID NO: 95525 - protein, 424 aa, Fusobacterium nucleatum subsp. vincentii ATCC 49256; identical to SEQ ID NO: 56354

SEQ ID NO: 95526 - DNA, 1281 bp, Dechloromonas aromatica RCB; identical to SEQ ID NO: 56355
  CDS (1)..(1281)

SEQ ID NO: 95527 - protein, 426 aa, Dechloromonas aromatica RCB; identical to SEQ ID NO: 56356

SEQ ID NO: 95528 - DNA, 1851 bp, Haemophilus influenzae R2846; identical to SEQ ID NO: 56357
  CDS (1)..(1851)

SEQ ID NO: 95529 - protein, 616 aa, Haemophilus influenzae R2846; identical to SEQ ID NO: 56358

SEQ ID NO: 95530 - DNA, 1272 bp, Haemophilus influenzae R2846; identical to SEQ ID NO: 56359
  CDS (1)..(1272)

SEQ ID NO: 95531 - protein, 423 aa, Haemophilus influenzae R2846; identical to SEQ ID NO: 56360

SEQ ID NO: 95532 - DNA, 1305 bp, Ralstonia eutropha JMP134; identical to SEQ ID NO: 56361
  CDS (1)..(1305)

SEQ ID NO: 95533 - protein, 434 aa, Ralstonia eutropha JMP134; identical to SEQ ID NO: 56362

SEQ ID NO: 95534 - DNA, 1263 bp, Mesorhizobium sp. BNC1; identical to SEQ ID NO: 56363
  CDS (1)..(1263)

SEQ ID NO: 95535 - protein, 420 aa, Mesorhizobium sp. BNC1; identical to SEQ ID NO: 56364

SEQ ID NO: 95536 - DNA, 1278 bp, Mesorhizobium sp. BNC1; identical to SEQ ID NO: 56365
  CDS (1)..(1278)

SEQ ID NO: 95537 - protein, 425 aa, Mesorhizobium sp. BNC1; identical to SEQ ID NO: 56366

SEQ ID NO: 95538 - DNA, 1257 bp, Mesorhizobium sp. BNC1; identical to SEQ ID NO: 56367
  CDS (1)..(1257)

SEQ ID NO: 95539 - protein, 418 aa, Mesorhizobium sp. BNC1; identical to SEQ ID NO: 56368

SEQ ID NO: 95540 - DNA, 1275 bp, Mesorhizobium sp. BNC1; identical to SEQ ID NO: 56369
  CDS (1)..(1275)

SEQ ID NO: 95541 - protein, 424 aa, Mesorhizobium sp. BNC1; identical to SEQ ID NO: 56370

SEQ ID NO: 95542 - DNA, 1278 bp, Pseudomonas aeruginosa UCBPP-PA14; identical to SEQ ID NO: 56371
  CDS (1)..(1278)

SEQ ID NO: 95543 - protein, 425 aa, Pseudomonas aeruginosa UCBPP-PA14; identical to SEQ ID NO: 56372

SEQ ID NO: 95544 - DNA, 1281 bp, Rhodobacter sphaeroides 2.4.1; identical to SEQ ID NO: 56373
  CDS (1)..(1281)

SEQ ID NO: 95545 - protein, 426 aa, Rhodobacter sphaeroides 2.4.1; identical to SEQ ID NO: 56374

SEQ ID NO: 95546 - DNA, 1281 bp, Rhodobacter sphaeroides 2.4.1; identical to SEQ ID NO: 56375
  CDS (1)..(1281)

SEQ ID NO: 95547 - protein, 426 aa, Rhodobacter sphaeroides 2.4.1; identical to SEQ ID NO: 56376

SEQ ID NO: 95548 - DNA, 1281 bp, Pseudomonas fluorescens PfO-1; identical to SEQ ID NO: 56377
  CDS (1)..(1281)

SEQ ID NO: 95549 - protein, 426 aa, Pseudomonas fluorescens PfO-1; identical to SEQ ID NO: 56378

SEQ ID NO: 95550 - DNA, 1284 bp, Rhodospirillum rubrum; identical to SEQ ID NO: 56379
  CDS (1)..(1284)

SEQ ID NO: 95551 - protein, 427 aa, Rhodospirillum rubrum; identical to SEQ ID NO: 56380

SEQ ID NO: 95552 - DNA, 1353 bp, Burkholderia fungorum LB400; identical to SEQ ID NO: 56381
  CDS (1)..(1353)

SEQ ID NO: 95553 - protein, 450 aa, Burkholderia fungorum LB400; identical to SEQ ID NO: 56382

SEQ ID NO: 95554 - DNA, 1287 bp, Burkholderia fungorum LB400; identical to SEQ ID NO: 56383
  CDS (1)..(1287)

SEQ ID NO: 95555 - protein, 428 aa, Burkholderia fungorum LB400; identical to SEQ ID NO: 56384

SEQ ID NO: 95556 - DNA, 1887 bp, Burkholderia fungorum LB400; identical to SEQ ID NO: 56385
  CDS (1)..(1887)

SEQ ID NO: 95557 - protein, 628 aa, Burkholderia fungorum LB400; identical to SEQ ID NO: 56386

SEQ ID NO: 95558 - DNA, 1296 bp, Enterococcus faecium; identical to SEQ ID NO: 56387
  CDS (1)..(1296)

SEQ ID NO: 95559 - protein, 431 aa, Enterococcus faecium; identical to SEQ ID NO: 56388

SEQ ID NO: 95560 - DNA, 1287 bp, Magnetococcus sp. MC-1; identical to SEQ ID NO: 56389
  CDS (1)..(1287)

SEQ ID NO: 95561 - protein, 428 aa, Magnetococcus sp. MC-1; identical to SEQ ID NO: 56390

SEQ ID NO: 95562 - DNA, 1386 bp, Magnetococcus sp. MC-1; identical to SEQ ID NO: 56391
  CDS (1)..(1386)

SEQ ID NO: 95563 - protein, 461 aa, Magnetococcus sp. MC-1; identical to SEQ ID NO: 56392

SEQ ID NO: 95564 - DNA, 1209 bp, Microbulbifer degradans 2-40; identical to SEQ ID NO: 56393
  CDS (1)..(1209)

SEQ ID NO: 95565 - protein, 402 aa, Microbulbifer degradans 2-40; identical to SEQ ID NO: 56394

SEQ ID NO: 95566 - DNA, 1299 bp, Microbulbifer degradans 2-40; identical to SEQ ID NO: 56395
  CDS (1)..(1299)

SEQ ID NO: 95567 - protein, 432 aa, Microbulbifer degradans 2-40; identical to SEQ ID NO: 56396

SEQ ID NO: 95568 - DNA, 1278 bp, Thiobacillus denitrificans ATCC 25259; identical to SEQ ID NO: 56397
  CDS (1)..(1278)

SEQ ID NO: 95569 - protein, 425 aa, Thiobacillus denitrificans ATCC 25259; identical to SEQ ID NO: 56398

SEQ ID NO: 95570 - DNA, 1377 bp, Silicibacter sp. TM1040; identical to SEQ ID NO: 56399
  CDS (1)..(1377)

SEQ ID NO: 95571 - protein, 458 aa, Silicibacter sp. TM1040; identical to SEQ ID NO: 56400

SEQ ID NO: 95572 - DNA, 1302 bp, Silicibacter sp. TM1040; identical to SEQ ID NO: 56401
  CDS (1)..(1302)

SEQ ID NO: 95573 - protein, 433 aa, Silicibacter sp. TM1040; identical to SEQ ID NO: 56402

SEQ ID NO: 95574 - DNA, 1287 bp, Silicibacter sp. TM1040; identical to SEQ ID NO: 56403
  CDS (1)..(1287)

SEQ ID NO: 95575 - protein, 428 aa, Silicibacter sp. TM1040; identical to SEQ ID NO: 56404

SEQ ID NO: 95576 - DNA, 1284 bp, Silicibacter sp. TM1040; identical to SEQ ID NO: 56405
  CDS (1)..(1284)

SEQ ID NO: 95577 - protein, 427 aa, Silicibacter sp. TM1040; identical to SEQ ID NO: 56406

SEQ ID NO: 95578 - DNA, 1476 bp, Silicibacter sp. TM1040; identical to SEQ ID NO: 56407
  CDS (1)..(1476)

SEQ ID NO: 95579 - protein, 491 aa, Silicibacter sp. TM1040; identical to SEQ ID NO: 56408

SEQ ID NO: 95580 - DNA, 1287 bp, Silicibacter sp. TM1040; identical to SEQ ID NO: 56409
  CDS (1)..(1287)

SEQ ID NO: 95581 - protein, 428 aa, Silicibacter sp. TM1040; identical to SEQ ID NO: 56410

SEQ ID NO: 95582 - DNA, 1299 bp, Silicibacter sp. TM1040; identical to SEQ ID NO: 56411
  CDS (1)..(1299)

SEQ ID NO: 95583 - protein, 432 aa, Silicibacter sp. TM1040; identical to SEQ ID NO: 56412

SEQ ID NO: 95584 - DNA, 1290 bp, Psychrobacter sp. 273-4; identical to SEQ ID NO: 56413
  CDS (1)..(1290)

SEQ ID NO: 95585 - protein, 429 aa, Psychrobacter sp. 273-4; identical to SEQ ID NO: 56414

SEQ ID NO: 95586 - DNA, 1317 bp, Desulfovibrio desulfuricans G20; identical to SEQ ID NO: 56415
  CDS (1)..(1317)

SEQ ID NO: 95587 - protein, 438 aa, Desulfovibrio desulfuricans G20; identical to SEQ ID NO: 56416

SEQ ID NO: 95588 - DNA, 1284 bp, Dechloromonas aromatica RCB; identical to SEQ ID NO: 56417
  CDS (1)..(1284)

SEQ ID NO: 95589 - protein, 427 aa, Dechloromonas aromatica RCB; identical to SEQ ID NO: 56418

SEQ ID NO: 95590 - DNA, 1335 bp, Chloroflexus aurantiacus; identical to SEQ ID NO: 56419
  CDS (1)..(1335)

SEQ ID NO: 95591 - protein, 444 aa, Chloroflexus aurantiacus; identical to SEQ ID NO: 56420

SEQ ID NO: 95592 - DNA, 1290 bp, Polaromonas sp. JS666; identical to SEQ ID NO: 56421
  CDS (1)..(1290)

SEQ ID NO: 95593 - protein, 429 aa, Polaromonas sp. JS666; identical to SEQ ID NO: 56422

SEQ ID NO: 95594 - DNA, 1395 bp, Polaromonas sp. JS666; identical to SEQ ID NO: 56423
  CDS (1)..(1395)

SEQ ID NO: 95595 - protein, 464 aa, Polaromonas sp. JS666; identical to SEQ ID NO: 56424

SEQ ID NO: 95596 - DNA, 1260 bp, Polaromonas sp. JS666; identical to SEQ ID NO: 56425
  CDS (1)..(1260)

SEQ ID NO: 95597 - protein, 419 aa, Polaromonas sp. JS666; identical to SEQ ID NO: 56426

SEQ ID NO: 95598 - DNA, 1281 bp, Polaromonas sp. JS666; identical to SEQ ID NO: 56427
  CDS (1)..(1281)

SEQ ID NO: 95599 - protein, 426 aa, Polaromonas sp. JS666; identical to SEQ ID NO: 56428

SEQ ID NO: 95600 - DNA, 1296 bp, Polaromonas sp. JS666; identical to SEQ ID NO: 56429
  CDS (1)..(1296)

SEQ ID NO: 95601 - protein, 431 aa, Polaromonas sp. JS666; identical to SEQ ID NO: 56430

SEQ ID NO: 95602 - DNA, 1323 bp, Polaromonas sp. JS666; identical to SEQ ID NO: 56431
  CDS (1)..(1323)

SEQ ID NO: 95603 - protein, 440 aa, Polaromonas sp. JS666; identical to SEQ ID NO: 56432

SEQ ID NO: 95604 - DNA, 1269 bp, Polaromonas sp. JS666; identical to SEQ ID NO: 56433
  CDS (1)..(1269)

SEQ ID NO: 95605 - protein, 422 aa, Polaromonas sp. JS666; identical to SEQ ID NO: 56434

SEQ ID NO: 95606 - DNA, 1293 bp, Polaromonas sp. JS666; identical to SEQ ID NO: 56435
  CDS (1)..(1293)

SEQ ID NO: 95607 - protein, 430 aa, Polaromonas sp. JS666; identical to SEQ ID NO: 56436

SEQ ID NO: 95608 - DNA, 1188 bp, Polaromonas sp. JS666; identical to SEQ ID NO: 56437
  CDS (1)..(1188)

SEQ ID NO: 95609 - protein, 395 aa, Polaromonas sp. JS666; identical to SEQ ID NO: 56438

SEQ ID NO: 95610 - DNA, 1323 bp, Rhodobacter capsulatus; identical to SEQ ID NO: 56439
  CDS (1)..(1323): transl_table=11

SEQ ID NO: 95611 - protein, 440 aa, Rhodobacter capsulatus; identical to SEQ ID NO: 56440

SEQ ID NO: 95612 - DNA, 1281 bp, Comamonas sp; identical to SEQ ID NO: 56441
  CDS (1)..(1281): transl_table=11

SEQ ID NO: 95613 - protein, 426 aa, Comamonas sp; identical to SEQ ID NO: 56442

SEQ ID NO: 95614 - DNA, 1341 bp, Paracoccus denitrificans; identical to SEQ ID NO: 56443
  CDS (1)..(1341): transl_table=11

SEQ ID NO: 95615 - protein, 446 aa, Paracoccus denitrificans; identical to SEQ ID NO: 56444

SEQ ID NO: 95616 - DNA, 1284 bp, Halomonas elongata; identical to SEQ ID NO: 56445
  CDS (1)..(1284): transl_table=11

SEQ ID NO: 95617 - protein, 427 aa, Halomonas elongata; identical to SEQ ID NO: 56446

SEQ ID NO: 95618 - DNA, 1296 bp, Mycobacterium smegmatis; identical to SEQ ID NO: 56447
  CDS (1)..(1296): transl_table=11

SEQ ID NO: 95619 - protein, 431 aa, Mycobacterium smegmatis; identical to SEQ ID NO: 56448

SEQ ID NO: 95620 - DNA, 1281 bp, Pseudomonas stutzeri; identical to SEQ ID NO: 56449
  CDS (1)..(1281): transl_table=11

SEQ ID NO: 95621 - protein, 426 aa, Pseudomonas stutzeri; identical to SEQ ID NO: 56450

SEQ ID NO: 95622 - DNA, 1251 bp, Agrobacterium tumefaciens; identical to SEQ ID NO: 56451
  CDS (1)..(1251): transl_table=11

SEQ ID NO: 95623 - protein, 416 aa, Agrobacterium tumefaciens; identical to SEQ ID NO: 56452

SEQ ID NO: 95624 - DNA, 1248 bp, Wolinella succinogenes; identical to SEQ ID NO: 56453
  CDS (1)..(1248): transl_table=11

SEQ ID NO: 95625 - protein, 415 aa, Wolinella succinogenes; identical to SEQ ID NO: 56454

SEQ ID NO: 95626 - DNA, 1206 bp, Haemophilus influenzae; identical to SEQ ID NO: 56455
  CDS (1)..(1206): transl_table=11

SEQ ID NO: 95627 - protein, 401 aa, Haemophilus influenzae; identical to SEQ ID NO: 56456

SEQ ID NO: 95628 - DNA, 1278 bp, Haemophilus influenzae; identical to SEQ ID NO: 56457
  CDS (1)..(1278): transl_table=11

SEQ ID NO: 95629 - protein, 425 aa, Haemophilus influenzae; identical to SEQ ID NO: 56458

SEQ ID NO: 95630 - DNA, 1902 bp, Haemophilus influenzae; identical to SEQ ID NO: 56459
  CDS (1)..(1902): transl_table=11

SEQ ID NO: 95631 - protein, 633 aa, Haemophilus influenzae; identical to SEQ ID NO: 56460

SEQ ID NO: 95632 - DNA, 1260 bp, Rhizobium sp; identical to SEQ ID NO: 56461
  CDS (1)..(1260): transl_table=11

SEQ ID NO: 95633 - protein, 419 aa, Rhizobium sp; identical to SEQ ID NO: 56462

SEQ ID NO: 95634 - DNA, 1308 bp, Salmonella typhimurium; identical to SEQ ID NO: 56463
  CDS (1)..(1308): transl_table=11

SEQ ID NO: 95635 - protein, 435 aa, Salmonella typhimurium; identical to SEQ ID NO: 56464

SEQ ID NO: 95636 - DNA, 22 bp, Primer
atggctgtgctgatttttctgg

SEQ ID NO: 95637 - DNA, 25 bp, Primer
ttaatccatttcaaagggaggatga

SEQ ID NO: 95638 - protein, 544 aa, consensus; identical to SEQ ID NO: 56467
  MISC_FEATURE (1)..(544): consensus for the disclosure of xaa see table XV

SEQ ID NO: 95639 - protein, 143 aa, consensus; identical to SEQ ID NO: 56468
  MISC_FEATURE (1)..(143): consensus for the disclosure of xaa see table XV

SEQ ID NO: 95640 - protein, 70 aa, consensus; identical to SEQ ID NO: 56469
  MISC_FEATURE (1)..(70): consensus for the disclosure of xaa see table XV

SEQ ID NO: 95641 - DNA, 933 bp, Escherichia coli; identical to SEQ ID NO: 64920
  CDS (1)..(933)

SEQ ID NO: 95642 - protein, 310 aa, Escherichia coli [sequence omitted]

SEQ ID NO: 95643 - DNA, 936 bp, Anopheles gambiae str. PEST; identical to SEQ ID NO: 64922
  CDS (1)..(936)

SEQ ID NO: 95644 - protein, 311 aa, Anopheles gambiae str. PEST; identical to SEQ ID NO: 64923

SEQ ID NO: 95645 - DNA, 927 bp, Thermococcus kodakaraensis; identical to SEQ ID NO: 64924
  CDS (1)..(927)

SEQ ID NO: 95646 - protein, 308 aa, Thermococcus kodakaraensis; identical to SEQ ID NO: 64925

SEQ ID NO: 95647 - DNA, 951 bp, Thermococcus kodakaraensis; identical to SEQ ID NO: 64926
  CDS (1)..(951)

SEQ ID NO: 95648 - protein, 316 aa, Thermococcus kodakaraensis; identical to SEQ ID NO: 64927

SEQ ID NO: 95649 - DNA, 981 bp, Gluconobacter oxydans 621H; identical to SEQ ID NO: 64928
  CDS (1)..(981)

SEQ ID NO: 95650 - protein, 326 aa, Gluconobacter oxydans 621H; identical to SEQ ID NO: 64929

SEQ ID NO: 95651 - DNA, 969 bp, Gluconobacter oxydans 621H; identical to SEQ ID NO: 64930
  CDS (1)..(969)

SEQ ID NO: 95652 - protein, 322 aa, Gluconobacter oxydans 621H; identical to SEQ ID NO: 64931

SEQ ID NO: 95653 - DNA, 987 bp, Gluconobacter oxydans 621H; identical to SEQ ID NO: 64932
  CDS (1)..(987)

SEQ ID NO: 95654 - protein, 328 aa, Gluconobacter oxydans 621H; identical to SEQ ID NO: 64933

SEQ ID NO: 95655 - DNA, 993 bp, Lactobacillus acidophilus NCFM; identical to SEQ ID NO: 64934
  CDS (1)..(993)

SEQ ID NO: 95656 - protein, 330 aa, Lactobacillus acidophilus NCFM; identical to SEQ ID NO: 64935

SEQ ID NO: 95657 - DNA, 942 bp, Vibrio fischeri ES114; identical to SEQ ID NO: 64936
  CDS (1)..(942)

SEQ ID NO: 95658 - protein, 313 aa, Vibrio fischeri ES114; identical to SEQ ID NO: 64937

SEQ ID NO: 95659 - DNA, 1005 bp, Neisseria gonorrhoeae FA 1090; identical to SEQ ID NO: 64938
  CDS (1)..(1005)

SEQ ID NO: 95660 - protein, 334 aa, Neisseria gonorrhoeae FA 1090; identical to SEQ ID NO: 64939

SEQ ID NO: 95661 - DNA, 918 bp, Archaeoglobus fulgidus DSM 4304; identical to SEQ ID NO: 64940
  CDS (1)..(918): transl_table=11

SEQ ID NO: 95662 - protein, 305 aa, Archaeoglobus fulgidus DSM 4304; identical to SEQ ID NO: 64941

SEQ ID NO: 95663 - DNA, 1002 bp, Mesorhizobium loti MAFF303099; identical to SEQ ID NO: 64942
  CDS (1)..(1002): transl_table=11

SEQ ID NO: 95664 - protein, 333 aa, Mesorhizobium loti MAFF303099; identical to SEQ ID NO: 64943

SEQ ID NO: 95665 - DNA, 1029 bp, Mesorhizobium loti MAFF303099; identical to SEQ ID NO: 64944
  CDS (1)..(1029): transl_table=11

SEQ ID NO: 95666 - protein, 342 aa, Mesorhizobium loti MAFF303099; identical to SEQ ID NO: 64945

SEQ ID NO: 95667 - DNA, 933 bp, Mesorhizobium loti MAFF303099; identical to SEQ ID NO: 64946
  CDS (1)..(933): transl_table=11

SEQ ID NO: 95668 - protein, 310 aa, Mesorhizobium loti MAFF303099; identical to SEQ ID NO: 64947

SEQ ID NO: 95669 - DNA, 939 bp, Thermoplasma volcanium GSS1; identical to SEQ ID NO: 64948
  CDS (1)..(939): transl_table=11

SEQ ID NO: 95670 - protein, 312 aa, Thermoplasma volcanium GSS1; identical to SEQ ID NO: 64949

SEQ ID NO: 95671 - DNA, 924 bp, Thermoplasma volcanium GSS1; identical to SEQ ID NO: 64950
  CDS (1)..(924): transl_table=11

SEQ ID NO: 95672 - protein, 307 aa, Thermoplasma volcanium GSS1; identical to SEQ ID NO: 64951

SEQ ID NO: 95673 - DNA, 954 bp, Pyrococcus abyssi GE5; identical to SEQ ID NO: 64952
  CDS (1)..(954): transl_table=11

SEQ ID NO: 95674 - protein, 317 aa, Pyrococcus abyssi GE5; identical to SEQ ID NO: 64953

SEQ ID NO: 95675 - DNA, 921 bp, Pyrococcus horikoshii OT3; identical to SEQ ID NO: 64954
  CDS (1)..(921): transl_table=11

SEQ ID NO: 95676 - protein, 306 aa, Pyrococcus horikoshii OT3; identical to SEQ ID NO: 64955

SEQ ID NO: 95677 - DNA, 1140 bp, Arabidopsis thaliana; identical to SEQ ID NO: 64956
  CDS (1)..(1140)

SEQ ID NO: 95678 - protein, 379 aa, Arabidopsis thaliana; identical to SEQ ID NO: 64957

SEQ ID NO: 95679 - DNA, 1311 bp, Arabidopsis thaliana; identical to SEQ ID NO: 64958
  CDS (1)..(1311)

SEQ ID NO: 95680 - protein, 436 aa, Arabidopsis thaliana; identical to SEQ ID NO: 64959

SEQ ID NO: 95681 - DNA, 1035 bp, Helicobacter pylori 26695; identical to SEQ ID NO: 64960
  CDS (1)..(1035): transl_table=11

SEQ ID NO: 95682 - protein, 344 aa, Helicobacter pylori 26695; identical to SEQ ID NO: 64961

SEQ ID NO: 95683 - DNA, 1068 bp, Borrelia burgdorferi B31; identical to SEQ ID NO: 64962
  CDS (1)..(1068): transl_table=11

SEQ ID NO: 95684 - protein, 355 aa, Borrelia burgdorferi B31; identical to SEQ ID NO: 64963

SEQ ID NO: 95685 - DNA, 933 bp, Aquifex aeolicus VF5; identical to SEQ ID NO: 64964
  CDS (1)..(933): transl_table=11

SEQ ID NO: 95686 - protein, 310 aa, Aquifex aeolicus VF5; identical to SEQ ID NO: 64965

SEQ ID NO: 95687 - DNA, 984 bp, Aquifex aeolicus VF5; identical to SEQ ID NO: 64966
  CDS (1)..(984): transl_table=11

SEQ ID NO: 95688 - protein, 327 aa, Aquifex aeolicus VF5; identical to SEQ ID NO: 64967

SEQ ID NO: 95689 - DNA, 1035 bp, Helicobacter pylori J99; identical to SEQ ID NO: 64968
  CDS (1)..(1035): transl_table=11

SEQ ID NO: 95690 - protein, 344 aa, Helicobacter pylori J99; identical to SEQ ID NO: 64969

SEQ ID NO: 95691 - DNA, 930 bp, Thermotoga maritima MSB8; identical to SEQ ID NO: 64970
  CDS (1)..(930): transl_table=11

SEQ ID NO: 95692 - protein, 309 aa, Thermotoga maritima MSB8; identical to SEQ ID NO: 64971

SEQ ID NO: 95693 - DNA, 1041 bp, Thermotoga maritima MSB8; identical to SEQ ID NO: 64972
  CDS (1)..(1041): transl_table=11

SEQ ID NO: 95694 - protein, 346 aa, Thermotoga maritima MSB8; identical to SEQ ID NO: 64973

SEQ ID NO: 95695 - DNA, 948 bp, Bacillus halodurans C-125; identical to SEQ ID NO: 64974
  CDS (1)..(948): transl_table=11

SEQ ID NO: 95696 - protein, 315 aa, Bacillus halodurans C-125; identical to SEQ ID NO: 64975

SEQ ID NO: 95697 - DNA, 927 bp, Bacillus halodurans C-125; identical to SEQ ID NO: 64976
  CDS (1)..(927): transl_table=11

SEQ ID NO: 95698 - protein, 308 aa, Bacillus halodurans C-125; identical to SEQ ID NO: 64977

SEQ ID NO: 95699 - DNA, 936 bp, Bacillus halodurans C-125; identical to SEQ ID NO: 64978
  CDS (1)..(936): transl_table=11

SEQ ID NO: 95700 - protein, 311 aa, Bacillus halodurans C-125; identical to SEQ ID NO: 64979

SEQ ID NO: 95701 - DNA, 1032 bp, Bacillus halodurans C-125; identical to SEQ ID NO: 64980
  CDS (1)..(1032): transl_table=11

SEQ ID NO: 95702 - protein, 343 aa, Bacillus halodurans C-125; identical to SEQ ID NO: 64981

SEQ ID NO: 95703 - DNA, 930 bp, Pseudomonas aeruginosa PAO1; identical to SEQ ID NO: 64982
  CDS (1)..(930): transl_table=11

SEQ ID NO: 95704 - protein, 309 aa, Pseudomonas aeruginosa PAO1; identical to SEQ ID NO: 64983

SEQ ID NO: 95705 - DNA, 942 bp, Lactococcus lactis subsp. lactis Il1403; identical to SEQ ID NO: 64984
  CDS (1)..(942): transl_table=11

SEQ ID NO: 95706 - protein, 313 aa, Lactococcus lactis subsp. lactis Il1403; identical to SEQ ID NO: 64985

SEQ ID NO: 95707 - DNA, 981 bp, Lactococcus lactis subsp. lactis Il1403; identical to SEQ ID NO: 64986
  CDS (1)..(981): transl_table=11

SEQ ID NO: 95708 - protein, 326 aa, Lactococcus lactis subsp. lactis Il1403; identical to SEQ ID NO: 64987

SEQ ID NO: 95709 - DNA, 951 bp, Methanothermobacter thermautotrophicus str. Delta H; identical to SEQ ID NO: 64988
  CDS (1)..(951): transl_table=11

SEQ ID NO: 95710 - protein, 316 aa, Methanothermobacter thermautotrophicus str. Delta H; identical to SEQ ID NO: 64989

SEQ ID NO: 95711 - DNA, 978 bp, Methanothermobacter thermautotrophicus str. Delta H; identical to SEQ ID NO: 64990
  CDS (1)..(978): transl_table=11

SEQ ID NO: 95712 - protein, 325 aa, Methanothermobacter thermautotrophicus str. Delta H; identical to SEQ ID NO: 64991

SEQ ID NO: 95713 - DNA, 987 bp, Halobacterium salinarum NRC-1; identical to SEQ ID NO: 64992
  CDS (1)..(987): transl_table=11

SEQ ID NO: 95714 - protein, 328 aa, Halobacterium salinarum NRC-1; identical to SEQ ID NO: 64993

SEQ ID NO: 95715 - DNA, 930 bp, Halobacterium salinarum NRC-1; identical to SEQ ID NO: 64994
  CDS (1)..(930): transl_table=11

SEQ ID NO: 95716 - protein, 309 aa, Halobacterium salinarum NRC-1; identical to SEQ ID NO: 64995

SEQ ID NO: 95717 - DNA, 945 bp, Halobacterium salinarum NRC-1; identical to SEQ ID NO: 64996
  CDS (1)..(945): transl_table=11

SEQ ID NO: 95718 - protein, 314 aa, Halobacterium salinarum NRC-1; identical to SEQ ID NO: 64997

SEQ ID NO: 95719 - DNA, 972 bp, Campylobacter jejuni subsp. jejuni NCTC 11168; identical to SEQ ID NO: 64998
  CDS (1)..(972): transl_table=11

SEQ ID NO: 95720 - protein, 323 aa, Campylobacter jejuni subsp. jejuni NCTC 11168; identical to SEQ ID NO: 64999

SEQ ID NO: 95721 - DNA, 1185 bp, Deinococcus radiodurans R1; identical to SEQ ID NO: 65000
  CDS (1)..(1185): transl_table=11

SEQ ID NO: 95722 - protein, 394 aa, Deinococcus radiodurans R1; identical to SEQ ID NO: 65001

SEQ ID NO: 95723 - DNA, 933 bp, Sulfolobus solfataricus P2; identical to SEQ ID NO: 65002
  CDS (1)..(933): transl_table=11

SEQ ID NO: 95724 - protein, 310 aa, Sulfolobus solfataricus P2; identical to SEQ ID NO: 65003

SEQ ID NO: 95725 - DNA, 984 bp, Clostridium acetobutylicum ATCC 824; identical to SEQ ID NO: 65004
  CDS (1)..(984): transl_table=11

SEQ ID NO: 95726 - protein, 327 aa, Clostridium acetobutylicum ATCC 824; identical to SEQ ID NO: 65005

SEQ ID NO: 95727 - DNA, 999 bp, Clostridium acetobutylicum ATCC 824; identical to SEQ ID NO: 65006
  CDS (1)..(999): transl_table=11

SEQ ID NO: 95728 - protein, 332 aa, Clostridium acetobutylicum ATCC 824; identical to SEQ ID NO: 65007

SEQ ID NO: 95729 - DNA, 906 bp, Clostridium acetobutylicum ATCC 824; identical to SEQ ID NO: 65008
  CDS (1)..(906): transl_table=11

SEQ ID NO: 95730 - protein, 301 aa, Clostridium acetobutylicum ATCC 824; identical to SEQ ID NO: 65009

SEQ ID NO: 95731 - DNA, 990 bp, Clostridium acetobutylicum ATCC 824; identical to SEQ ID NO: 65010
  CDS (1)..(990): transl_table=11

SEQ ID NO: 95732 - protein, 329 aa, Clostridium acetobutylicum ATCC 824; identical to SEQ ID NO: 65011

SEQ ID NO: 95733 - DNA, 1071 bp, Agrobacterium tumefaciens str. C58; identical to SEQ ID NO: 65012
  CDS (1)..(1071): transl_table=11

SEQ ID NO: 95734 - protein, 356 aa, Agrobacterium tumefaciens str. C58; identical to SEQ ID NO: 65013

SEQ ID NO: 95735 - DNA, 951 bp, Bacillus subtilis subsp. subtilis str. 168; identical to SEQ ID NO: 65014
  CDS (1)..(951): transl_table=11

SEQ ID NO: 95736 - protein, 316 aa, Bacillus subtilis subsp. subtilis str. 168; identical to SEQ ID NO: 65015

SEQ ID NO: 95737 - DNA, 924 bp, Thermoplasma acidophilum DSM 1728; identical to SEQ ID NO: 65016
  CDS (1)..(924): transl_table=11

SEQ ID NO: 95738 - protein, 307 aa, Thermoplasma acidophilum DSM 1728; identical to SEQ ID NO: 65017

SEQ ID NO: 95739 - DNA, 984 bp, Caulobacter crescentus CB15; identical to SEQ ID NO: 65018
  CDS (1)..(984): transl_table=11

SEQ ID NO: 95740 - protein, 327 aa, Caulobacter crescentus CB15; identical to SEQ ID NO: 65019

SEQ ID NO: 95741 - DNA, 1002 bp, Caulobacter crescentus CB15; identical to SEQ ID NO: 65020
  CDS (1)..(1002): transl_table=11

SEQ ID NO: 95742 - protein, 333 aa, Caulobacter crescentus CB15; identical to SEQ ID NO: 65021

SEQ ID NO: 95743 - DNA, 975 bp, Caulobacter crescentus CB15; identical to SEQ ID NO: 65022
  CDS (1)..(975): transl_table=11

SEQ ID NO: 95744 - protein, 324 aa, Caulobacter crescentus CB15; identical to SEQ ID NO: 65023

SEQ ID NO: 95745 - DNA, 987 bp, Sinorhizobium meliloti 1021; identical to SEQ ID NO: 65024
  CDS (1)..(987): transl_table=11

SEQ ID NO: 95746 - protein, 328 aa, Sinorhizobium meliloti 1021; identical to SEQ ID NO: 65025

SEQ ID NO: 95747 - DNA, 1023 bp, Synechocystis sp. PCC 6803; identical to SEQ ID NO: 65026
  CDS (1)..(1023): transl_table=11

SEQ ID NO: 95748 - protein, 340 aa, Synechocystis sp. PCC 6803; identical to SEQ ID NO: 65027

SEQ ID NO: 95749 - DNA, 1017 bp, Synechocystis sp. PCC 6803; identical to SEQ ID NO: 65028
  CDS (1)..(1017): transl_table=11

SEQ ID NO: 95750 - protein, 338 aa, Synechocystis sp. PCC 6803; identical to SEQ ID NO: 65029

SEQ ID NO: 95751 - DNA, 984 bp, Listeria monocytogenes EGD-e; identical to SEQ ID NO: 65030
  CDS (1)..(984): transl_table=11

SEQ ID NO: 95752 - protein, 327 aa, Listeria monocytogenes EGD-e; identical to SEQ ID NO: 65031

SEQ ID NO: 95753 - DNA, 987 bp, Listeria innocua Clip11262; identical to SEQ ID NO: 65032
  CDS (1)..(987): transl_table=11

SEQ ID NO: 95754 - protein, 328 aa, Listeria innocua Clip11262; identical to SEQ ID NO: 65033

SEQ ID NO: 95755 - DNA, 951 bp, Nostoc sp. PCC 7120; identical to SEQ ID NO: 65034
  CDS (1)..(951): transl_table=11

SEQ ID NO: 95756 - protein, 316 aa, Nostoc sp. PCC 7120; identical to SEQ ID NO: 65035

SEQ ID NO: 95757 - DNA, 1044 bp, Caenorhabditis elegans; identical to SEQ ID NO: 65036
  CDS (1)..(1044)

SEQ ID NO: 95758 - protein, 347 aa, Caenorhabditis elegans; identical to SEQ ID NO: 65037

SEQ ID NO: 95759 - DNA, 1032 bp, Agrobacterium tumefaciens str. C58; identical to SEQ ID NO: 65038
  CDS (1)..(1032): transl_table=11

SEQ ID NO: 95760 - protein, 343 aa, Agrobacterium tumefaciens str. C58; identical to SEQ ID NO: 65039

SEQ ID NO: 95761 - DNA, 987 bp, Agrobacterium tumefaciens str. C58; identical to SEQ ID NO: 65040
  CDS (1)..(987): transl_table=11

SEQ ID NO: 95762 - protein, 328 aa, Agrobacterium tumefaciens str. C58; identical to SEQ ID NO: 65041

SEQ ID NO: 95763 - DNA, 987 bp, Brucella melitensis 16M; identical to SEQ ID NO: 65042
  CDS (1)..(987): transl_table=11

SEQ ID NO: 95764 - protein, 328 aa, Brucella melitensis 16M; identical to SEQ ID NO: 65043

SEQ ID NO: 95765 - DNA, 945 bp, Pyrobaculum aerophilum str. IM2; identical to SEQ ID NO: 65044
  CDS (1)..(945): transl_table=11

SEQ ID NO: 95766 - protein, 314 aa, Pyrobaculum aerophilum str. IM2; identical to SEQ ID NO: 65045

SEQ ID NO: 95767 - DNA, 987 bp, Clostridium perfringens str. 13; identical to SEQ ID NO: 65046
  CDS (1)..(987): transl_table=11

SEQ ID NO: 95768 - protein, 328 aa, Clostridium perfringens str. 13; identical to SEQ ID NO: 65047

SEQ ID NO: 95769 - DNA, 1056 bp, Arabidopsis thaliana; identical to SEQ ID NO: 65048
  CDS (1)..(1056)

SEQ ID NO: 95770 - protein, 351 aa, Arabidopsis thaliana; identical to SEQ ID NO: 65049

SEQ ID NO: 95771 - DNA, 951 bp, Pyrococcus furiosus DSM 3638; identical to SEQ ID NO: 65050
  CDS (1)..(951): transl_table=11

SEQ ID NO: 95772 - protein, 316 aa, Pyrococcus furiosus DSM 3638; identical to SEQ ID NO: 65051

SEQ ID NO: 95773 - DNA, 1011 bp, Pyrococcus furiosus DSM 3638; identical to SEQ ID NO: 65052
  CDS (1)..(1011): transl_table=11

SEQ ID NO: 95774 - protein, 336 aa, Pyrococcus furiosus DSM 3638; identical to SEQ ID NO: 65053

SEQ ID NO: 95775 - DNA, 924 bp, Pyrococcus furiosus DSM 3638; identical to SEQ ID NO: 65054
  CDS (1)..(924): transl_table=11

SEQ ID NO: 95776 - protein, 307 aa, Pyrococcus furiosus DSM 3638; identical to SEQ ID NO: 65055

SEQ ID NO: 95777 - DNA, 936 bp, Corynebacterium glutamicum ATCC 13032; identical to SEQ ID NO: 65056
  CDS (1)..(936): transl_table=11

SEQ ID NO: 95778 - protein, 311 aa, Corynebacterium glutamicum ATCC 13032; identical to SEQ ID NO: 65057

SEQ ID NO: 95779 - DNA, 990 bp, Fusobacterium nucleatum subsp. nucleatum ATCC 25586; identical to SEQ ID NO: 65058
  CDS (1)..(990): transl_table=11

SEQ ID NO: 95780 - protein, 329 aa, Fusobacterium nucleatum subsp. nucleatum ATCC 25586; identical to SEQ ID NO: 65059

SEQ ID NO: 95781 - DNA, 975 bp, Fusobacterium nucleatum subsp. nucleatum ATCC 25586; identical to SEQ ID NO: 65060
  CDS (1)..(975): transl_table=11

SEQ ID NO: 95782 - protein, 324 aa, Fusobacterium nucleatum subsp. nucleatum ATCC 25586; identical to SEQ ID NO: 65061

SEQ ID NO: 95783 - DNA, 930 bp, Methanopyrus kandleri AV19; identical to SEQ ID NO: 65062
  CDS (1)..(930): transl_table=11

SEQ ID NO: 95784 - protein, 309 aa, Methanopyrus kandleri AV19; identical to SEQ ID NO: 65063

SEQ ID NO: 95785 - DNA, 936 bp, Methanosarcina acetivorans C2A; identical to SEQ ID NO: 65064
  CDS (1)..(936): transl_table=11

SEQ ID NO: 95786 - protein, 311 aa, Methanosarcina acetivorans C2A; identical to SEQ ID NO: 65065

SEQ ID NO: 95787 - DNA, 963 bp, Methanosarcina acetivorans C2A; identical to SEQ ID NO: 65066
  CDS (1)..(963): transl_table=11

SEQ ID NO: 95788 - protein, 320 aa, Methanosarcina acetivorans C2A; identical to SEQ ID NO: 65067

SEQ ID NO: 95789 - DNA, 897 bp, Methanosarcina acetivorans C2A; identical to SEQ ID NO: 65068
  CDS (1)..(897): transl_table=11

SEQ ID NO: 95790 - protein, 298 aa, Methanosarcina acetivorans C2A; identical to SEQ ID NO: 65069

SEQ ID NO: 95791 - DNA, 990 bp, Thermoanaerobacter tengcongensis MB4; identical to SEQ ID NO: 65070
  CDS (1)..(990): transl_table=11

SEQ ID NO: 95792 - protein, 329 aa, Thermoanaerobacter tengcongensis MB4; identical to SEQ ID NO: 65071

SEQ ID NO: 95793 - DNA, 966 bp, Streptomyces coelicolor A3(2); identical to SEQ ID NO: 65072
  CDS (1)..(966)

SEQ ID NO: 95794 - protein, 321 aa, Streptomyces coelicolor A3(2); identical to SEQ ID NO: 65073

SEQ ID NO: 95795 - DNA, 1005 bp, Streptomyces coelicolor A3(2); identical to SEQ ID NO: 65074
  CDS (1)..(1005)

SEQ ID NO: 95796 - protein, 334 aa, Streptomyces coelicolor A3(2); identical to SEQ ID NO: 65075

SEQ ID NO: 95797 - DNA, 951 bp, Methanosarcina mazei Go1; identical to SEQ ID NO: 65076
  CDS (1)..(951): transl_table=11

SEQ ID NO: 95798 - protein, 316 aa, Methanosarcina mazei Go1; identical to SEQ ID NO: 65077

SEQ ID NO: 95799 - DNA, 1005 bp, Methanosarcina mazei Go1; identical to SEQ ID NO: 65078
  CDS (1)..(1005): transl_table=11

SEQ ID NO: 95800 - protein, 334 aa, Methanosarcina mazei Go1; identical to SEQ ID NO: 65079

SEQ ID NO: 95801 - DNA, 765 bp, Methanosarcina mazei Go1; identical to SEQ ID NO: 65080
  CDS (1)..(765): transl_table=11

SEQ ID NO: 95802 - protein, 254 aa, Methanosarcina mazei Go1; identical to SEQ ID NO: 65081

SEQ ID NO: 95803 - DNA, 1152 bp, Xanthomonas campestris pv. campestris str. ATCC 33913; identical to SEQ ID NO: 65082
  CDS (1)..(1152): transl_table=11

SEQ ID NO: 95804 - protein, 383 aa, Xanthomonas campestris pv. campestris str. ATCC 33913; identical to SEQ ID NO: 65083

SEQ ID NO: 95805 - DNA, 999 bp, Chlorobium tepidum TLS; identical to SEQ ID NO: 65084
  CDS (1)..(999): transl_table=11

SEQ ID NO: 95806 - protein, 332 aa, Chlorobium tepidum TLS; identical to SEQ ID NO: 65085

SEQ ID NO: 95807 - DNA, 1017 bp, Thermosynechococcus elongatus BP-1; identical to SEQ ID NO: 65086
  CDS (1)..(1017): transl_table=11

SEQ ID NO: 95808 - protein, 338 aa, Thermosynechococcus elongatus BP-1; identical to SEQ ID NO: 65087

SEQ ID NO: 95809 - DNA, 996 bp, Streptococcus agalactiae 2603V/R; identical to SEQ ID NO: 65088
  CDS (1)..(996): transl_table=11

SEQ ID NO: 95810 - protein, 331 aa, Streptococcus agalactiae 2603V/R; identical to SEQ ID NO: 65089

SEQ ID NO: 95811 - DNA, 930 bp, Oceanobacillus iheyensis HTE831; identical to SEQ ID NO: 65090
  CDS (1)..(930): transl_table=11

SEQ ID NO: 95812 - protein, 309 aa, Oceanobacillus iheyensis HTE831; identical to SEQ ID NO: 65091

SEQ ID NO: 95813 - DNA, 1023 bp, Oceanobacillus iheyensis HTE831; identical to SEQ ID NO: 65092
  CDS (1)..(1023): transl_table=11

SEQ ID NO: 95814 - protein, 340 aa, Oceanobacillus iheyensis HTE831; identical to SEQ ID NO: 65093

SEQ ID NO: 95815 - DNA, 1014 bp, Bifidobacterium longum NCC2705; identical to SEQ ID NO: 65094
  CDS (1)..(1014): transl_table=11

SEQ ID NO: 95816 - protein, 337 aa, Bifidobacterium longum NCC2705; identical to SEQ ID NO: 65095

SEQ ID NO: 95817 - DNA, 987 bp, Brucella suis 1330; identical to SEQ ID NO: 65096
  CDS (1)..(987): transl_table=11

SEQ ID NO: 95818 - protein, 328 aa, Brucella suis 1330; identical to SEQ ID NO: 65097

SEQ ID NO: 95819 - DNA, 990 bp, Leptospira interrogans serovar Lai str. 56601; identical to SEQ ID NO: 65098
  CDS (1)..(990): transl_table=11

SEQ ID NO: 95820 - protein, 329 aa, Leptospira interrogans serovar Lai str. 56601; identical to SEQ ID NO: 65099

SEQ ID NO: 95821 - DNA, 981 bp, Leptospira interrogans serovar Lai str. 56601; identical to SEQ ID NO: 65100
  CDS (1)..(981): transl_table=11

SEQ ID NO: 95822 - protein, 326 aa, Leptospira interrogans serovar Lai str. 56601; identical to SEQ ID NO: 65101

SEQ ID NO: 95823 - DNA, 972 bp, Leptospira interrogans serovar Lai str. 56601; identical to SEQ ID NO: 65102
  CDS (1)..(972): transl_table=11

SEQ ID NO: 95824 - protein, 323 aa, Leptospira interrogans serovar Lai str. 56601; identical to SEQ ID NO: 65103

SEQ ID NO: 95825 - DNA, 1023 bp, Shewanella oneidensis MR-1; identical to SEQ ID NO: 65104
  CDS (1)..(1023): transl_table=11

SEQ ID NO: 95826 - protein, 340 aa, Shewanella oneidensis MR-1; identical to SEQ ID NO: 65105

SEQ ID NO: 95827 - DNA, 1008 bp, Shewanella oneidensis MR-1; identical to SEQ ID NO: 65106
  CDS (1)..(1008): transl_table=11

SEQ ID NO: 95828 - protein, 335 aa, Shewanella oneidensis MR-1; identical to SEQ ID NO: 65107

SEQ ID NO: 95829 - DNA, 1065 bp, Streptococcus mutans UA159; identical to SEQ ID NO: 65108
  CDS (1)..(1065): transl_table=11

SEQ ID NO: 95830 - protein, 354 aa, Streptococcus mutans UA159; identical to SEQ ID NO: 65109

SEQ ID NO: 95831 - DNA, 1017 bp, Streptococcus mutans UA159; identical to SEQ ID NO: 65110
  CDS (1)..(1017): transl_table=11

SEQ ID NO: 95832 - protein, 338 aa, Streptococcus mutans UA159; identical to SEQ ID NO: 65111

SEQ ID NO: 95833 - DNA, 936 bp, Corynebacterium efficiens YS-314; identical to SEQ ID NO: 65112
  CDS (1)..(936): transl_table=11

SEQ ID NO: 95834 - protein, 311 aa, Corynebacterium efficiens YS-314; identical to SEQ ID NO: 65113

SEQ ID NO: 95835 - DNA, 924 bp, Corynebacterium efficiens YS-314; identical to SEQ ID NO: 65114
  CDS (1)..(924): transl_table=11

SEQ ID NO: 95836 - protein, 307 aa, Corynebacterium efficiens YS-314; identical to SEQ ID NO: 65115

SEQ ID NO: 95837 - DNA, 987 bp, Corynebacterium efficiens YS-314; identical to SEQ ID NO: 65116
  CDS (1)..(987): transl_table=11

SEQ ID NO: 95838 - protein, 328 aa, Corynebacterium efficiens YS-314; identical to SEQ ID NO: 65117

SEQ ID NO: 95839 - DNA, 933 bp, Pseudomonas putida KT2440; identical to SEQ ID NO: 65118
  CDS (1)..(933): transl_table=11

SEQ ID NO: 95840 - protein, 310 aa, Pseudomonas putida KT2440; identical to SEQ ID NO: 65119

SEQ ID NO: 95841 - DNA, 966 bp, Pseudomonas putida KT2440; identical to SEQ ID NO: 65120
  CDS (1)..(966): transl_table=11

SEQ ID NO: 95842 - protein, 321 aa, Pseudomonas putida KT2440; identical to SEQ ID NO: 65121

SEQ ID NO: 95843 - DNA, 1029 bp, Bradyrhizobium japonicum USDA 110; identical to SEQ ID NO: 65122
  CDS (1)..(1029)

SEQ ID NO: 95844 - protein, 342 aa, Bradyrhizobium japonicum USDA 110; identical to SEQ ID NO: 65123

SEQ ID NO: 95845 - DNA, 981 bp, Bradyrhizobium japonicum USDA 110; identical to SEQ ID NO: 65124
  CDS (1)..(981)

SEQ ID NO: 95846 - protein, 326 aa, Bradyrhizobium japonicum USDA 110; identical to SEQ ID NO: 65125

SEQ ID NO: 95847 - DNA, 1023 bp, Bradyrhizobium japonicum USDA 110; identical to SEQ ID NO: 65126
  CDS (1)..(1023)

SEQ ID NO: 95848 - protein, 340 aa, Bradyrhizobium japonicum USDA 110; identical to SEQ ID NO: 65127

SEQ ID NO: 95849 - DNA, 993 bp, Bradyrhizobium japonicum USDA 110; identical to SEQ ID NO: 65128
  CDS (1)..(993)

SEQ ID NO: 95850 - protein, 330 aa, Bradyrhizobium japonicum USDA 110; identical to SEQ ID NO: 65129

SEQ ID NO: 95851 - DNA, 999 bp, Clostridium tetani E88; identical to SEQ ID NO: 65130
  CDS (1)..(999): transl_table=11

SEQ ID NO: 95852 - protein, 332 aa, Clostridium tetani E88; identical to SEQ ID NO: 65131

SEQ ID NO: 95853 - DNA, 996 bp, Lactobacillus plantarum WCFS1; identical to SEQ ID NO: 65132
  CDS (1)..(996): transl_table=11

SEQ ID NO: 95854 - protein, 331 aa, Lactobacillus plantarum WCFS1; identical to SEQ ID NO: 65133

SEQ ID NO: 95855 - DNA, 948 bp, Lactobacillus plantarum WCFS1; identical to SEQ ID NO: 65134
  CDS (1)..(948): transl_table=11

SEQ ID NO: 95856 - protein, 315 aa, Lactobacillus plantarum WCFS1; identical to SEQ ID NO: 65135

SEQ ID NO: 95857 - DNA, 942 bp, Lactobacillus plantarum WCFS1; identical to SEQ ID NO: 65136
  CDS (1)..(942): transl_table=11

SEQ ID NO: 95858 - protein, 313 aa, Lactobacillus plantarum WCFS1; identical to SEQ ID NO: 65137

SEQ ID NO: 95859 - DNA, 1005 bp, Lactobacillus plantarum WCFS1; identical to SEQ ID NO: 65138
  CDS (1)..(1005): transl_table=11

SEQ ID NO: 95860 - protein, 334 aa, Lactobacillus plantarum WCFS1; identical to SEQ ID NO: 65139

SEQ ID NO: 95861 - DNA, 930 bp, Pseudomonas syringae pv. tomato str. DC3000; identical to SEQ ID NO: 65140
  CDS (1)..(930): transl_table=11

SEQ ID NO: 95862 - protein, 309 aa, Pseudomonas syringae pv. tomato str. DC3000; identical to SEQ ID NO: 65141

SEQ ID NO: 95863 - DNA, 999 bp, Pseudomonas syringae pv. tomato str. DC3000; identical to SEQ ID NO: 65142
  CDS (1)..(999): transl_table=11

SEQ ID NO: 95864 - protein, 332 aa, Pseudomonas syringae pv. tomato str. DC3000; identical to SEQ ID NO: 65143

SEQ ID NO: 95865 - DNA, 1011 bp, Vibrio parahaemolyticus RIMD 2210633; identical to SEQ ID NO: 65144
  CDS (1)..(1011): transl_table=11

SEQ ID NO: 95866 - protein, 336 aa, Vibrio parahaemolyticus RIMD 2210633; identical to SEQ ID NO: 65145

SEQ ID NO: 95867 - DNA, 1074 bp, Bacteroides thetaiotaomicron VPI-5482; identical to SEQ ID NO: 65146
  CDS (1)..(1074): transl_table=11

SEQ ID NO: 95868 - protein, 357 aa, Bacteroides thetaiotaomicron VPI-5482; identical to SEQ ID NO: 65147

SEQ ID NO: 95869 - DNA, 1065 bp, Bacteroides thetaiotaomicron VPI-5482; identical to SEQ ID NO: 65148
  CDS (1)..(1065): transl_table=11

SEQ ID NO: 95870 - protein, 354 aa, Bacteroides thetaiotaomicron VPI-5482; identical to SEQ ID NO: 65149

SEQ ID NO: 95871 - DNA, 1062 bp, Bacteroides thetaiotaomicron VPI-5482; identical to SEQ ID NO: 65150
  CDS (1)..(1062): transl_table=11

SEQ ID NO: 95872 - protein, 353 aa, Bacteroides thetaiotaomicron VPI-5482; identical to SEQ ID NO: 65151

SEQ ID NO: 95873 - DNA, 960 bp, Enterococcus faecalis V583; identical to SEQ ID NO: 65152
  CDS (1)..(960): transl_table=11

SEQ ID NO: 95874 - protein, 319 aa, Enterococcus faecalis V583; identical to SEQ ID NO: 65153

SEQ ID NO: 95875 - DNA, 990 bp, Enterococcus faecalis V583; identical to SEQ ID NO: 65154
  CDS (1)..(990): transl_table=11

SEQ ID NO: 95876 - protein, 329 aa, Enterococcus faecalis V583; identical to SEQ ID NO: 65155

SEQ ID NO: 95877 - DNA, 975 bp, Enterococcus faecalis V583; identical to SEQ ID NO: 65156
  CDS (1)..(975): transl_table=11

SEQ ID NO: 95878 - protein, 324 aa, Enterococcus faecalis V583; identical to SEQ ID NO: 65157

SEQ ID NO: 95879 - DNA, 993 bp, Enterococcus faecalis V583; identical to SEQ ID NO: 65158
  CDS (1)..(993): transl_table=11

SEQ ID NO: 95880 - protein, 330 aa, Enterococcus faecalis V583; identical to SEQ ID NO: 65159

SEQ ID NO: 95881 - DNA, 1035 bp, Coxiella burnetii RSA 493; identical to SEQ ID NO: 65160
  CDS (1)..(1035): transl_table=11

SEQ ID NO: 95882 - protein, 344 aa, Coxiella burnetii RSA 493; identical to SEQ ID NO: 65161

SEQ ID NO: 95883 - DNA, 993 bp, Coxiella burnetii RSA 493; identical to SEQ ID NO: 65162
  CDS (1)..(993): transl_table=11

SEQ ID NO: 95884 - protein, 330 aa, Coxiella burnetii RSA 493; identical to SEQ ID NO: 65163

SEQ ID NO: 95885 - DNA, 1005 bp, Coxiella burnetii RSA 493; identical to SEQ ID NO: 65164
  CDS (1)..(1005): transl_table=11

SEQ ID NO: 95886 - protein, 334 aa, Coxiella burnetii RSA 493; identical to SEQ ID NO: 65165

SEQ ID NO: 95887 - DNA, 960 bp, Streptomyces avermitilis MA-4680; identical to SEQ ID NO: 65166
  CDS (1)..(960)

SEQ ID NO: 95888 - protein, 319 aa, Streptomyces avermitilis MA-4680; identical to SEQ ID NO: 65167

SEQ ID NO: 95889 - DNA, 1002 bp, Streptomyces avermitilis MA-4680; identical to SEQ ID NO: 65168
  CDS (1)..(1002)

SEQ ID NO: 95890 - protein, 333 aa, Streptomyces avermitilis MA-4680; identical to SEQ ID NO: 65169

SEQ ID NO: 95891 - DNA, 981 bp, Streptomyces avermitilis MA-4680; identical to SEQ ID NO: 65170
  CDS (1)..(981)

SEQ ID NO: 95892 - protein, 326 aa, Streptomyces avermitilis MA-4680; identical to SEQ ID NO: 65171

SEQ ID NO: 95893 - DNA, 966 bp, Bacillus cereus ATCC 14579; identical to SEQ ID NO: 65172
  CDS (1)..(966): transl_table=11

SEQ ID NO: 95894 - protein, 321 aa, Bacillus cereus ATCC 14579; identical to SEQ ID NO: 65173

SEQ ID NO: 95895 - DNA, 906 bp, Bacillus cereus ATCC 14579; identical to SEQ ID NO: 65174
  CDS (1)..(906): transl_table=11

SEQ ID NO: 95896 - protein, 301 aa, Bacillus cereus ATCC 14579; identical to SEQ ID NO: 65175

SEQ ID NO: 95897 - DNA, 1008 bp, Nitrosomonas europaea ATCC 19718; identical to SEQ ID NO: 65176
  CDS (1)..(1008): transl_table=11

SEQ ID NO: 95898 - protein, 335 aa, Nitrosomonas europaea ATCC 19718; identical to SEQ ID NO: 65177

SEQ ID NO: 95899 - DNA, 1038 bp, Helicobacter hepaticus ATCC 51449; identical to SEQ ID NO: 65178
  CDS (1)..(1038): transl_table=11

SEQ ID NO: 95900 - protein, 345 aa, Helicobacter hepaticus ATCC 51449; identical to SEQ ID NO: 65179

SEQ ID NO: 95901 - DNA, 939 bp, Helicobacter hepaticus ATCC 51449; identical to SEQ ID NO: 65180
  CDS (1)..(939): transl_table=11

SEQ ID NO: 95902 - protein, 312 aa, Helicobacter hepaticus ATCC 51449; identical to SEQ ID NO: 65181

SEQ ID NO: 95903 - DNA, 1008 bp, Helicobacter hepaticus ATCC 51449; identical to SEQ ID NO: 65182
  CDS (1)..(1008): transl_table=11

SEQ ID NO: 95904 - protein, 335 aa, Helicobacter hepaticus ATCC 51449; identical to SEQ ID NO: 65183

SEQ ID NO: 95905 - DNA, 1149 bp, Ruegeria sp. PR1b; identical to SEQ ID NO: 65184
  CDS (1)..(1149): transl_table=11

SEQ ID NO: 95906 - protein, 382 aa, Ruegeria sp. PR1b; identical to SEQ ID NO: 65185

SEQ ID NO: 95907 - DNA, 1116 bp, Rhodopirellula baltica SH 1; identical to SEQ ID NO: 65186
  CDS (1)..(1116): transl_table=11

SEQ ID NO: 95908 - protein, 371 aa, Rhodopirellula baltica SH 1; identical to SEQ ID NO: 65187

SEQ ID NO: 95909 - DNA, 1218 bp, Rhodopirellula baltica SH 1; identical to SEQ ID NO: 65188
  CDS (1)..(1218): transl_table=11

SEQ ID NO: 95910 - protein, 405 aa, Rhodopirellula baltica SH 1; identical to SEQ ID NO: 65189

SEQ ID NO: 95911 - DNA, 1026 bp, Prochlorococcus marinus subsp. marinus str. CCMP1375; identical to SEQ ID NO: 65190
  CDS (1)..(1026): transl_table=11

SEQ ID NO: 95912 - protein, 341 aa, Prochlorococcus marinus subsp. marinus str. CCMP1375; identical to SEQ ID NO: 65191

SEQ ID NO: 95913 - DNA, 936 bp, Candidatus Blochmannia floridanus; identical to SEQ ID NO: 65192
  CDS (1)..(936): transl_table=11

SEQ ID NO: 95914 - protein, 311 aa, Candidatus Blochmannia floridanus; identical to SEQ ID NO: 65193

SEQ ID NO: 95915 - DNA, 978 bp, Bordetella bronchiseptica RB50; identical to SEQ ID NO: 65194
  CDS (1)..(978): transl_table=11

SEQ ID NO: 95916 - protein, 325 aa, Bordetella bronchiseptica RB50; identical to SEQ ID NO: 65195

SEQ ID NO: 95917 - DNA, 1023 bp, Prochlorococcus marinus str. MIT 9313; identical to SEQ ID NO: 65196
  CDS (1)..(1023): transl_table=11

SEQ ID NO: 95918 - protein, 340 aa, Prochlorococcus marinus str. MIT 9313; identical to SEQ ID NO: 65197

SEQ ID NO: 95919 - DNA, 972 bp, Chromobacterium violaceum ATCC 12472; identical to SEQ ID NO: 65198
  CDS (1)..(972): transl_table=11

SEQ ID NO: 95920 - protein, 323 aa, Chromobacterium violaceum ATCC 12472; identical to SEQ ID NO: 65199

SEQ ID NO: 95921 - DNA, 1002 bp, Wolinella succinogenes DSM 1740; identical to SEQ ID NO: 65200
  CDS (1)..(1002): transl_table=11

SEQ ID NO: 95922 - protein, 333 aa, Wolinella succinogenes DSM 1740; identical to SEQ ID NO: 65201

SEQ ID NO: 95923 - DNA, 1005 bp, Gloeobacter violaceus PCC 7421; identical to SEQ ID NO: 65202
  CDS (1)..(1005): transl_table=11

SEQ ID NO: 95924 - protein, 334 aa, Gloeobacter violaceus PCC 7421; identical to SEQ ID NO: 65203

SEQ ID NO: 95925 - DNA, 1011 bp, Vibrio vulnificus YJ016; identical to SEQ ID NO: 65204
  CDS (1)..(1011): transl_table=11

SEQ ID NO: 95926 - protein, 336 aa, Vibrio vulnificus YJ016; identical to SEQ ID NO: 65205

SEQ ID NO: 95927 - DNA, 981 bp, Rhodopseudomonas palustris CGA009; identical to SEQ ID NO: 65206
  CDS (1)..(981): transl_table=11

SEQ ID NO: 95928 - protein, 326 aa, Rhodopseudomonas palustris CGA009; identical to SEQ ID NO: 65207

SEQ ID NO: 95929 - DNA, 1014 bp, Rhodopseudomonas palustris CGA009; identical to SEQ ID NO: 65208
  CDS (1)..(1014): transl_table=11

SEQ ID NO: 95930 - protein, 337 aa, Rhodopseudomonas palustris CGA009; identical to SEQ ID NO: 65209

SEQ ID NO: 95931 - DNA, 984 bp, Rhodopseudomonas palustris CGA009; identical to SEQ ID NO: 65210
  CDS (1)..(984): transl_table=11

SEQ ID NO: 95932 - protein, 327 aa, Rhodopseudomonas palustris CGA009; identical to SEQ ID NO: 65211

SEQ ID NO: 95933 - DNA, 981 bp, Geobacter sulfurreducens PCA; identical to SEQ ID NO: 65212
  CDS (1)..(981): transl_table=11

SEQ ID NO: 95934 - protein, 326 aa, Geobacter sulfurreducens PCA; identical to SEQ ID NO: 65213

SEQ ID NO: 95935 - DNA, 825 bp, Danio rerio; identical to SEQ ID NO: 65214
  CDS (1)..(825)

SEQ ID NO: 95936 - protein, 274 aa, Danio rerio; identical to SEQ ID NO: 65215

SEQ ID NO: 95937 - DNA, 993 bp, Lactobacillus johnsonii NCC 533; identical to SEQ ID NO: 65216
  CDS (1)..(993): transl_table=11

SEQ ID NO: 95938 - protein, 330 aa, Lactobacillus johnsonii NCC 533; identical to SEQ ID NO: 65217

SEQ ID NO: 95939 - DNA, 969 bp, Bdellovibrio bacteriovorus HD100; identical to SEQ ID NO: 65218
  CDS (1)..(969): transl_table=11

SEQ ID NO: 95940 - protein, 322 aa, Bdellovibrio bacteriovorus HD100; identical to SEQ ID NO: 65219

SEQ ID NO: 95941 - DNA, 1020 bp, Treponema denticola ATCC 35405; identical to SEQ ID NO: 65220
  CDS (1)..(1020): transl_table=11

SEQ ID NO: 95942 - protein, 339 aa, Treponema denticola ATCC 35405; identical to SEQ ID NO: 65221

SEQ ID NO: 95943 - DNA, 966 bp, Bacillus cereus ATCC 10987; identical to SEQ ID NO: 65222
  CDS (1)..(966): transl_table=11

SEQ ID NO: 95944 - protein, 321 aa, Bacillus cereus ATCC 10987; identical to SEQ ID NO: 65223

SEQ ID NO: 95945 - DNA, 993 bp, Bacillus cereus ATCC 10987; identical to SEQ ID NO: 65224
  CDS (1)..(993): transl_table=11

SEQ ID NO: 95946 - protein, 330 aa, Bacillus cereus ATCC 10987; identical to SEQ ID NO: 65225

SEQ ID NO: 95947 - DNA, 1026 bp, Bacillus cereus ATCC 10987; identical to SEQ ID NO: 65226
  CDS (1)..(1026): transl_table=11

SEQ ID NO: 95948 - protein, 341 aa, Bacillus cereus ATCC 10987; identical to SEQ ID NO: 65227

SEQ ID NO: 95949 - DNA, 921 bp, Methanococcus maripaludis S2; identical to SEQ ID NO: 65228
  CDS (1)..(921): transl_table=11

SEQ ID NO: 95950 - protein, 306 aa, Methanococcus maripaludis S2; identical to SEQ ID NO: 65229

SEQ ID NO: 95951 - DNA, 942 bp, Yersinia pestis biovar Medievalis str. 91001; identical to SEQ ID NO: 65230
  CDS (1)..(942): transl_table=11

SEQ ID NO: 95952 - protein, 313 aa, Yersinia pestis biovar Medievalis str. 91001; identical to SEQ ID NO: 65231

SEQ ID NO: 95953 - DNA, 999 bp, Gibberella zeae PH-1; identical to SEQ ID NO: 65232
  CDS (1)..(999)

SEQ ID NO: 95954 - protein, 332 aa, Gibberella zeae PH-1; identical to SEQ ID NO: 65233

SEQ ID NO: 95955 - DNA, 1065 bp, Oryza sativa (japonica cultivar-group); identical to SEQ ID NO: 65234
  CDS (1)..(1065)

SEQ ID NO: 95956 - protein, 354 aa, Oryza sativa (japonica cultivar-group); identical to SEQ ID NO: 65235

SEQ ID NO: 95957 - DNA, 990 bp, Leptospira interrogans serovar Copenhageni str. Fiocruz L1-130; identical to SEQ ID NO: 65236
  CDS (1)..(990): transl_table=11

SEQ ID NO: 95958 - protein, 329 aa, Leptospira interrogans serovar Copenhageni str. Fiocruz L1-130; identical to SEQ ID NO: 65237

SEQ ID NO: 95959 - DNA, 930 bp, Thermus thermophilus HB27; identical to SEQ ID NO: 65238
  CDS (1)..(930): transl_table=11

SEQ ID NO: 95960 - protein, 309 aa, Thermus thermophilus HB27; identical to SEQ ID NO: 65239

SEQ ID NO: 95961 - DNA, 987 bp, Parachlamydia sp. UWE25; identical to SEQ ID NO: 65240
  CDS (1)..(987): transl_table=11

SEQ ID NO: 95962 - protein, 328 aa, Parachlamydia sp. UWE25; identical to SEQ ID NO: 65241

SEQ ID NO: 95963 - DNA, 1026 bp, Desulfovibrio vulgaris subsp. vulgaris str. Hildenborough; identical to SEQ ID NO: 65242
  CDS (1)..(1026): transl_table=11

SEQ ID NO: 95964 - protein, 341 aa, Desulfovibrio vulgaris subsp. vulgaris str. Hildenborough; identical to SEQ ID NO: 65243

SEQ ID NO: 95965 - DNA, 996 bp, Desulfovibrio vulgaris subsp. vulgaris str. Hildenborough; identical to SEQ ID NO: 65244
  CDS (1)..(996): transl_table=11

SEQ ID NO: 95966 - protein, 331 aa, Desulfovibrio vulgaris subsp. vulgaris str. Hildenborough; identical to SEQ ID NO: 65245

SEQ ID NO: 95967 - DNA, 984 bp, Listeria monocytogenes str. 4b F2365; identical to SEQ ID NO: 65246
  CDS (1)..(984): transl_table=11

SEQ ID NO: 95968 - protein, 327 aa, Listeria monocytogenes str. 4b F2365; identical to SEQ ID NO: 65247

SEQ ID NO: 95969 - DNA, 993 bp, Mycoplasma mobile 163K; identical to SEQ ID NO: 65248
  CDS (1)..(993): transl_table=4

SEQ ID NO: 95970 - protein, 330 aa, Mycoplasma mobile 163K; identical to SEQ ID NO: 65249

SEQ ID NO: 95971 - DNA, 930 bp, Picrophilus torridus DSM 9790; identical to SEQ ID NO: 65250
  CDS (1)..(930): transl_table=11

SEQ ID NO: 95972 - protein, 309 aa, Picrophilus torridus DSM 9790; identical to SEQ ID NO: 65251

SEQ ID NO: 95973 - DNA, 966 bp, Bacillus thuringiensis serovar konkukian str. 97-27; identical to SEQ ID NO: 65252
  CDS (1)..(966): transl_table=11

SEQ ID NO: 95974 - protein, 321 aa, Bacillus thuringiensis serovar konkukian str. 97-27; identical to SEQ ID NO: 65253

SEQ ID NO: 95975 - DNA, 972 bp, Staphylococcus aureus subsp. aureus MRSA252; identical to SEQ ID NO: 65254
  CDS (1)..(972): transl_table=11

SEQ ID NO: 95976 - protein, 323 aa, Staphylococcus aureus subsp. aureus MRSA252; identical to SEQ ID NO: 65255

SEQ ID NO: 95977 - DNA, 933 bp, Erwinia carotovora subsp. atroseptica SCRI1043; identical to SEQ ID NO: 65256
  CDS (1)..(933)

SEQ ID NO: 95978 - protein, 310 aa, Erwinia carotovora subsp. atroseptica SCRI1043; identical to SEQ ID NO: 65257

SEQ ID NO: 95979 - DNA, 1038 bp, Desulfotalea psychrophila LSv54; identical to SEQ ID NO: 65258
  CDS (1)..(1038): transl_table=11

SEQ ID NO: 95980 - protein, 345 aa, Desulfotalea psychrophila LSv54; identical to SEQ ID NO: 65259

SEQ ID NO: 95981 - DNA, 879 bp, Symbiobacterium thermophilum IAM 14863; identical to SEQ ID NO: 65260
  CDS (1)..(879): transl_table=11

SEQ ID NO: 95982 - protein, 292 aa, Symbiobacterium thermophilum IAM 14863; identical to SEQ ID NO: 65261

SEQ ID NO: 95983 - DNA, 987 bp, Symbiobacterium thermophilum IAM 14863; identical to SEQ ID NO: 65262
  CDS (1)..(987): transl_table=11

SEQ ID NO: 95984 - protein, 328 aa, Symbiobacterium thermophilum IAM 14863; identical to SEQ ID NO: 65263

SEQ ID NO: 95985 - DNA, 966 bp, Symbiobacterium thermophilum IAM 14863; identical to SEQ ID NO: 65264
  CDS (1)..(966): transl_table=11

SEQ ID NO: 95986 - protein, 321 aa, Symbiobacterium thermophilum IAM 14863; identical to SEQ ID NO: 65265

SEQ ID NO: 95987 - DNA, 966 bp, Bacillus cereus ZK; identical to SEQ ID NO: 65266
  CDS (1)..(966): transl_table=11

SEQ ID NO: 95988 - protein, 321 aa, Bacillus cereus ZK; identical to SEQ ID NO: 65267

SEQ ID NO: 95989 - DNA, 927 bp, Mannheimia succiniciproducens MBEL55E; identical to SEQ ID NO: 65268
  CDS (1)..(927): transl_table=11

SEQ ID NO: 95990 - protein, 308 aa, Mannheimia succiniciproducens MBEL55E; identical to SEQ ID NO: 65269

SEQ ID NO: 95991 - DNA, 987 bp, Bacillus licheniformis ATCC 14580; identical to SEQ ID NO: 65270
  CDS (1)..(987): transl_table=11

SEQ ID NO: 95992 - protein, 328 aa, Bacillus licheniformis ATCC 14580; identical to SEQ ID NO: 65271

SEQ ID NO: 95993 - DNA, 930 bp, Bacillus licheniformis ATCC 14580; identical to SEQ ID NO: 65272
  CDS (1)..(930): transl_table=11

SEQ ID NO: 95994 - protein, 309 aa, Bacillus licheniformis ATCC 14580; identical to SEQ ID NO: 65273

SEQ ID NO: 95995 - DNA, 990 bp, Bacillus licheniformis ATCC 14580; identical to SEQ ID NO: 65274
  CDS (1)..(990): transl_table=11

SEQ ID NO: 95996 - protein, 329 aa, Bacillus licheniformis ATCC 14580; identical to SEQ ID NO: 65275

SEQ ID NO: 95997 - DNA, 993 bp, Burkholderia mallei ATCC 23344; identical to SEQ ID NO: 65276
  CDS (1)..(993): transl_table=11

SEQ ID NO: 95998 - protein, 330 aa, Burkholderia mallei ATCC 23344; identical to SEQ ID NO: 65277

SEQ ID NO: 95999 - DNA, 1011 bp, Methylococcus capsulatus str. Bath; identical to SEQ ID NO: 65278
  CDS (1)..(1011): transl_table=11

SEQ ID NO: 96000 - protein, 336 aa, Methylococcus capsulatus str. Bath; identical to SEQ ID NO: 65279

SEQ ID NO: 96001 - DNA, 1026 bp, Methylococcus capsulatus str. Bath; identical to SEQ ID NO: 65280
  CDS (1)..(1026): transl_table=11

SEQ ID NO: 96002 - protein, 341 aa, Methylococcus capsulatus str. Bath; identical to SEQ ID NO: 65281

SEQ ID NO: 96003 - DNA, 1005 bp, Photobacterium profundum SS9; identical to SEQ ID NO: 65282
  CDS (1)..(1005): transl_table=11

SEQ ID NO: 96004 - protein, 334 aa, Photobacterium profundum SS9; identical to SEQ ID NO: 65283

SEQ ID NO: 96005 - DNA, 945 bp, Photobacterium profundum SS9; identical to SEQ ID NO: 65284
  CDS (1)..(945): transl_table=11

SEQ ID NO: 96006 - protein, 314 aa, Photobacterium profundum SS9; identical to SEQ ID NO: 65285

SEQ ID NO: 96007 - DNA, 1008 bp, Photobacterium profundum SS9; identical to SEQ ID NO: 65286
  CDS (1)..(1008): transl_table=11

SEQ ID NO: 96008 - protein, 335 aa, Photobacterium profundum SS9; identical to SEQ ID NO: 65287

SEQ ID NO: 96009 - DNA, 930 bp, Haloarcula marismortui ATCC 43049; identical to SEQ ID NO: 65288
  CDS (1)..(930): transl_table=11

SEQ ID NO: 96010 - protein, 309 aa, Haloarcula marismortui ATCC 43049; identical to SEQ ID NO: 65289

SEQ ID NO: 96011 - DNA, 918 bp, Haloarcula marismortui ATCC 43049; identical to SEQ ID NO: 65290
  CDS (1)..(918): transl_table=11

SEQ ID NO: 96012 - protein, 305 aa, Haloarcula marismortui ATCC 43049; identical to SEQ ID NO: 65291

SEQ ID NO: 96013 - DNA, 927 bp, Haloarcula marismortui ATCC 43049; identical to SEQ ID NO: 65292
  CDS (1)..(927): transl_table=11

SEQ ID NO: 96014 - protein, 308 aa, Haloarcula marismortui ATCC 43049; identical to SEQ ID NO: 65293

SEQ ID NO: 96015 - DNA, 1005 bp, Haloarcula marismortui ATCC 43049; identical to SEQ ID NO: 65294
  CDS (1)..(1005): transl_table=11

SEQ ID NO: 96016 - protein, 334 aa, Haloarcula marismortui ATCC 43049; identical to SEQ ID NO: 65295

SEQ ID NO: 96017 - DNA, 1002 bp, Streptococcus thermophilus LMG 18311; identical to SEQ ID NO: 65296
  CDS (1)..(1002): transl_table=11

SEQ ID NO: 96018 - protein, 333 aa, Streptococcus thermophilus LMG 18311; identical to SEQ ID NO: 65297

SEQ ID NO: 96019 - DNA, 1014 bp, Streptococcus thermophilus CNRZ1066; identical to SEQ ID NO: 65298
  CDS (1)..(1014): transl_table=11

SEQ ID NO: 96020 - protein, 337 aa, Streptococcus thermophilus CNRZ1066; identical to SEQ ID NO: 65299

SEQ ID NO: 96021 - DNA, 1002 bp, Streptococcus thermophilus CNRZ1066; identical to SEQ ID NO: 65300
  CDS (1)..(1002): transl_table=11

SEQ ID NO: 96022 - protein, 333 aa, Streptococcus thermophilus CNRZ1066; identical to SEQ ID NO: 65301

SEQ ID NO: 96023 - DNA, 936 bp, Thermus thermophilus HB8; identical to SEQ ID NO: 65302
  CDS (1)..(936): transl_table=11

SEQ ID NO: 96024 - protein, 311 aa, Thermus thermophilus HB8; identical to SEQ ID NO: 65303

SEQ ID NO: 96025 - DNA, 957 bp, Geobacillus kaustophilus HTA426; identical to SEQ ID NO: 65304
  CDS (1)..(957): transl_table=11

SEQ ID NO: 96026 - protein, 318 aa, Geobacillus kaustophilus HTA426; identical to SEQ ID NO: 65305

SEQ ID NO: 96027 - DNA, 987 bp, Geobacillus kaustophilus HTA426; identical to SEQ ID NO: 65306
  CDS (1)..(987): transl_table=11

SEQ ID NO: 96028 - protein, 328 aa, Geobacillus kaustophilus HTA426; identical to SEQ ID NO: 65307

SEQ ID NO: 96029 - DNA, 972 bp, Geobacillus kaustophilus HTA426; identical to SEQ ID NO: 65308
  CDS (1)..(972): transl_table=11

SEQ ID NO: 96030 - protein, 323 aa, Geobacillus kaustophilus HTA426; identical to SEQ ID NO: 65309

SEQ ID NO: 96031 - DNA, 1008 bp, Azoarcus sp. EbN1; identical to SEQ ID NO: 65310
  CDS (1)..(1008): transl_table=11

SEQ ID NO: 96032 - protein, 335 aa, Azoarcus sp. EbN1; identical to SEQ ID NO: 65311

SEQ ID NO: 96033 - DNA, 960 bp, Azoarcus sp. EbN1; identical to SEQ ID NO: 65312
  CDS (1)..(960): transl_table=11

SEQ ID NO: 96034 - protein, 319 aa, Azoarcus sp. EbN1; identical to SEQ ID NO: 65313

SEQ ID NO: 96035 - DNA, 972 bp, Francisella tularensis subsp. tularensis Schu 4; identical to SEQ ID NO: 65314
  CDS (1)..(972): transl_table=11

SEQ ID NO: 96036 - protein, 323 aa, Francisella tularensis subsp. tularensis Schu 4; identical to SEQ ID NO: 65315

SEQ ID NO: 96037 - DNA, 999 bp, Synechococcus elongatus PCC 6301; identical to SEQ ID NO: 65316
  CDS (1)..(999): transl_table=11

SEQ ID NO: 96038 - protein, 332 aa, Synechococcus elongatus PCC 6301; identical to SEQ ID NO: 65317

SEQ ID NO: 96039 - DNA, 933 bp, Bacillus clausii KSM-K16; identical to SEQ ID NO: 65318
  CDS (1)..(933): transl_table=11

SEQ ID NO: 96040 - protein, 310 aa, Bacillus clausii KSM-K16; identical to SEQ ID NO: 65319

SEQ ID NO: 96041 - DNA, 1017 bp, Bacillus clausii KSM-K16; identical to SEQ ID NO: 65320
  CDS (1)..(1017): transl_table=11

SEQ ID NO: 96042 - protein, 338 aa, Bacillus clausii KSM-K16; identical to SEQ ID NO: 65321

SEQ ID NO: 96043 - DNA, 987 bp, Campylobacter jejuni RM1221; identical to SEQ ID NO: 65322
  CDS (1)..(987): transl_table=11

SEQ ID NO: 96044 - protein, 328 aa, Campylobacter jejuni RM1221; identical to SEQ ID NO: 65323

SEQ ID NO: 96045 - DNA, 939 bp, Dehalococcoides ethenogenes 195; identical to SEQ ID NO: 65324
  CDS (1)..(939): transl_table=11

SEQ ID NO: 96046 - protein, 312 aa, Dehalococcoides ethenogenes 195; identical to SEQ ID NO: 65325

SEQ ID NO: 96047 - DNA, 921 bp, Rhodobacter sphaeroides 2.4.1; identical to SEQ ID NO: 65326
  CDS (1)..(921)

SEQ ID NO: 96048 - protein, 306 aa, Rhodobacter sphaeroides 2.4.1; identical to SEQ ID NO: 65327

SEQ ID NO: 96049 - DNA, 993 bp, Rhodobacter sphaeroides 2.4.1; identical to SEQ ID NO: 65328
  CDS (1)..(993)

SEQ ID NO: 96050 - protein, 330 aa, Rhodobacter sphaeroides 2.4.1; identical to SEQ ID NO: 65329

SEQ ID NO: 96051 - DNA, 987 bp, Rhodobacter sphaeroides 2.4.1; identical to SEQ ID NO: 65330
  CDS (1)..(987)

SEQ ID NO: 96052 - protein, 328 aa, Rhodobacter sphaeroides 2.4.1; identical to SEQ ID NO: 65331

SEQ ID NO: 96053 - DNA, 993 bp, Lactobacillus gasseri; identical to SEQ ID NO: 65332
  CDS (1)..(993)

SEQ ID NO: 96054 - protein, 330 aa, Lactobacillus gasseri; identical to SEQ ID NO: 65333

SEQ ID NO: 96055 - DNA, 981 bp, Magnetospirillum magnetotacticum MS-1; identical to SEQ ID NO: 65334
  CDS (1)..(981)

SEQ ID NO: 96056 - protein, 326 aa, Magnetospirillum magnetotacticum MS-1; identical to SEQ ID NO: 65335

SEQ ID NO: 96057 - DNA, 999 bp, Magnetospirillum magnetotacticum MS-1; identical to SEQ ID NO: 65336
  CDS (1)..(999)

SEQ ID NO: 96058 - protein, 332 aa, Magnetospirillum magnetotacticum MS-1; identical to SEQ ID NO: 65337

SEQ ID NO: 96059 - DNA, 984 bp, Magnetospirillum magnetotacticum MS-1; identical to SEQ ID NO: 65338
  CDS (1)..(984)

SEQ ID NO: 96060 - protein, 327 aa, Magnetospirillum magnetotacticum MS-1; identical to SEQ ID NO: 65339

SEQ ID NO: 96061 - DNA, 900 bp, Magnetospirillum magnetotacticum MS-1; identical to SEQ ID NO: 65340
  CDS (1)..(900)

SEQ ID NO: 96062 - protein, 299 aa, Magnetospirillum magnetotacticum MS-1; identical to SEQ ID NO: 65341

SEQ ID NO: 96063 - DNA, 990 bp, Magnetospirillum magnetotacticum MS-1; identical to SEQ ID NO: 65342
  CDS (1)..(990)

SEQ ID NO: 96064 - protein, 329 aa, Magnetospirillum magnetotacticum MS-1; identical to SEQ ID NO: 65343

SEQ ID NO: 96065 - DNA, 1005 bp, Leuconostoc mesenteroides subsp. mesenteroides ATCC 8293; identical to SEQ ID NO: 65344
  CDS (1)..(1005)

SEQ ID NO: 96066 - protein, 334 aa, Leuconostoc mesenteroides subsp. mesenteroides ATCC 8293; identical to SEQ ID NO: 65345

SEQ ID NO: 96067 - DNA, 993 bp, Leuconostoc mesenteroides subsp. mesenteroides ATCC 8293; identical to SEQ ID NO: 65346
  CDS (1)..(993)

SEQ ID NO: 96068 - protein, 330 aa, Leuconostoc mesenteroides subsp. mesenteroides ATCC 8293; identical to SEQ ID NO: 65347

SEQ ID NO: 96069 - DNA, 948 bp, Nostoc punctiforme PCC 73102; identical to SEQ ID NO: 65348
  CDS (1)..(948)

SEQ ID NO: 96070 - protein, 315 aa, Nostoc punctiforme PCC 73102; identical to SEQ ID NO: 65349

SEQ ID NO: 96071 - DNA, 1017 bp, Nostoc punctiforme PCC 73102; identical to SEQ ID NO: 65350
  CDS (1)..(1017)

SEQ ID NO: 96072 - protein, 338 aa, Nostoc punctiforme PCC 73102; identical to SEQ ID NO: 65351

SEQ ID NO: 96073 - DNA, 999 bp, Nostoc punctiforme PCC 73102; identical to SEQ ID NO: 65352
  CDS (1)..(999)

SEQ ID NO: 96074 - protein, 332 aa, Nostoc punctiforme PCC 73102; identical to SEQ ID NO: 65353

SEQ ID NO: 96075 - DNA, 987 bp, Nostoc punctiforme PCC 73102; identical to SEQ ID NO: 65354
  CDS (1)..(987)

SEQ ID NO: 96076 - protein, 328 aa, Nostoc punctiforme PCC 73102; identical to SEQ ID NO: 65355

SEQ ID NO: 96077 - DNA, 1017 bp, Haemophilus somnus 129PT; identical to SEQ ID NO: 65356
  CDS (1)..(1017)

SEQ ID NO: 96078 - protein, 338 aa, Haemophilus somnus 129PT; identical to SEQ ID NO: 65357

SEQ ID NO: 96079 - DNA, 996 bp, Pseudomonas syringae pv. syringae B728a; identical to SEQ ID NO: 65358
  CDS (1)..(996)

SEQ ID NO: 96080 - protein, 331 aa, Pseudomonas syringae pv. syringae B728a; identical to SEQ ID NO: 65359

SEQ ID NO: 96081 - DNA, 948 bp, Desulfovibrio desulfuricans G20; identical to SEQ ID NO: 65360
  CDS (1)..(948)

SEQ ID NO: 96082 - protein, 315 aa, Desulfovibrio desulfuricans G20; identical to SEQ ID NO: 65361

SEQ ID NO: 96083 - DNA, 984 bp, Desulfovibrio desulfuricans G20; identical to SEQ ID NO: 65362
  CDS (1)..(984)

SEQ ID NO: 96084 - protein, 327 aa, Desulfovibrio desulfuricans G20; identical to SEQ ID NO: 65363

SEQ ID NO: 96085 - DNA, 1017 bp, Haemophilus somnus 2336; identical to SEQ ID NO: 65364
  CDS (1)..(1017)

SEQ ID NO: 96086 - protein, 338 aa, Haemophilus somnus 2336; identical to SEQ ID NO: 65365

SEQ ID NO: 96087 - DNA, 927 bp, Actinobacillus pleuropneumoniae serovar 1 str. 4074; identical to SEQ ID NO: 65366
  CDS (1)..(927)

SEQ ID NO: 96088 - protein, 308 aa, Actinobacillus pleuropneumoniae serovar 1 str. 4074; identical to SEQ ID NO: 65367

SEQ ID NO: 96089 - DNA, 993 bp, Pseudomonas aeruginosa UCBPP-PA14; identical to SEQ ID NO: 65368
  CDS (1)..(993)

SEQ ID NO: 96090 - protein, 330 aa, Pseudomonas aeruginosa UCBPP-PA14; identical to SEQ ID NO: 65369

SEQ ID NO: 96091 - DNA, 1035 bp, Psychrobacter sp. 273-4; identical to SEQ ID NO: 65370
  CDS (1)..(1035)

SEQ ID NO: 96092 - protein, 344 aa, Psychrobacter sp. 273-4; identical to SEQ ID NO: 65371

SEQ ID NO: 96093 - DNA, 900 bp, Methanococcoides burtonii DSM 6242; identical to SEQ ID NO: 65372
  CDS (1)..(900)

SEQ ID NO: 96094 - protein, 299 aa, Methanococcoides burtonii DSM 6242; identical to SEQ ID NO: 65373

SEQ ID NO: 96095 - DNA, 999 bp, Dechloromonas aromatica RCB; identical to SEQ ID NO: 65374
  CDS (1)..(999)

SEQ ID NO: 96096 - protein, 332 aa, Dechloromonas aromatica RCB; identical to SEQ ID NO: 65375

SEQ ID NO: 96097 - DNA, 999 bp, Anabaena variabilis ATCC 29413; identical to SEQ ID NO: 65376
  CDS (1)..(999)

SEQ ID NO: 96098 - protein, 332 aa, Anabaena variabilis ATCC 29413; identical to SEQ ID NO: 65377

SEQ ID NO: 96099 - DNA, 951 bp, Anabaena variabilis ATCC 29413; identical to SEQ ID NO: 65378
  CDS (1)..(951)

SEQ ID NO: 96100 - protein, 316 aa, Anabaena variabilis ATCC 29413; identical to SEQ ID NO: 65379

SEQ ID NO: 96101 - DNA, 1089 bp, Ralstonia eutropha JMP134; identical to SEQ ID NO: 65380
  CDS (1)..(1089)

SEQ ID NO: 96102 - protein, 362 aa, Ralstonia eutropha JMP134; identical to SEQ ID NO: 65381

SEQ ID NO: 96103 - DNA, 996 bp, Ralstonia eutropha JMP134; identical to SEQ ID NO: 65382
  CDS (1)..(996)

SEQ ID NO: 96104 - protein, 331 aa, Ralstonia eutropha JMP134; identical to SEQ ID NO: 65383

SEQ ID NO: 96105 - DNA, 981 bp, Methylobacillus flagellatus KT; identical to SEQ ID NO: 65384
  CDS (1)..(981)

SEQ ID NO: 96106 - protein, 326 aa, Methylobacillus flagellatus KT; identical to SEQ ID NO: 65385

SEQ ID NO: 96107 - DNA, 981 bp, Crocosphaera watsonii WH 8501; identical to SEQ ID NO: 65386
  CDS (1)..(981)

SEQ ID NO: 96108 - protein, 326 aa, Crocosphaera watsonii WH 8501; identical to SEQ ID NO: 65387

SEQ ID NO: 96109 - DNA, 1005 bp, Crocosphaera watsonii WH 8501; identical to SEQ ID NO: 65388
  CDS (1)..(1005)

SEQ ID NO: 96110 - protein, 334 aa, Crocosphaera watsonii WH 8501; identical to SEQ ID NO: 65389

SEQ ID NO: 96111 - DNA, 921 bp, Exiguobacterium sp. 255-15; identical to SEQ ID NO: 65390
  CDS (1)..(921)

SEQ ID NO: 96112 - protein, 306 aa, Exiguobacterium sp. 255-15; identical to SEQ ID NO: 65391

SEQ ID NO: 96113 - DNA, 999 bp, Exiguobacterium sp. 255-15; identical to SEQ ID NO: 65392
  CDS (1)..(999)

SEQ ID NO: 96114 - protein, 332 aa, Exiguobacterium sp. 255-15; identical to SEQ ID NO: 65393

SEQ ID NO: 96115 - DNA, 921 bp, Rubrobacter xylanophilus DSM 9941; identical to SEQ ID NO: 65394
  CDS (1)..(921)

SEQ ID NO: 96116 - protein, 306 aa, Rubrobacter xylanophilus DSM 9941; identical to SEQ ID NO: 65395

SEQ ID NO: 96117 - DNA, 990 bp, Mesorhizobium sp. BNC1; identical to SEQ ID NO: 65396
  CDS (1)..(990)

SEQ ID NO: 96118 - protein, 329 aa, Mesorhizobium sp. BNC1; identical to SEQ ID NO: 65397

SEQ ID NO: 96119 - DNA, 903 bp, Rubrobacter xylanophilus DSM 9941; identical to SEQ ID NO: 65398
  CDS (1)..(903)

SEQ ID NO: 96120 - protein, 300 aa, Rubrobacter xylanophilus DSM 9941; identical to SEQ ID NO: 65399

SEQ ID NO: 96121 - DNA, 990 bp, Crocosphaera watsonii WH 8501; identical to SEQ ID NO: 65400
  CDS (1)..(990)

SEQ ID NO: 96122 - protein, 329 aa, Crocosphaera watsonii WH 8501; identical to SEQ ID NO: 65401

SEQ ID NO: 96123 - DNA, 1032 bp, Psychrobacter sp. 273-4; identical to SEQ ID NO: 65402
  CDS (1)..(1032)

SEQ ID NO: 96124 - protein, 343 aa, Psychrobacter sp. 273-4; identical to SEQ ID NO: 65403

SEQ ID NO: 96125 - DNA, 891 bp, Methanococcoides burtonii DSM 6242; identical to SEQ ID NO: 65404
  CDS (1)..(891)

SEQ ID NO: 96126 - protein, 296 aa, Methanococcoides burtonii DSM 6242; identical to SEQ ID NO: 65405

SEQ ID NO: 96127 - DNA, 930 bp, Pseudomonas aeruginosa UCBPP-PA14; identical to SEQ ID NO: 65406
  CDS (1)..(930)

SEQ ID NO: 96128 - protein, 309 aa, Pseudomonas aeruginosa UCBPP-PA14; identical to SEQ ID NO: 65407

SEQ ID NO: 96129 - DNA, 930 bp, Pseudomonas syringae pv. syringae B728a; identical to SEQ ID NO: 65408
  CDS (1)..(930)

SEQ ID NO: 96130 - protein, 309 aa, Pseudomonas syringae pv. syringae B728a; identical to SEQ ID NO: 65409

SEQ ID NO: 96131 - DNA, 1005 bp, Magnetospirillum magnetotacticum MS-1; identical to SEQ ID NO: 65410
  CDS (1)..(1005)

SEQ ID NO: 96132 - protein, 334 aa, Magnetospirillum magnetotacticum MS-1; identical to SEQ ID NO: 65411

SEQ ID NO: 96133 - DNA, 990 bp, Burkholderia cepacia R18194; identical to SEQ ID NO: 65412
  CDS (1)..(990)

SEQ ID NO: 96134 - protein, 329 aa, Burkholderia cepacia R18194; identical to SEQ ID NO: 65413

SEQ ID NO: 96135 - DNA, 966 bp, Bacillus cereus G9241; identical to SEQ ID NO: 65414
  CDS (1)..(966): transl_table=11

SEQ ID NO: 96136 - protein, 321 aa, Bacillus cereus G9241; identical to SEQ ID NO: 65415

SEQ ID NO: 96137 - DNA, 1011 bp, Pseudomonas fluorescens PfO-1; identical to SEQ ID NO: 65416
  CDS (1)..(1011)

SEQ ID NO: 96138 - protein, 336 aa, Pseudomonas fluorescens PfO-1; identical to SEQ ID NO: 65417

SEQ ID NO: 96139 - DNA, 1056 bp, Pseudomonas fluorescens PfO-1; identical to SEQ ID NO: 65418
  CDS (1)..(1056)

SEQ ID NO: 96140 - protein, 351 aa, Pseudomonas fluorescens PfO-1; identical to SEQ ID NO: 65419

SEQ ID NO: 96141 - DNA, 993 bp, Rhodospirillum rubrum; identical to SEQ ID NO: 65420
  CDS (1)..(993)

SEQ ID NO: 96142 - protein, 330 aa, Rhodospirillum rubrum; identical to SEQ ID NO: 65421

SEQ ID NO: 96143 - DNA, 984 bp, Rhodospirillum rubrum; identical to SEQ ID NO: 65422
  CDS (1)..(984)

SEQ ID NO: 96144 - protein, 327 aa, Rhodospirillum rubrum; identical to SEQ ID NO: 65423

SEQ ID NO: 96145 - DNA, 996 bp, Ralstonia metallidurans CH34; identical to SEQ ID NO: 65424
  CDS (1)..(996)

SEQ ID NO: 96146 - protein, 331 aa, Ralstonia metallidurans CH34; identical to SEQ ID NO: 65425

SEQ ID NO: 96147 - DNA, 993 bp, Burkholderia fungorum LB400; identical to SEQ ID NO: 65426
  CDS (1)..(993)

SEQ ID NO: 96148 - protein, 330 aa, Burkholderia fungorum LB400; identical to SEQ ID NO: 65427

SEQ ID NO: 96149 - DNA, 948 bp, Enterococcus faecium; identical to SEQ ID NO: 65428
  CDS (1)..(948)

SEQ ID NO: 96150 - protein, 315 aa, Enterococcus faecium; identical to SEQ ID NO: 65429

SEQ ID NO: 96151 - DNA, 990 bp, Enterococcus faecium; identical to SEQ ID NO: 65430
  CDS (1)..(990)

SEQ ID NO: 96152 - protein, 329 aa, Enterococcus faecium; identical to SEQ ID NO: 65431

SEQ ID NO: 96153 - DNA, 1008 bp, Magnetococcus sp. MC-1; identical to SEQ ID NO: 65432
  CDS (1)..(1008)

SEQ ID NO: 96154 - protein, 335 aa, Magnetococcus sp. MC-1; identical to SEQ ID NO: 65433

SEQ ID NO: 96155 - DNA, 957 bp, Magnetococcus sp. MC-1; identical to SEQ ID NO: 65434
  CDS (1)..(957)

SEQ ID NO: 96156 - protein, 318 aa, Magnetococcus sp. MC-1; identical to SEQ ID NO: 65435

SEQ ID NO: 96157 - DNA, 933 bp, Magnetococcus sp. MC-1; identical to SEQ ID NO: 65436
  CDS (1)..(933)

SEQ ID NO: 96158 - protein, 310 aa, Magnetococcus sp. MC-1; identical to SEQ ID NO: 65437

SEQ ID NO: 96159 - DNA, 1080 bp, Magnetococcus sp. MC-1; identical to SEQ ID NO: 65438
  CDS (1)..(1080)

SEQ ID NO: 96160 - protein, 359 aa, Magnetococcus sp. MC-1; identical to SEQ ID NO: 65439

SEQ ID NO: 96161 - DNA, 990 bp, Magnetococcus sp. MC-1; identical to SEQ ID NO: 65440
  CDS (1)..(990)

SEQ ID NO: 96162 - protein, 329 aa, Magnetococcus sp. MC-1; identical to SEQ ID NO: 65441

SEQ ID NO: 96163 - DNA, 927 bp, Methanosarcina barkeri str. fusaro; identical to SEQ ID NO: 65442
  CDS (1)..(927)

SEQ ID NO: 96164 - protein, 308 aa, Methanosarcina barkeri str. fusaro; identical to SEQ ID NO: 65443

SEQ ID NO: 96165 - DNA, 951 bp, Methanosarcina barkeri str. fusaro; identical to SEQ ID NO: 65444
  CDS (1)..(951)

SEQ ID NO: 96166 - protein, 316 aa, Methanosarcina barkeri str. fusaro; identical to SEQ ID NO: 65445

SEQ ID NO: 96167 - DNA, 897 bp, Methanosarcina barkeri str. fusaro; identical to SEQ ID NO: 65446
  CDS (1)..(897)

SEQ ID NO: 96168 - protein, 298 aa, Methanosarcina barkeri str. fusaro; identical to SEQ ID NO: 65447

SEQ ID NO: 96169 - DNA, 975 bp, Methanosarcina barkeri str. fusaro; identical to SEQ ID NO: 65448
  CDS (1)..(975)

SEQ ID NO: 96170 - protein, 324 aa, Methanosarcina barkeri str. fusaro; identical to SEQ ID NO: 65449

SEQ ID NO: 96171 - DNA, 993 bp, Geobacter metallireducens GS-15; identical to SEQ ID NO: 65450
  CDS (1)..(993)

SEQ ID NO: 96172 - protein, 330 aa, Geobacter metallireducens GS-15; identical to SEQ ID NO: 65451

SEQ ID NO: 96173 - DNA, 981 bp, Geobacter metallireducens GS-15; identical to SEQ ID NO: 65452
  CDS (1)..(981)

SEQ ID NO: 96174 - protein, 326 aa, Geobacter metallireducens GS-15; identical to SEQ ID NO: 65453

SEQ ID NO: 96175 - DNA, 1065 bp, Novosphingobium aromaticivorans DSM 12444; identical to SEQ ID NO: 65454
  CDS (1)..(1065)

SEQ ID NO: 96176 - protein, 354 aa, Novosphingobium aromaticivorans DSM 12444; identical to SEQ ID NO: 65455

SEQ ID NO: 96177 - DNA, 1002 bp, Novosphingobium aromaticivorans DSM 12444; identical to SEQ ID NO: 65456
  CDS (1)..(1002)

SEQ ID NO: 96178 - protein, 333 aa, Novosphingobium aromaticivorans DSM 12444; identical to SEQ ID NO: 65457

SEQ ID NO: 96179 - DNA, 921 bp, Ferroplasma acidarmanus; identical to SEQ ID NO: 65458
  CDS (1)..(921)

SEQ ID NO: 96180 - protein, 306 aa, Ferroplasma acidarmanus; identical to SEQ ID NO: 65459

SEQ ID NO: 96181 - DNA, 957 bp, Ferroplasma acidarmanus; identical to SEQ ID NO: 65460
  CDS (1)..(957)

SEQ ID NO: 96182 - protein, 318 aa, Ferroplasma acidarmanus; identical to SEQ ID NO: 65461

SEQ ID NO: 96183 - DNA, 945 bp, Cytophaga hutchinsonii; identical to SEQ ID NO: 65462
  CDS (1)..(945)

SEQ ID NO: 96184 - protein, 314 aa, Cytophaga hutchinsonii; identical to SEQ ID NO: 65463

SEQ ID NO: 96185 - DNA, 963 bp, Cytophaga hutchinsonii; identical to SEQ ID NO: 65464
  CDS (1)..(963)

SEQ ID NO: 96186 - protein, 320 aa, Cytophaga hutchinsonii; identical to SEQ ID NO: 65465

SEQ ID NO: 96187 - DNA, 960 bp, Cytophaga hutchinsonii; identical to SEQ ID NO: 65466
  CDS (1)..(960)

SEQ ID NO: 96188 - protein, 319 aa, Cytophaga hutchinsonii; identical to SEQ ID NO: 65467

SEQ ID NO: 96189 - DNA, 1002 bp, Cytophaga hutchinsonii; identical to SEQ ID NO: 65468
  CDS (1)..(1002)

SEQ ID NO: 96190 - protein, 333 aa, Cytophaga hutchinsonii; identical to SEQ ID NO: 65469

SEQ ID NO: 96191 - DNA, 1044 bp, Clostridium thermocellum ATCC 27405; identical to SEQ ID NO: 65470
  CDS (1)..(1044)

SEQ ID NO: 96192 - protein, 347 aa, Clostridium thermocellum ATCC 27405; identical to SEQ ID NO: 65471

SEQ ID NO: 96193 - DNA, 1065 bp, Clostridium thermocellum ATCC 27405; identical to SEQ ID NO: 65472
  CDS (1)..(1065)

SEQ ID NO: 96194 - protein, 354 aa, Clostridium thermocellum ATCC 27405; identical to SEQ ID NO: 65473

SEQ ID NO: 96195 - DNA, 1020 bp, Microbulbifer degradans 2-40; identical to SEQ ID NO: 65474
  CDS (1)..(1020)

SEQ ID NO: 96196 - protein, 339 aa, Microbulbifer degradans 2-40; identical to SEQ ID NO: 65475

SEQ ID NO: 96197 - DNA, 1008 bp, Microbulbifer degradans 2-40; identical to SEQ ID NO: 65476
  CDS (1)..(1008)

SEQ ID NO: 96198 - protein, 335 aa, Microbulbifer degradans 2-40; identical to SEQ ID NO: 65477

SEQ ID NO: 96199 - DNA, 999 bp, Oenococcus oeni PSU-1; identical to SEQ ID NO: 65478
  CDS (1)..(999)

SEQ ID NO: 96200 - protein, 332 aa, Oenococcus oeni PSU-1; identical to SEQ ID NO: 65479

SEQ ID NO: 96201 - DNA, 1005 bp, Pediococcus pentosaceus ATCC 25745; identical to SEQ ID NO: 65480
  CDS (1)..(1005)

SEQ ID NO: 96202 - protein, 334 aa, Pediococcus pentosaceus ATCC 25745; identical to SEQ ID NO: 65481

SEQ ID NO: 96203 - DNA, 993 bp, Pediococcus pentosaceus ATCC 25745; identical to SEQ ID NO: 65482
  CDS (1)..(993)

SEQ ID NO: 96204 - protein, 330 aa, Pediococcus pentosaceus ATCC 25745; identical to SEQ ID NO: 65483

SEQ ID NO: 96205 - DNA, 951 bp, Trichodesmium erythraeum IMS101; identical to SEQ ID NO: 65484
  CDS (1)..(951)

SEQ ID NO: 96206 - protein, 316 aa, Trichodesmium erythraeum IMS101; identical to SEQ ID NO: 65485

SEQ ID NO: 96207 - DNA, 1002 bp, Trichodesmium erythraeum IMS101; identical to SEQ ID NO: 65486
  CDS (1)..(1002)

SEQ ID NO: 96208 - protein, 333 aa, Trichodesmium erythraeum IMS101; identical to SEQ ID NO: 65487

SEQ ID NO: 96209 - DNA, 1014 bp, Moorella thermoacetica ATCC 39073; identical to SEQ ID NO: 65488
  CDS (1)..(1014)

SEQ ID NO: 96210 - protein, 337 aa, Moorella thermoacetica ATCC 39073; identical to SEQ ID NO: 65489

SEQ ID NO: 96211 - DNA, 1029 bp, Thiobacillus denitrificans ATCC 25259; identical to SEQ ID NO: 65490
  CDS (1)..(1029)

SEQ ID NO: 96212 - protein, 342 aa, Thiobacillus denitrificans ATCC 25259; identical to SEQ ID NO: 65491

SEQ ID NO: 96213 - DNA, 999 bp, Thiobacillus denitrificans ATCC 25259; identical to SEQ ID NO: 65492
  CDS (1)..(999)

SEQ ID NO: 96214 - protein, 332 aa, Thiobacillus denitrificans ATCC 25259; identical to SEQ ID NO: 65493

SEQ ID NO: 96215 - DNA, 984 bp, Silicibacter sp. TM1040; identical to SEQ ID NO: 65494
  CDS (1)..(984)

SEQ ID NO: 96216 - protein, 327 aa, Silicibacter sp. TM1040; identical to SEQ ID NO: 65495

SEQ ID NO: 96217 - DNA, 939 bp, Azotobacter vinelandii; identical to SEQ ID NO: 65496
  CDS (1)..(939)

SEQ ID NO: 96218 - protein, 312 aa, Azotobacter vinelandii; identical to SEQ ID NO: 65497

SEQ ID NO: 96219 - DNA, 1011 bp, Anabaena variabilis ATCC 29413; identical to SEQ ID NO: 65498
  CDS (1)..(1011)

SEQ ID NO: 96220 - protein, 336 aa, Anabaena variabilis ATCC 29413; identical to SEQ ID NO: 65499

SEQ ID NO: 96221 - DNA, 2166 bp, Kineococcus radiotolerans SRS30216; identical to SEQ ID NO: 65500
  CDS (1)..(2166)

SEQ ID NO: 96222 - protein, 721 aa, Kineococcus radiotolerans SRS30216; identical to SEQ ID NO: 65501

SEQ ID NO: 96223 - DNA, 1110 bp, Polaromonas sp. JS666; identical to SEQ ID NO: 65502
  CDS (1)..(1110)

SEQ ID NO: 96224 - protein, 369 aa, Polaromonas sp. JS666; identical to SEQ ID NO: 65503

SEQ ID NO: 96225 - DNA, 1008 bp, Polaromonas sp. JS666; identical to SEQ ID NO: 65504
  CDS (1)..(1008)

SEQ ID NO: 96226 - protein, 335 aa, Polaromonas sp. JS666; identical to SEQ ID NO: 65505

SEQ ID NO: 96227 - DNA, 987 bp, Campylobacter lari RM2100; identical to SEQ ID NO: 65506
  CDS (1)..(987): transl_table=11

SEQ ID NO: 96228 - protein, 328 aa, Campylobacter lari RM2100; identical to SEQ ID NO: 65507

SEQ ID NO: 96229 - DNA, 954 bp, Campylobacter lari RM2100; identical to SEQ ID NO: 65508
  CDS (1)..(954): transl_table=11

SEQ ID NO: 96230 - protein, 317 aa, Campylobacter lari RM2100; identical to SEQ ID NO: 65509

SEQ ID NO: 96231 - DNA, 993 bp, Helicobacter pylori; identical to SEQ ID NO: 65510
  CDS (1)..(993): transl_table=11

SEQ ID NO: 96232 - protein, 330 aa, Helicobacter pylori; identical to SEQ ID NO: 65511

SEQ ID NO: 96233 - DNA, 1035 bp, Helicobacter pylori; identical to SEQ ID NO: 65512
  CDS (1)..(1035): n means a or g or c or t/u

SEQ ID NO: 96234 - protein, 344 aa, Helicobacter pylori; identical to SEQ ID NO: 65513
  misc_feature (101)..(101): Xaa can be any amino acid
  misc_feature (244)..(244): Xaa can be Asn or Asp or His or Tyr

SEQ ID NO: 96235 - DNA, 1128 bp, Arabidopsis thaliana; identical to SEQ ID NO: 65514
  CDS (1)..(1128)

SEQ ID NO: 96236 - protein, 375 aa, Arabidopsis thaliana; identical to SEQ ID NO: 65515

SEQ ID NO: 96237 - DNA, 1005 bp, Vibrio vulnificus; identical to SEQ ID NO: 65516
  CDS (1)..(1005): transl_table=11

SEQ ID NO: 96238 - protein, 334 aa, Vibrio vulnificus; identical to SEQ ID NO: 65517

SEQ ID NO: 96239 - DNA, 987 bp, Campylobacter jejuni; identical to SEQ ID NO: 65518
  CDS (1)..(987): transl_table=11

SEQ ID NO: 96240 - protein, 328 aa, Campylobacter jejuni; identical to SEQ ID NO: 65519

SEQ ID NO: 96241 - DNA, 1005 bp, Vibrio cholerae; identical to SEQ ID NO: 65520
  CDS (1)..(1005): transl_table=11

SEQ ID NO: 96242 - protein, 334 aa, Vibrio cholerae; identical to SEQ ID NO: 65521

SEQ ID NO: 96243 - DNA, 993 bp, Lactococcus lactis; identical to SEQ ID NO: 65522
  CDS (1)..(993): transl_table=11

SEQ ID NO: 96244 - protein, 330 aa, Lactococcus lactis; identical to SEQ ID NO: 65523

SEQ ID NO: 96245 - DNA, 1026 bp, Shigella sonnei; identical to SEQ ID NO: 65524
  CDS (1)..(1026): transl_table=11

SEQ ID NO: 96246 - protein, 341 aa, Shigella sonnei; identical to SEQ ID NO: 65525

SEQ ID NO: 96247 - DNA, 1005 bp, Vibrio cholerae O139; identical to SEQ ID NO: 65526
  CDS (1)..(1005): transl_table=11

SEQ ID NO: 96248 - protein, 334 aa, Vibrio cholerae O139; identical to SEQ ID NO: 65527

SEQ ID NO: 96249 - DNA, 975 bp, Campylobacter jejuni; identical to SEQ ID NO: 65528
  CDS (1)..(975)

SEQ ID NO: 96250 - protein, 324 aa, Campylobacter jejuni; identical to SEQ ID NO: 65529

SEQ ID NO: 96251 - DNA, 1002 bp, Streptococcus thermophilus; identical to SEQ ID NO: 65530
  CDS (1)..(1002): transl_table=11

SEQ ID NO: 96252 - protein, 333 aa, Streptococcus thermophilus; identical to SEQ ID NO: 65531

SEQ ID NO: 96253 - DNA, 1002 bp, Streptococcus thermophilus; identical to SEQ ID NO: 65532
  CDS (1)..(1002): transl_table=11

SEQ ID NO: 96254 - protein, 333 aa, Streptococcus thermophilus; identical to SEQ ID NO: 65533

SEQ ID NO: 96255 - DNA, 951 bp, Escherichia coli; identical to SEQ ID NO: 65534
  CDS (1)..(951): transl_table=11

SEQ ID NO: 96256 - protein, 316 aa, Escherichia coli; identical to SEQ ID NO: 65535

SEQ ID NO: 96257 - DNA, 984 bp, Listeria monocytogenes; identical to SEQ ID NO: 65536
  CDS (1)..(984): transl_table=11

SEQ ID NO: 96258 - protein, 327 aa, Listeria monocytogenes; identical to SEQ ID NO: 65537

SEQ ID NO: 96259 - DNA, 1005 bp, Klebsiella pneumoniae; identical to SEQ ID NO: 65538
  CDS (1)..(1005): transl_table=11

SEQ ID NO: 96260 - protein, 334 aa, Klebsiella pneumoniae; identical to SEQ ID NO: 65539

SEQ ID NO: 96261 - DNA, 1044 bp, Brachydanio rerio; identical to SEQ ID NO: 65540
  CDS (1)..(1044)

SEQ ID NO: 96262 - protein, 347 aa, Brachydanio rerio; identical to SEQ ID NO: 65541

SEQ ID NO: 96263 - DNA, 987 bp, Campylobacter jejuni; identical to SEQ ID NO: 65542
  CDS (1)..(987): transl_table=11

SEQ ID NO: 96264 - protein, 328 aa, Campylobacter jejuni; identical to SEQ ID NO: 65543

SEQ ID NO: 96265 - DNA, 1029 bp, Shigella dysenteriae; identical to SEQ ID NO: 65544
  CDS (1)..(1029): transl_table=11

SEQ ID NO: 96266 - protein, 342 aa, Shigella dysenteriae; identical to SEQ ID NO: 65545

SEQ ID NO: 96267 - DNA, 1011 bp, Klebsiella terrigena; identical to SEQ ID NO: 65546
  CDS (1)..(1011): transl_table=11

SEQ ID NO: 96268 - protein, 336 aa, Klebsiella terrigena; identical to SEQ ID NO: 65547

SEQ ID NO: 96269 - DNA, 987 bp, Rhizobium sp; identical to SEQ ID NO: 65548
  CDS (1)..(987): transl_table=11

SEQ ID NO: 96270 - protein, 328 aa, Rhizobium sp; identical to SEQ ID NO: 65549

SEQ ID NO: 96271 - DNA, 981 bp, Rhizobium sp; identical to SEQ ID NO: 65550
  CDS (1)..(981): transl_table=11

SEQ ID NO: 96272 - protein, 326 aa, Rhizobium sp; identical to SEQ ID NO: 65551

SEQ ID NO: 96273 - DNA, 993 bp, Streptococcus agalactiae; identical to SEQ ID NO: 65552
  CDS (1)..(993): transl_table=11

SEQ ID NO: 96274 - protein, 330 aa, Streptococcus agalactiae; identical to SEQ ID NO: 65553

SEQ ID NO: 96275 - DNA, 963 bp, Melittangium lichenicola; identical to SEQ ID NO: 65554
  CDS (1)..(963): transl_table=11

SEQ ID NO: 96276 - protein, 320 aa, Melittangium lichenicola; identical to SEQ ID NO: 65555

SEQ ID NO: 96277 - DNA, 1038 bp, Plesiomonas shigelloides; identical to SEQ ID NO: 65556
  CDS (1)..(1038): transl_table=11

SEQ ID NO: 96278 - protein, 345 aa, Plesiomonas shigelloides; identical to SEQ ID NO: 65557

SEQ ID NO: 96279 - DNA, 954 bp, Campylobacter jejuni; identical to SEQ ID NO: 65558
  CDS (1)..(954): transl_table=11

SEQ ID NO: 96280 - protein, 317 aa, Campylobacter jejuni; identical to SEQ ID NO: 65559

SEQ ID NO: 96281 - DNA, 987 bp, Campylobacter jejuni; identical to SEQ ID NO: 65560
  CDS (1)..(987): transl_table=11

SEQ ID NO: 96282 - protein, 328 aa, Campylobacter jejuni; identical to SEQ ID NO: 65561

SEQ ID NO: 96283 - DNA, 984 bp, Methylobacillus sp; identical to SEQ ID NO: 65562
  CDS (1)..(984): transl_table=11

SEQ ID NO: 96284 - protein, 327 aa, Methylobacillus sp; identical to SEQ ID NO: 65563

SEQ ID NO: 96285 - DNA, 1050 bp, Escherichia coli; identical to SEQ ID NO: 65564
  CDS (1)..(1050): transl_table=11

SEQ ID NO: 96286 - protein, 349 aa, Escherichia coli; identical to SEQ ID NO: 65565

SEQ ID NO: 96287 - DNA, 1158 bp, Giardia lamblia; identical to SEQ ID NO: 65566
  CDS (1)..(1158)

SEQ ID NO: 96288 - protein, 385 aa, Giardia lamblia; identical to SEQ ID NO: 65567

SEQ ID NO: 96289 - DNA, 1260 bp, Arabidopsis thaliana; identical to SEQ ID NO: 65568
  CDS (1)..(1260)

SEQ ID NO: 96290 - protein, 419 aa, Arabidopsis thaliana; identical to SEQ ID NO: 65569

SEQ ID NO: 96291 - DNA, 1026 bp, Pseudomonas aeruginosa; identical to SEQ ID NO: 65570
  CDS (1)..(1026): transl_table=11

SEQ ID NO: 96292 - protein, 341 aa, Pseudomonas aeruginosa; identical to SEQ ID NO: 65571

SEQ ID NO: 96293 - DNA, 1020 bp, Escherichia coli; identical to SEQ ID NO: 65572
  CDS (1)..(1020): transl_table=11

SEQ ID NO: 96294 - protein, 339 aa, Escherichia coli; identical to SEQ ID NO: 65573

SEQ ID NO: 96295 - DNA, 1011 bp, Streptococcus thermophilus; identical to SEQ ID NO: 65574
  CDS (1)..(1011): transl_table=11

SEQ ID NO: 96296 - protein, 336 aa, Streptococcus thermophilus; identical to SEQ ID NO: 65575

SEQ ID NO: 96297 - DNA, 1002 bp, Streptococcus salivarius; identical to SEQ ID NO: 65576
  CDS (1)..(1002): transl_table=11

SEQ ID NO: 96298 - protein, 333 aa, Streptococcus salivarius; identical to SEQ ID NO: 65577

SEQ ID NO: 96299 - DNA, 1005 bp, Pasteurella piscicida; identical to SEQ ID NO: 65578
  CDS (1)..(1005): transl_table=11

SEQ ID NO: 96300 - protein, 334 aa, Pasteurella piscicida; identical to SEQ ID NO: 65579

SEQ ID NO: 96301 - DNA, 1029 bp, Streptomyces viridochromogenes; identical to SEQ ID NO: 65580
  CDS (1)..(1029): transl_table=11

SEQ ID NO: 96302 - protein, 342 aa, Streptomyces viridochromogenes; identical to SEQ ID NO: 65581

SEQ ID NO: 96303 - DNA, 1041 bp, Citrobacter freundii; identical to SEQ ID NO: 65582
  CDS (1)..(1041): transl_table=11

SEQ ID NO: 96304 - protein, 346 aa, Citrobacter freundii; identical to SEQ ID NO: 65583

SEQ ID NO: 96305 - DNA, 1062 bp, Arabidopsis thaliana; identical to SEQ ID NO: 65584
  CDS (1)..(1062)

SEQ ID NO: 96306 - protein, 353 aa, Arabidopsis thaliana; identical to SEQ ID NO: 65585

SEQ ID NO: 96307 - DNA, 852 bp, Corynebacterium equii; identical to SEQ ID NO: 65586
  CDS (1)..(852): transl_table=11

SEQ ID NO: 96308 - protein, 283 aa, Corynebacterium equii; identical to SEQ ID NO: 65587

SEQ ID NO: 96309 - DNA, 993 bp, Campylobacter jejuni; identical to SEQ ID NO: 65588
  CDS (1)..(993): transl_table=11

SEQ ID NO: 96310 - protein, 330 aa, Campylobacter jejuni; identical to SEQ ID NO: 65589

SEQ ID NO: 96311 - DNA, 1014 bp, Bradyrhizobium japonicum; identical to SEQ ID NO: 65590
  CDS (1)..(1014): transl_table=11

SEQ ID NO: 96312 - protein, 337 aa, Bradyrhizobium japonicum; identical to SEQ ID NO: 65591

SEQ ID NO: 96313 - DNA, 990 bp, Rhodococcus erythropolis; identical to SEQ ID NO: 65592
  CDS (1)..(990): transl_table=11

SEQ ID NO: 96314 - protein, 329 aa, Rhodococcus erythropolis; identical to SEQ ID NO: 65593

SEQ ID NO: 96315 - DNA, 990 bp, Staphylococcus carnosus; identical to SEQ ID NO: 65594
  CDS (1)..(990): transl_table=11

SEQ ID NO: 96316 - protein, 329 aa, Staphylococcus carnosus; identical to SEQ ID NO: 65595

SEQ ID NO: 96317 - DNA, 1038 bp, Plesiomonas shigelloides; identical to SEQ ID NO: 65596
  CDS (1)..(1038): transl_table=11

SEQ ID NO: 96318 - protein, 345 aa, Plesiomonas shigelloides; identical to SEQ ID NO: 65597

SEQ ID NO: 96319 - DNA, 1005 bp, Staphylococcus aureus; identical to SEQ ID NO: 65598
  CDS (1)..(1005): transl_table=11

SEQ ID NO: 96320 - protein, 334 aa, Staphylococcus aureus; identical to SEQ ID NO: 65599

SEQ ID NO: 96321 - DNA, 1047 bp, Azospirillum brasilense; identical to SEQ ID NO: 65600
  CDS (1)..(1047): transl_table=11

SEQ ID NO: 96322 - protein, 348 aa, Azospirillum brasilense; identical to SEQ ID NO: 65601

SEQ ID NO: 96323 - DNA, 984 bp, Rhizobium leguminosarum; identical to SEQ ID NO: 65602
  CDS (1)..(984): transl_table=11

SEQ ID NO: 96324 - protein, 327 aa, Rhizobium leguminosarum; identical to SEQ ID NO: 65603

SEQ ID NO: 96325 - DNA, 987 bp, Rhizobium meliloti; identical to SEQ ID NO: 65604
  CDS (1)..(987): transl_table=11

SEQ ID NO: 96326 - protein, 328 aa, Rhizobium meliloti; identical to SEQ ID NO: 65605

SEQ ID NO: 96327 - DNA, 2070 bp, Pachysolen tannophilus; identical to SEQ ID NO: 65606
  CDS (1)..(2070)

SEQ ID NO: 96328 - protein, 689 aa, Pachysolen tannophilus; identical to SEQ ID NO: 65607

SEQ ID NO: 96329 - DNA, 1056 bp, Arabidopsis thaliana; identical to SEQ ID NO: 65608
  CDS (1)..(1056)

SEQ ID NO: 96330 - protein, 351 aa, Arabidopsis thaliana; identical to SEQ ID NO: 65609

SEQ ID NO: 96331 - DNA, 1053 bp, Pisum sativum; identical to SEQ ID NO: 65610
  CDS (1)..(1053)

SEQ ID NO: 96332 - protein, 350 aa, Pisum sativum; identical to SEQ ID NO: 65611

SEQ ID NO: 96333 - DNA, 987 bp, Corynebacterium diphtheriae; identical to SEQ ID NO: 65612
  CDS (1)..(987)

SEQ ID NO: 96334 - protein, 328 aa, Corynebacterium diphtheriae; identical to SEQ ID NO: 65613

SEQ ID NO: 96335 - DNA, 990 bp, Corynebacterium glutamicum; identical to SEQ ID NO: 65614
  CDS (1)..(990): transl_table=11

SEQ ID NO: 96336 - protein, 329 aa, Corynebacterium glutamicum; identical to SEQ ID NO: 65615

SEQ ID NO: 96337 - DNA, 996 bp, Lactobacillus casei; identical to SEQ ID NO: 65616
  CDS (1)..(996): transl_table=11

SEQ ID NO: 96338 - protein, 331 aa, Lactobacillus casei; identical to SEQ ID NO: 65617

SEQ ID NO: 96339 - DNA, 993 bp, Lactobacillus helveticus; identical to SEQ ID NO: 65618
  CDS (1)..(993): transl_table=11

SEQ ID NO: 96340 - protein, 330 aa, Lactobacillus helveticus; identical to SEQ ID NO: 65619

SEQ ID NO: 96341 - DNA, 918 bp, Methanococcus jannaschii; identical to SEQ ID NO: 65620
  CDS (1)..(918): transl_table=11

SEQ ID NO: 96342 - protein, 305 aa, Methanococcus jannaschii; identical to SEQ ID NO: 65621

SEQ ID NO: 96343 - DNA, 1023 bp, Mycoplasma genitalium; identical to SEQ ID NO: 65622
  CDS (1)..(1023): transl_table=4

SEQ ID NO: 96344 - protein, 340 aa, Mycoplasma genitalium; identical to SEQ ID NO: 65623

SEQ ID NO: 96345 - DNA, 1017 bp, Mycoplasma pneumoniae; identical to SEQ ID NO: 65624
  CDS (1)..(1017): transl_table=4

SEQ ID NO: 96346 - protein, 338 aa, Mycoplasma pneumoniae; identical to SEQ ID NO: 65625

SEQ ID NO: 96347 - DNA, 1017 bp, Pasteurella haemolytica; identical to SEQ ID NO: 65626
  CDS (1)..(1017): transl_table=11

SEQ ID NO: 96348 - protein, 338 aa, Pasteurella haemolytica; identical to SEQ ID NO: 65627

SEQ ID NO: 96349 - DNA, 1017 bp, Pasteurella multocida; identical to SEQ ID NO: 65628
  CDS (1)..(1017): transl_table=11

SEQ ID NO: 96350 - protein, 338 aa, Pasteurella multocida; identical to SEQ ID NO: 65629

SEQ ID NO: 96351 - DNA, 1002 bp, Streptococcus mutans; identical to SEQ ID NO: 65630
  CDS (1)..(1002)

SEQ ID NO: 96352 - protein, 333 aa, Streptococcus mutans; identical to SEQ ID NO: 65631

SEQ ID NO: 96353 - DNA, 990 bp, Bordetella bronchiseptica; identical to SEQ ID NO: 65632
  CDS (1)..(990): transl_table=11

SEQ ID NO: 96354 - protein, 329 aa, Bordetella bronchiseptica; identical to SEQ ID NO: 65633

SEQ ID NO: 96355 - DNA, 990 bp, Bordetella pertussis; identical to SEQ ID NO: 65634
  CDS (1)..(990): transl_table=11

SEQ ID NO: 96356 - protein, 329 aa, Bordetella pertussis; identical to SEQ ID NO: 65635

SEQ ID NO: 96357 - DNA, 1002 bp, Chromobacterium violaceum; identical to SEQ ID NO: 65636
  CDS (1)..(1002): transl_table=11

SEQ ID NO: 96358 - protein, 333 aa, Chromobacterium violaceum; identical to SEQ ID NO: 65637

SEQ ID NO: 96359 - DNA, 972 bp, Desulfovibrio vulgaris; identical to SEQ ID NO: 65638
  CDS (1)..(972): transl_table=11

SEQ ID NO: 96360 - protein, 323 aa, Desulfovibrio vulgaris; identical to SEQ ID NO: 65639

SEQ ID NO: 96361 - DNA, 999 bp, Fusobacterium nucleatum; identical to SEQ ID NO: 65640
  CDS (1)..(999): transl_table=11

SEQ ID NO: 96362 - protein, 332 aa, Fusobacterium nucleatum; identical to SEQ ID NO: 65641

SEQ ID NO: 96363 - DNA, 942 bp, Haemophilus ducreyi; identical to SEQ ID NO: 65642
  CDS (1)..(942): transl_table=11

SEQ ID NO: 96364 - protein, 313 aa, Haemophilus ducreyi; identical to SEQ ID NO: 65643

SEQ ID NO: 96365 - DNA, 927 bp, Haemophilus influenzae; identical to SEQ ID NO: 65644
  CDS (1)..(927): transl_table=11

SEQ ID NO: 96366 - protein, 308 aa, Haemophilus influenzae; identical to SEQ ID NO: 65645

SEQ ID NO: 96367 - DNA, 1005 bp, Neisseria meningitidis; identical to SEQ ID NO: 65646
  CDS (1)..(1005): transl_table=11

SEQ ID NO: 96368 - protein, 334 aa, Neisseria meningitidis; identical to SEQ ID NO: 65647

SEQ ID NO: 96369 - DNA, 933 bp, Pasteurella multocida; identical to SEQ ID NO: 65648
  CDS (1)..(933): transl_table=11

SEQ ID NO: 96370 - protein, 310 aa, Pasteurella multocida; identical to SEQ ID NO: 65649

SEQ ID NO: 96371 - DNA, 939 bp, Photorhabdus luminescens; identical to SEQ ID NO: 65650
  CDS (1)..(939): transl_table=11

SEQ ID NO: 96372 - protein, 312 aa, Photorhabdus luminescens; identical to SEQ ID NO: 65651

SEQ ID NO: 96373 - DNA, 951 bp, Rhizobium loti; identical to SEQ ID NO: 65652
  CDS (1)..(951)

SEQ ID NO: 96374 - protein, 316 aa, Rhizobium loti; identical to SEQ ID NO: 65653

SEQ ID NO: 96375 - DNA, 942 bp, Vibrio parahaemolyticus; identical to SEQ ID NO: 65654
  CDS (1)..(942)

SEQ ID NO: 96376 - protein, 313 aa, Vibrio parahaemolyticus; identical to SEQ ID NO: 65655

SEQ ID NO: 96377 - DNA, 1047 bp, Salmonella typhi; identical to SEQ ID NO: 65656
  CDS (1)..(1047): transl_table=11

SEQ ID NO: 96378 - protein, 348 aa, Salmonella typhi; identical to SEQ ID NO: 65657

SEQ ID NO: 96379 - DNA, 981 bp, Methanococcus jannaschii; identical to SEQ ID NO: 65658
  CDS (1)..(981): transl_table=11

SEQ ID NO: 96380 - protein, 326 aa, Methanococcus jannaschii; identical to SEQ ID NO: 65659

SEQ ID NO: 96381 - DNA, 1005 bp, Escherichia coli O111; identical to SEQ ID NO: 65660
  CDS (1)..(1005): transl_table=11

SEQ ID NO: 96382 - protein, 334 aa, Escherichia coli O111; identical to SEQ ID NO: 65661

SEQ ID NO: 96383 - DNA, 22 bp, Primer
atgatcatcgttaccggcggcg

SEQ ID NO: 96384 - DNA, 22 bp, Primer
ttatgcgtcgcgattcagccag

SEQ ID NO: 96385 - protein, 328 aa, consensus; identical to SEQ ID NO: 65664
  MISC_FEATURE (1)..(328): consensus for the disclosure of xaa see table XV

SEQ ID NO: 96386 - protein, 30 aa, consensus; identical to SEQ ID NO: 65665
  MISC_FEATURE (1)..(30): consensus for the disclosure of xaa see table XV

SEQ ID NO: 96387 - protein, 116 aa, consensus; identical to SEQ ID NO: 65666
  MISC_FEATURE (1)..(116): consensus for the disclosure of xaa see table XV

SEQ ID NO: 96388 - protein, 57 aa, consensus; identical to SEQ ID NO: 65667
  MISC_FEATURE (1)..(57): consensus for the disclosure of xaa see table XV

SEQ ID NO: 96389 - DNA, 768 bp, Escherichia coli; identical to SEQ ID NO: 66654
  CDS (1)..(768)

SEQ ID NO: 96390 - protein, 255 aa, Escherichia coli; identical to SEQ ID NO: 66655

SEQ ID NO: 96391 - DNA, 828 bp, Gluconobacter oxydans 621H; identical to SEQ ID NO: 66656
  CDS (1)..(828)

SEQ ID NO: 96392 - protein, 275 aa, Gluconobacter oxydans 621H; identical to SEQ ID NO: 66657

SEQ ID NO: 96393 - DNA, 801 bp, Gluconobacter oxydans 621H; identical to SEQ ID NO: 66658
  CDS (1)..(801)

SEQ ID NO: 96394 - protein, 266 aa, Gluconobacter oxydans 621H; identical to SEQ ID NO: 66659

SEQ ID NO: 96395 - DNA, 750 bp, Homo sapiens; identical to SEQ ID NO: 66660
  CDS (1)..(750)

SEQ ID NO: 96396 - protein, 249 aa, Homo sapiens; identical to SEQ ID NO: 66661

SEQ ID NO: 96397 - DNA, 747 bp, Saccharomyces cerevisiae; identical to SEQ ID NO: 66662
  CDS (1)..(747)

SEQ ID NO: 96398 - protein, 248 aa, Saccharomyces cerevisiae; identical to SEQ ID NO: 66663

SEQ ID NO: 96399 - DNA, 750 bp, Mus musculus; identical to SEQ ID NO: 66664
  CDS (1)..(750)

SEQ ID NO: 96400 - protein, 249 aa, Mus musculus; identical to SEQ ID NO: 66665

SEQ ID NO: 96401 - DNA, 753 bp, Agrobacterium rhizogenes; identical to SEQ ID NO: 66666
  CDS (1)..(753): transl_table=11

SEQ ID NO: 96402 - protein, 250 aa, Agrobacterium rhizogenes; identical to SEQ ID NO: 66667

SEQ ID NO: 96403 - DNA, 765 bp, Chlamydophila pneumoniae CWL029; identical to SEQ ID NO: 66668
  CDS (1)..(765): transl_table=11

SEQ ID NO: 96404 - protein, 254 aa, Chlamydophila pneumoniae CWL029; identical to SEQ ID NO: 66669

SEQ ID NO: 96405 - DNA, 1050 bp, Pasteurella multocida subsp. multocida str. Pm70; identical to SEQ ID NO: 66670
  CDS (1)..(1050): transl_table=11

SEQ ID NO: 96406 - protein, 349 aa, Pasteurella multocida subsp. multocida str. Pm70; identical to SEQ ID NO: 66671

SEQ ID NO: 96407 - DNA, 759 bp, Lactococcus lactis subsp. lactis Il1403; identical to SEQ ID NO: 66672
  CDS (1)..(759): transl_table=11

SEQ ID NO: 96408 - protein, 252 aa, Lactococcus lactis subsp. lactis Il1403; identical to SEQ ID NO: 66673

SEQ ID NO: 96409 - DNA, 765 bp, Chlamydophila pneumoniae J138; identical to SEQ ID NO: 66674
  CDS (1)..(765): transl_table=11

SEQ ID NO: 96410 - protein, 254 aa, Chlamydophila pneumoniae J138; identical to SEQ ID NO: 66675

SEQ ID NO: 96411 - DNA, 780 bp, Streptococcus pneumoniae R6; identical to SEQ ID NO: 66676
  CDS (1)..(780): transl_table=11

SEQ ID NO: 96412 - protein, 259 aa, Streptococcus pneumoniae R6; identical to SEQ ID NO: 66677

SEQ ID NO: 96413 - DNA, 729 bp, Encephalitozoon cuniculi; identical to SEQ ID NO: 66678
  CDS (1)..(729): transl_table=11

SEQ ID NO: 96414 - protein, 242 aa, Encephalitozoon cuniculi; identical to SEQ ID NO: 66679

SEQ ID NO: 96415 - DNA, 750 bp, Schizosaccharomyces pombe; identical to SEQ ID NO: 66680
  CDS (1)..(750)

SEQ ID NO: 96416 - protein, 249 aa, Schizosaccharomyces pombe; identical to SEQ ID NO: 66681

SEQ ID NO: 96417 - DNA, 759 bp, Streptococcus pyogenes MGAS8232; identical to SEQ ID NO: 66682
  CDS (1)..(759): transl_table=11

SEQ ID NO: 96418 - protein, 252 aa, Streptococcus pyogenes MGAS8232; identical to SEQ ID NO: 66683

SEQ ID NO: 96419 - DNA, 747 bp, Danio rerio; identical to SEQ ID NO: 66684
  CDS (1)..(747)

SEQ ID NO: 96420 - protein, 248 aa, Danio rerio; identical to SEQ ID NO: 66685

SEQ ID NO: 96421 - DNA, 744 bp, Drosophila melanogaster; identical to SEQ ID NO: 66686
  CDS (1)..(744)

SEQ ID NO: 96422 - protein, 247 aa, Drosophila melanogaster; identical to SEQ ID NO: 66687

SEQ ID NO: 96423 - DNA, 693 bp, Prochlorococcus marinus subsp. pastoris str. CCMP1986; identical to SEQ ID NO: 66688
  CDS (1)..(693): transl_table=11

SEQ ID NO: 96424 - protein, 230 aa, Prochlorococcus marinus subsp. pastoris str. CCMP1986; identical to SEQ ID NO: 66689

SEQ ID NO: 96425 - DNA, 768 bp, Oryza sativa (japonica cultivar-group); identical to SEQ ID NO: 66690
  CDS (1)..(768)

SEQ ID NO: 96426 - protein, 255 aa, Oryza sativa (japonica cultivar-group); identical to SEQ ID NO: 66691

SEQ ID NO: 96427 - DNA, 783 bp, Corynebacterium diphtheriae NCTC 13129; identical to SEQ ID NO: 66692
  CDS (1)..(783): transl_table=11

SEQ ID NO: 96428 - protein, 260 aa, Corynebacterium diphtheriae NCTC 13129; identical to SEQ ID NO: 66693

SEQ ID NO: 96429 - DNA, 837 bp, Rhodopseudomonas palustris CGA009; identical to SEQ ID NO: 66694
  CDS (1)..(837): transl_table=11

SEQ ID NO: 96430 - protein, 278 aa, Rhodopseudomonas palustris CGA009; identical to SEQ ID NO: 66695

SEQ ID NO: 96431 - DNA, 825 bp, Onion yellows phytoplasma OY-M; identical to SEQ ID NO: 66696
  CDS (1)..(825): transl_table=11

SEQ ID NO: 96432 - protein, 274 aa, Onion yellows phytoplasma OY-M; identical to SEQ ID NO: 66697

SEQ ID NO: 96433 - DNA, 1965 bp, Geobacter sulfurreducens PCA; identical to SEQ ID NO: 66698
  CDS (1)..(1965): transl_table=11

SEQ ID NO: 96434 - protein, 654 aa, Geobacter sulfurreducens PCA; identical to SEQ ID NO: 66699

SEQ ID NO: 96435 - DNA, 786 bp, Mycobacterium avium subsp. paratuberculosis str. k10; identical to SEQ ID NO: 66700
  CDS (1)..(786): transl_table=11

SEQ ID NO: 96436 - protein, 261 aa, Mycobacterium avium subsp. paratuberculosis str. k10; identical to SEQ ID NO: 66701

SEQ ID NO: 96437 - DNA, 756 bp, Lactobacillus johnsonii NCC 533; identical to SEQ ID NO: 66702
  CDS (1)..(756): transl_table=11

SEQ ID NO: 96438 - protein, 251 aa, Lactobacillus johnsonii NCC 533; identical to SEQ ID NO: 66703

SEQ ID NO: 96439 - DNA, 729 bp, Wolbachia endosymbiont of Drosophila melanogaster; identical to SEQ ID NO: 66704
  CDS (1)..(729): transl_table=11

SEQ ID NO: 96440 - protein, 242 aa, Wolbachia endosymbiont of Drosophila melanogaster; identical to SEQ ID NO: 66705

SEQ ID NO: 96441 - DNA, 726 bp, Bdellovibrio bacteriovorus HD100; identical to SEQ ID NO: 66706
  CDS (1)..(726): transl_table=11

SEQ ID NO: 96442 - protein, 241 aa, Bdellovibrio bacteriovorus HD100; identical to SEQ ID NO: 66707

SEQ ID NO: 96443 - DNA, 753 bp, Treponema denticola ATCC 35405; identical to SEQ ID NO: 66708
  CDS (1)..(753): transl_table=11

SEQ ID NO: 96444 - protein, 250 aa, Treponema denticola ATCC 35405; identical to SEQ ID NO: 66709

SEQ ID NO: 96445 - DNA, 747 bp, Mycoplasma mycoides subsp. mycoides SC str. PG1; identical to SEQ ID NO: 66710
  CDS (1)..(747): transl_table=4

SEQ ID NO: 96446 - protein, 248 aa, Mycoplasma mycoides subsp. mycoides SC str. PG1; identical to SEQ ID NO: 66711

SEQ ID NO: 96447 - DNA, 756 bp, Bacillus cereus ATCC 10987; identical to SEQ ID NO: 66712
  CDS (1)..(756): transl_table=11

SEQ ID NO: 96448 - protein, 251 aa, Bacillus cereus ATCC 10987; identical to SEQ ID NO: 66713

SEQ ID NO: 96449 - DNA, 795 bp, Anopheles gambiae str. PEST; identical to SEQ ID NO: 66714
  CDS (1)..(795)

SEQ ID NO: 96450 - protein, 264 aa, Anopheles gambiae str. PEST; identical to SEQ ID NO: 66715

SEQ ID NO: 96451 - DNA, 744 bp, Gibberella zeae PH-1; identical to SEQ ID NO: 66716
  CDS (1)..(744)

SEQ ID NO: 96452 - protein, 247 aa, Gibberella zeae PH-1; identical to SEQ ID NO: 66717

SEQ ID NO: 96453 - DNA, 747 bp, Ustilago maydis 521; identical to SEQ ID NO: 66718
  CDS (1)..(747)

SEQ ID NO: 96454 - protein, 248 aa, Ustilago maydis 521; identical to SEQ ID NO: 66719

SEQ ID NO: 96455 - DNA, 774 bp, Kluyveromyces lactis NRRL Y-1140; identical to SEQ ID NO: 66720
  CDS (1)..(774)

SEQ ID NO: 96456 - protein, 257 aa, Kluyveromyces lactis NRRL Y-1140; identical to SEQ ID NO: 66721

SEQ ID NO: 96457 - DNA, 753 bp, Leptospira interrogans serovar Copenhageni str. Fiocruz L1-130; identical to SEQ ID NO: 66722
  CDS (1)..(753): transl_table=11

SEQ ID NO: 96458 - protein, 250 aa, Leptospira interrogans serovar Copenhageni str. Fiocruz L1-130; identical to SEQ ID NO: 66723

SEQ ID NO: 96459 - DNA, 753 bp, Thermus thermophilus HB27; identical to SEQ ID NO: 66724
  CDS (1)..(753): transl_table=11

SEQ ID NO: 96460 - protein, 250 aa, Thermus thermophilus HB27; identical to SEQ ID NO: 66725

SEQ ID NO: 96461 - DNA, 795 bp, Parachlamydia sp. UWE25; identical to SEQ ID NO: 66726
  CDS (1)..(795): transl_table=11

SEQ ID NO: 96462 - protein, 264 aa, Parachlamydia sp. UWE25; identical to SEQ ID NO: 66727

SEQ ID NO: 96463 - DNA, 756 bp, Desulfovibrio vulgaris subsp. vulgaris str. Hildenborough; identical to SEQ ID NO: 66728
  CDS (1)..(756): transl_table=11

SEQ ID NO: 96464 - protein, 251 aa, Desulfovibrio vulgaris subsp. vulgaris str. Hildenborough; identical to SEQ ID NO: 66729

SEQ ID NO: 96465 - DNA, 765 bp, Listeria monocytogenes str. 4b F2365; identical to SEQ ID NO: 66730
  CDS (1)..(765): transl_table=11

SEQ ID NO: 96466 - protein, 254 aa, Listeria monocytogenes str. 4b F2365; identical to SEQ ID NO: 66731

SEQ ID NO: 96467 - DNA, 729 bp, Mycoplasma mobile 163K; identical to SEQ ID NO: 66732
  CDS (1)..(729): transl_table=4

SEQ ID NO: 96468 - protein, 242 aa, Mycoplasma mobile 163K; identical to SEQ ID NO: 66733

SEQ ID NO: 96469 - DNA, 765 bp, Bartonella quintana str. Toulouse; identical to SEQ ID NO: 66734
  CDS (1)..(765): transl_table=11

SEQ ID NO: 96470 - protein, 254 aa, Bartonella quintana str. Toulouse; identical to SEQ ID NO: 66735

SEQ ID NO: 96471 - DNA, 798 bp, Acinetobacter sp. ADP1; identical to SEQ ID NO: 66736
  CDS (1)..(798): transl_table=11

SEQ ID NO: 96472 - protein, 265 aa, Acinetobacter sp. ADP1; identical to SEQ ID NO: 66737

SEQ ID NO: 96473 - DNA, 768 bp, Erwinia carotovora subsp. atroseptica SCRI1043; identical to SEQ ID NO: 66738
  CDS (1)..(768)

SEQ ID NO: 96474 - protein, 255 aa, Erwinia carotovora subsp. atroseptica SCRI1043; identical to SEQ ID NO: 66739

SEQ ID NO: 96475 - DNA, 828 bp, Mesoplasma florum L1; identical to SEQ ID NO: 66740
  CDS (1)..(828): transl_table=4

SEQ ID NO: 96476 - protein, 275 aa, Mesoplasma florum L1; identical to SEQ ID NO: 66741

SEQ ID NO: 96477 - DNA, 780 bp, Propionibacterium acnes KPA171202; identical to SEQ ID NO: 66742
  CDS (1)..(780): transl_table=11

SEQ ID NO: 96478 - protein, 259 aa, Propionibacterium acnes KPA171202; identical to SEQ ID NO: 66743

SEQ ID NO: 96479 - DNA, 804 bp, Leifsonia xyli subsp. xyli str. CTCB07; identical to SEQ ID NO: 66744
  CDS (1)..(804): transl_table=11

SEQ ID NO: 96480 - protein, 267 aa, Leifsonia xyli subsp. xyli str. CTCB07; identical to SEQ ID NO: 66745

SEQ ID NO: 96481 - DNA, 756 bp, Desulfotalea psychrophila LSv54; identical to SEQ ID NO: 66746
  CDS (1)..(756): transl_table=11

SEQ ID NO: 96482 - protein, 251 aa, Desulfotalea psychrophila LSv54; identical to SEQ ID NO: 66747

SEQ ID NO: 96483 - DNA, 762 bp, Borrelia garinii PBi; identical to SEQ ID NO: 66748
  CDS (1)..(762): transl_table=11

SEQ ID NO: 96484 - protein, 253 aa, Borrelia garinii PBi; identical to SEQ ID NO: 66749

SEQ ID NO: 96485 - DNA, 771 bp, Symbiobacterium thermophilum IAM 14863; identical to SEQ ID NO: 66750
  CDS (1)..(771): transl_table=11

SEQ ID NO: 96486 - protein, 256 aa, Symbiobacterium thermophilum IAM 14863; identical to SEQ ID NO: 66751

SEQ ID NO: 96487 - DNA, 768 bp, Mannheimia succiniciproducens MBEL55E; identical to SEQ ID NO: 66752
  CDS (1)..(768): transl_table=11

SEQ ID NO: 96488 - protein, 255 aa, Mannheimia succiniciproducens MBEL55E; identical to SEQ ID NO: 66753

SEQ ID NO: 96489 - DNA, 783 bp, Mannheimia succiniciproducens MBEL55E; identical to SEQ ID NO: 66754
  CDS (1)..(783): transl_table=11

SEQ ID NO: 96490 - protein, 260 aa, Mannheimia succiniciproducens MBEL55E; identical to SEQ ID NO: 66755

SEQ ID NO: 96491 - DNA, 762 bp, Bacillus licheniformis ATCC 14580; identical to SEQ ID NO: 66756
  CDS (1)..(762): transl_table=11

SEQ ID NO: 96492 - protein, 253 aa, Bacillus licheniformis ATCC 14580; identical to SEQ ID NO: 66757

SEQ ID NO: 96493 - DNA, 756 bp, Bacteroides fragilis YCH46; identical to SEQ ID NO: 66758
  CDS (1)..(756): transl_table=11

SEQ ID NO: 96494 - protein, 251 aa, Bacteroides fragilis YCH46; identical to SEQ ID NO: 66759

SEQ ID NO: 96495 - DNA, 756 bp, Burkholderia mallei ATCC 23344; identical to SEQ ID NO: 66760
  CDS (1)..(756): transl_table=11

SEQ ID NO: 96496 - protein, 251 aa, Burkholderia mallei ATCC 23344; identical to SEQ ID NO: 66761

SEQ ID NO: 96497 - DNA, 753 bp, Methylococcus capsulatus str. Bath; identical to SEQ ID NO: 66762
  CDS (1)..(753): transl_table=11

SEQ ID NO: 96498 - protein, 250 aa, Methylococcus capsulatus str. Bath; identical to SEQ ID NO: 66763

SEQ ID NO: 96499 - DNA, 786 bp, Nocardia farcinica IFM 10152; identical to SEQ ID NO: 66764
  CDS (1)..(786): transl_table=11

SEQ ID NO: 96500 - protein, 261 aa, Nocardia farcinica IFM 10152; identical to SEQ ID NO: 66765

SEQ ID NO: 96501 - DNA, 750 bp, Legionella pneumophila str. Lens; identical to SEQ ID NO: 66766
  CDS (1)..(750): transl_table=11

SEQ ID NO: 96502 - protein, 249 aa, Legionella pneumophila str. Lens; identical to SEQ ID NO: 66767

SEQ ID NO: 96503 - DNA, 789 bp, Photobacterium profundum SS9; identical to SEQ ID NO: 66768
  CDS (1)..(789): transl_table=11

SEQ ID NO: 96504 - protein, 262 aa, Photobacterium profundum SS9; identical to SEQ ID NO: 66769

SEQ ID NO: 96505 - DNA, 753 bp, Thermus thermophilus HB8; identical to SEQ ID NO: 66770
  CDS (1)..(753): transl_table=11

SEQ ID NO: 96506 - protein, 250 aa, Thermus thermophilus HB8; identical to SEQ ID NO: 66771

SEQ ID NO: 96507 - DNA, 762 bp, Geobacillus kaustophilus HTA426; identical to SEQ ID NO: 66772
  CDS (1)..(762): transl_table=11

SEQ ID NO: 96508 - protein, 253 aa, Geobacillus kaustophilus HTA426; identical to SEQ ID NO: 66773

SEQ ID NO: 96509 - DNA, 807 bp, Anaplasma marginale str. St. Maries; identical to SEQ ID NO: 66774
  CDS (1)..(807): transl_table=11

SEQ ID NO: 96510 - protein, 268 aa, Anaplasma marginale str. St. Maries; identical to SEQ ID NO: 66775

SEQ ID NO: 96511 - DNA, 759 bp, Idiomarina loihiensis L2TR; identical to SEQ ID NO: 66776
  CDS (1)..(759): transl_table=11

SEQ ID NO: 96512 - protein, 252 aa, Idiomarina loihiensis L2TR; identical to SEQ ID NO: 66777

SEQ ID NO: 96513 - DNA, 816 bp, Azoarcus sp. EbN1; identical to SEQ ID NO: 66778
  CDS (1)..(816): transl_table=11

SEQ ID NO: 96514 - protein, 271 aa, Azoarcus sp. EbN1; identical to SEQ ID NO: 66779

SEQ ID NO: 96515 - DNA, 750 bp, Zymomonas mobilis subsp. mobilis ZM4; identical to SEQ ID NO: 66780
  CDS (1)..(750): transl_table=11

SEQ ID NO: 96516 - protein, 249 aa, Zymomonas mobilis subsp. mobilis ZM4; identical to SEQ ID NO: 66781

SEQ ID NO: 96517 - DNA, 756 bp, Silicibacter pomeroyi DSS-3; identical to SEQ ID NO: 66782
  CDS (1)..(756): transl_table=11

SEQ ID NO: 96518 - protein, 251 aa, Silicibacter pomeroyi DSS-3; identical to SEQ ID NO: 66783

SEQ ID NO: 96519 - DNA, 762 bp, Francisella tularensis subsp. tularensis Schu 4; identical to SEQ ID NO: 66784
  CDS (1)..(762): transl_table=11

SEQ ID NO: 96520 - protein, 253 aa, Francisella tularensis subsp. tularensis Schu 4; identical to SEQ ID NO: 66785

SEQ ID NO: 96521 - DNA, 762 bp, Synechococcus elongatus PCC 6301; identical to SEQ ID NO: 66786
  CDS (1)..(762): transl_table=11

SEQ ID NO: 96522 - protein, 253 aa, Synechococcus elongatus PCC 6301; identical to SEQ ID NO: 66787

SEQ ID NO: 96523 - DNA, 756 bp, Bacillus clausii KSM-K16; identical to SEQ ID NO: 66788
  CDS (1)..(756): transl_table=11

SEQ ID NO: 96524 - protein, 251 aa, Bacillus clausii KSM-K16; identical to SEQ ID NO: 66789

SEQ ID NO: 96525 - DNA, 723 bp, Ehrlichia ruminantium str. Welgevonden; identical to SEQ ID NO: 66790
  CDS (1)..(723): transl_table=11

SEQ ID NO: 96526 - protein, 240 aa, Ehrlichia ruminantium str. Welgevonden; identical to SEQ ID NO: 66791

SEQ ID NO: 96527 - DNA, 756 bp, Dehalococcoides ethenogenes 195; identical to SEQ ID NO: 66792
  CDS (1)..(756): transl_table=11

SEQ ID NO: 96528 - protein, 251 aa, Dehalococcoides ethenogenes 195; identical to SEQ ID NO: 66793

SEQ ID NO: 96529 - DNA, 750 bp, Rhodobacter sphaeroides 2.4.1; identical to SEQ ID NO: 66794
  CDS (1)..(750)

SEQ ID NO: 96530 - protein, 249 aa, Rhodobacter sphaeroides 2.4.1; identical to SEQ ID NO: 66795

SEQ ID NO: 96531 - DNA, 750 bp, Xylella fastidiosa Dixon; identical to SEQ ID NO: 66796
  CDS (1)..(750)

SEQ ID NO: 96532 - protein, 249 aa, Xylella fastidiosa Dixon; identical to SEQ ID NO: 66797

SEQ ID NO: 96533 - DNA, 741 bp, Azotobacter vinelandii; identical to SEQ ID NO: 66798
  CDS (1)..(741)

SEQ ID NO: 96534 - protein, 246 aa, Azotobacter vinelandii; identical to SEQ ID NO: 66799

SEQ ID NO: 96535 - DNA, 762 bp, Azotobacter vinelandii; identical to SEQ ID NO: 66800
  CDS (1)..(762)

SEQ ID NO: 96536 - protein, 253 aa, Azotobacter vinelandii; identical to SEQ ID NO: 66801

SEQ ID NO: 96537 - DNA, 747 bp, Nostoc punctiforme PCC 73102; identical to SEQ ID NO: 66802
  CDS (1)..(747)

SEQ ID NO: 96538 - protein, 248 aa, Nostoc punctiforme PCC 73102; identical to SEQ ID NO: 66803

SEQ ID NO: 96539 - DNA, 723 bp, Desulfovibrio desulfuricans G20; identical to SEQ ID NO: 66804
  CDS (1)..(723)

SEQ ID NO: 96540 - protein, 240 aa, Desulfovibrio desulfuricans G20; identical to SEQ ID NO: 66805

SEQ ID NO: 96541 - DNA, 771 bp, Actinobacillus pleuropneumoniae serovar 1 str. 4074; identical to SEQ ID NO: 66806
  CDS (1)..(771)

SEQ ID NO: 96542 - protein, 256 aa, Actinobacillus pleuropneumoniae serovar 1 str. 4074; identical to SEQ ID NO: 66807

SEQ ID NO: 96543 - DNA, 756 bp, Fusobacterium nucleatum subsp. vincentii ATCC 49256; identical to SEQ ID NO: 66808
  CDS (1)..(756): transl_table=11

SEQ ID NO: 96544 - protein, 251 aa, Fusobacterium nucleatum subsp. vincentii ATCC 49256; identical to SEQ ID NO: 66809

SEQ ID NO: 96545 - DNA, 810 bp, Psychrobacter sp. 273-4; identical to SEQ ID NO: 66810
  CDS (1)..(810)

SEQ ID NO: 96546 - protein, 269 aa, Psychrobacter sp. 273-4; identical to SEQ ID NO: 66811

SEQ ID NO: 96547 - DNA, 792 bp, Haemophilus influenzae R2866; identical to SEQ ID NO: 66812
  CDS (1)..(792)

SEQ ID NO: 96548 - protein, 263 aa, Haemophilus influenzae R2866; identical to SEQ ID NO: 66813

SEQ ID NO: 96549 - DNA, 693 bp, Anabaena variabilis ATCC 29413; identical to SEQ ID NO: 66814
  CDS (1)..(693)

SEQ ID NO: 96550 - protein, 230 aa, Anabaena variabilis ATCC 29413; identical to SEQ ID NO: 66815

SEQ ID NO: 96551 - DNA, 696 bp, Synechococcus elongatus PCC 7942; identical to SEQ ID NO: 66816
  CDS (1)..(696)

SEQ ID NO: 96552 - protein, 231 aa, Synechococcus elongatus PCC 7942; identical to SEQ ID NO: 66817

SEQ ID NO: 96553 - DNA, 753 bp, Methylobacillus flagellatus KT; identical to SEQ ID NO: 66818
  CDS (1)..(753)

SEQ ID NO: 96554 - protein, 250 aa, Methylobacillus flagellatus KT; identical to SEQ ID NO: 66819

SEQ ID NO: 96555 - DNA, 732 bp, Crocosphaera watsonii WH 8501; identical to SEQ ID NO: 66820
  CDS (1)..(732)

SEQ ID NO: 96556 - protein, 243 aa, Crocosphaera watsonii WH 8501; identical to SEQ ID NO: 66821

SEQ ID NO: 96557 - DNA, 753 bp, Exiguobacterium sp. 255-15; identical to SEQ ID NO: 66822
  CDS (1)..(753)

SEQ ID NO: 96558 - protein, 250 aa, Exiguobacterium sp. 255-15; identical to SEQ ID NO: 66823

SEQ ID NO: 96559 - DNA, 771 bp, Rubrobacter xylanophilus DSM 9941; identical to SEQ ID NO: 66824
  CDS (1)..(771)

SEQ ID NO: 96560 - protein, 256 aa, Rubrobacter xylanophilus DSM 9941; identical to SEQ ID NO: 66825

SEQ ID NO: 96561 - DNA, 765 bp, Mesorhizobium sp. BNC1; identical to SEQ ID NO: 66826
  CDS (1)..(765)

SEQ ID NO: 96562 - protein, 254 aa, Mesorhizobium sp. BNC1; identical to SEQ ID NO: 66827

SEQ ID NO: 96563 - DNA, 756 bp, Magnetospirillum magnetotacticum MS-1; identical to SEQ ID NO: 66828
  CDS (1)..(756)

SEQ ID NO: 96564 - protein, 251 aa, Magnetospirillum magnetotacticum MS-1; identical to SEQ ID NO: 66829

SEQ ID NO: 96565 - DNA, 768 bp, Ehrlichia canis str. Jake; identical to SEQ ID NO: 66830
  CDS (1)..(768)

SEQ ID NO: 96566 - protein, 255 aa, Ehrlichia canis str. Jake; identical to SEQ ID NO: 66831

SEQ ID NO: 96567 - DNA, 732 bp, Burkholderia cepacia R1808; identical to SEQ ID NO: 66832
  CDS (1)..(732)

SEQ ID NO: 96568 - protein, 243 aa, Burkholderia cepacia R1808; identical to SEQ ID NO: 66833

SEQ ID NO: 96569 - DNA, 756 bp, Listeria monocytogenes str. 1/2a F6854; identical to SEQ ID NO: 66834
  CDS (1)..(756): transl_table=11

SEQ ID NO: 96570 - protein, 251 aa, Listeria monocytogenes str. 1/2a F6854; identical to SEQ ID NO: 66835

SEQ ID NO: 96571 - DNA, 723 bp, Bacillus cereus G9241; identical to SEQ ID NO: 66836
  CDS (1)..(723): transl_table=11

SEQ ID NO: 96572 - protein, 240 aa, Bacillus cereus G9241; identical to SEQ ID NO: 66837

SEQ ID NO: 96573 - DNA, 756 bp, Rubrivivax gelatinosus PM1; identical to SEQ ID NO: 66838
  CDS (1)..(756)

SEQ ID NO: 96574 - protein, 251 aa, Rubrivivax gelatinosus PM1; identical to SEQ ID NO: 66839

SEQ ID NO: 96575 - DNA, 723 bp, Pseudomonas fluorescens PfO-1; identical to SEQ ID NO: 66840
  CDS (1)..(723)

SEQ ID NO: 96576 - protein, 240 aa, Pseudomonas fluorescens PfO-1; identical to SEQ ID NO: 66841

SEQ ID NO: 96577 - DNA, 720 bp, Rhodospirillum rubrum; identical to SEQ ID NO: 66842
  CDS (1)..(720)

SEQ ID NO: 96578 - protein, 239 aa, Rhodospirillum rubrum; identical to SEQ ID NO: 66843

SEQ ID NO: 96579 - DNA, 741 bp, Rhodospirillum rubrum; identical to SEQ ID NO: 66844
  CDS (1)..(741)

SEQ ID NO: 96580 - protein, 246 aa, Rhodospirillum rubrum; identical to SEQ ID NO: 66845

SEQ ID NO: 96581 - DNA, 819 bp, Ralstonia metallidurans CH34; identical to SEQ ID NO: 66846
  CDS (1)..(819)

SEQ ID NO: 96582 - protein, 272 aa, Ralstonia metallidurans CH34; identical to SEQ ID NO: 66847

SEQ ID NO: 96583 - DNA, 756 bp, Enterococcus faecium; identical to SEQ ID NO: 66848
  CDS (1)..(756)

SEQ ID NO: 96584 - protein, 251 aa, Enterococcus faecium; identical to SEQ ID NO: 66849

SEQ ID NO: 96585 - DNA, 768 bp, Magnetococcus sp. MC-1; identical to SEQ ID NO: 66850
  CDS (1)..(768)

SEQ ID NO: 96586 - protein, 255 aa, Magnetococcus sp. MC-1; identical to SEQ ID NO: 66851

SEQ ID NO: 96587 - DNA, 786 bp, Thermobifida fusca; identical to SEQ ID NO: 66852
  CDS (1)..(786)

SEQ ID NO: 96588 - protein, 261 aa, Thermobifida fusca; identical to SEQ ID NO: 66853

SEQ ID NO: 96589 - DNA, 735 bp, Novosphingobium aromaticivorans DSM 12444; identical to SEQ ID NO: 66854
  CDS (1)..(735)

SEQ ID NO: 96590 - protein, 244 aa, Novosphingobium aromaticivorans DSM 12444; identical to SEQ ID NO: 66855

SEQ ID NO: 96591 - DNA, 756 bp, Cytophaga hutchinsonii; identical to SEQ ID NO: 66856
  CDS (1)..(756)

SEQ ID NO: 96592 - protein, 251 aa, Cytophaga hutchinsonii; identical to SEQ ID NO: 66857

SEQ ID NO: 96593 - DNA, 756 bp, Clostridium thermocellum ATCC 27405; identical to SEQ ID NO: 66858
  CDS (1)..(756)

SEQ ID NO: 96594 - protein, 251 aa, Clostridium thermocellum ATCC 27405; identical to SEQ ID NO: 66859

SEQ ID NO: 96595 - DNA, 708 bp, Microbulbifer degradans 2-40; identical to SEQ ID NO: 66860
  CDS (1)..(708)

SEQ ID NO: 96596 - protein, 235 aa, Microbulbifer degradans 2-40; identical to SEQ ID NO: 66861

SEQ ID NO: 96597 - DNA, 756 bp, Microbulbifer degradans 2-40; identical to SEQ ID NO: 66862
  CDS (1)..(756)

SEQ ID NO: 96598 - protein, 251 aa, Microbulbifer degradans 2-40; identical to SEQ ID NO: 66863

SEQ ID NO: 96599 - DNA, 723 bp, Oenococcus oeni PSU-1; identical to SEQ ID NO: 66864
  CDS (1)..(723)

SEQ ID NO: 96600 - protein, 240 aa, Oenococcus oeni PSU-1; identical to SEQ ID NO: 66865

SEQ ID NO: 96601 - DNA, 756 bp, Pediococcus pentosaceus ATCC 25745; identical to SEQ ID NO: 66866
  CDS (1)..(756)

SEQ ID NO: 96602 - protein, 251 aa, Pediococcus pentosaceus ATCC 25745; identical to SEQ ID NO: 66867

SEQ ID NO: 96603 - DNA, 693 bp, Trichodesmium erythraeum IMS101; identical to SEQ ID NO: 66868
  CDS (1)..(693)

SEQ ID NO: 96604 - protein, 230 aa, Trichodesmium erythraeum IMS101; identical to SEQ ID NO: 66869

SEQ ID NO: 96605 - DNA, 717 bp, Moorella thermoacetica ATCC 39073; identical to SEQ ID NO: 66870
  CDS (1)..(717)

SEQ ID NO: 96606 - protein, 238 aa, Moorella thermoacetica ATCC 39073; identical to SEQ ID NO: 66871

SEQ ID NO: 96607 - DNA, 747 bp, Thiobacillus denitrificans ATCC 25259; identical to SEQ ID NO: 66872
  CDS (1)..(747)

SEQ ID NO: 96608 - protein, 248 aa, Thiobacillus denitrificans ATCC 25259; identical to SEQ ID NO: 66873

SEQ ID NO: 96609 - DNA, 741 bp, Silicibacter sp. TM1040; identical to SEQ ID NO: 66874
  CDS (1)..(741)

SEQ ID NO: 96610 - protein, 246 aa, Silicibacter sp. TM1040; identical to SEQ ID NO: 66875

SEQ ID NO: 96611 - DNA, 753 bp, Chloroflexus aurantiacus; identical to SEQ ID NO: 66876
  CDS (1)..(753)

SEQ ID NO: 96612 - protein, 250 aa, Chloroflexus aurantiacus; identical to SEQ ID NO: 66877

SEQ ID NO: 96613 - DNA, 768 bp, Polaromonas sp. JS666; identical to SEQ ID NO: 66878
  CDS (1)..(768)

SEQ ID NO: 96614 - protein, 255 aa, Polaromonas sp. JS666; identical to SEQ ID NO: 66879

SEQ ID NO: 96615 - DNA, 744 bp, Drosophila simulans; identical to SEQ ID NO: 66880
  CDS (1)..(744)

SEQ ID NO: 96616 - protein, 247 aa, Drosophila simulans; identical to SEQ ID NO: 66881

SEQ ID NO: 96617 - DNA, 744 bp, Drosophila yakuba; identical to SEQ ID NO: 66882
  CDS (1)..(744)

SEQ ID NO: 96618 - protein, 247 aa, Drosophila yakuba; identical to SEQ ID NO: 66883

SEQ ID NO: 96619 - DNA, 774 bp, Giardia lamblia; identical to SEQ ID NO: 66884
  CDS (1)..(774)

SEQ ID NO: 96620 - protein, 257 aa, Giardia lamblia; identical to SEQ ID NO: 66885

SEQ ID NO: 96621 - DNA, 1071 bp, Astasia longa; identical to SEQ ID NO: 66886
  CDS (1)..(1071)

SEQ ID NO: 96622 - protein, 356 aa, Astasia longa; identical to SEQ ID NO: 66887

SEQ ID NO: 96623 - DNA, 768 bp, Astasia longa; identical to SEQ ID NO: 66888
  CDS (1)..(768)

SEQ ID NO: 96624 - protein, 255 aa, Astasia longa; identical to SEQ ID NO: 66889

SEQ ID NO: 96625 - DNA, 849 bp, Chlamydomonas reinhardtii; identical to SEQ ID NO: 66890
  CDS (1)..(849)

SEQ ID NO: 96626 - protein, 282 aa, Chlamydomonas reinhardtii; identical to SEQ ID NO: 66891

SEQ ID NO: 96627 - DNA, 924 bp, Porphyra yezoensis; identical to SEQ ID NO: 66892
  CDS (1)..(924)

SEQ ID NO: 96628 - protein, 307 aa, Porphyra yezoensis; identical to SEQ ID NO: 66893

SEQ ID NO: 96629 - DNA, 759 bp, Helicosporidium sp; identical to SEQ ID NO: 66894
  CDS (1)..(759)

SEQ ID NO: 96630 - protein, 252 aa, Helicosporidium sp; identical to SEQ ID NO: 66895

SEQ ID NO: 96631 - DNA, 750 bp, Macaca fascicularis; identical to SEQ ID NO: 66896
  CDS (1)..(750)

SEQ ID NO: 96632 - protein, 249 aa, Macaca fascicularis; identical to SEQ ID NO: 66897

SEQ ID NO: 96633 - DNA, 747 bp, Bombyx mori; identical to SEQ ID NO: 66898
  CDS (1)..(747)

SEQ ID NO: 96634 - protein, 248 aa, Bombyx mori; identical to SEQ ID NO: 66899

SEQ ID NO: 96635 - DNA, 915 bp, Oryza sativa; identical to SEQ ID NO: 66900
  CDS (1)..(915)

SEQ ID NO: 96636 - protein, 304 aa, Oryza sativa; identical to SEQ ID NO: 66901

SEQ ID NO: 96637 - DNA, 762 bp, Glycine max; identical to SEQ ID NO: 66902
  CDS (1)..(762)

SEQ ID NO: 96638 - protein, 253 aa, Glycine max; identical to SEQ ID NO: 66903

SEQ ID NO: 96639 - DNA, 750 bp, Rattus norvegicus; identical to SEQ ID NO: 66904
  CDS (1)..(750)

SEQ ID NO: 96640 - protein, 249 aa, Rattus norvegicus; identical to SEQ ID NO: 66905

SEQ ID NO: 96641 - DNA, 765 bp, Solanum chacoense; identical to SEQ ID NO: 66906
  CDS (1)..(765)

SEQ ID NO: 96642 - protein, 254 aa, Solanum chacoense; identical to SEQ ID NO: 66907

SEQ ID NO: 96643 - DNA, 1074 bp, Euglena gracilis; identical to SEQ ID NO: 66908
  CDS (1)..(1074)

SEQ ID NO: 96644 - protein, 357 aa, Euglena gracilis; identical to SEQ ID NO: 66909

SEQ ID NO: 96645 - DNA, 768 bp, Euglena gracilis; identical to SEQ ID NO: 66910
  CDS (1)..(768)

SEQ ID NO: 96646 - protein, 255 aa, Euglena gracilis; identical to SEQ ID NO: 66911

SEQ ID NO: 96647 - DNA, 798 bp, Klebsiella pneumoniae; identical to SEQ ID NO: 66912
  CDS (1)..(798): s means g or c

SEQ ID NO: 96648 - protein, 265 aa, Klebsiella pneumoniae; identical to SEQ ID NO: 66913
  misc_feature (219)..(219): Xaa can be Thr or Ser or Arg

SEQ ID NO: 96649 - DNA, 747 bp, Brachydanio rerio; identical to SEQ ID NO: 66914
  CDS (1)..(747)

SEQ ID NO: 96650 - protein, 248 aa, Brachydanio rerio; identical to SEQ ID NO: 66915

SEQ ID NO: 96651 - DNA, 747 bp, Xenopus laevis; identical to SEQ ID NO: 66916
  CDS (1)..(747)

SEQ ID NO: 96652 - protein, 248 aa, Xenopus laevis; identical to SEQ ID NO: 66917

SEQ ID NO: 96653 - DNA, 897 bp, Cyanidioschyzon merolae; identical to SEQ ID NO: 66918
  CDS (1)..(897)

SEQ ID NO: 96654 - protein, 298 aa, Cyanidioschyzon merolae; identical to SEQ ID NO: 66919

SEQ ID NO: 96655 - DNA, 774 bp, Dictyostelium discoideum; identical to SEQ ID NO: 66920
  CDS (1)..(774)

SEQ ID NO: 96656 - protein, 257 aa, Dictyostelium discoideum; identical to SEQ ID NO: 66921

SEQ ID NO: 96657 - DNA, 759 bp, Schistosoma japonicum; identical to SEQ ID NO: 66922
  CDS (1)..(759)

SEQ ID NO: 96658 - protein, 252 aa, Schistosoma japonicum; identical to SEQ ID NO: 66923

SEQ ID NO: 96659 - DNA, 744 bp, Tenebrio molitor; identical to SEQ ID NO: 66924
  CDS (1)..(744)

SEQ ID NO: 96660 - protein, 247 aa, Tenebrio molitor; identical to SEQ ID NO: 66925

SEQ ID NO: 96661 - DNA, 756 bp, Leishmania infantum; identical to SEQ ID NO: 66926
  CDS (1)..(756)

SEQ ID NO: 96662 - protein, 251 aa, Leishmania infantum; identical to SEQ ID NO: 66927

SEQ ID NO: 96663 - DNA, 744 bp, Xiphophorus maculatus; identical to SEQ ID NO: 66928
  CDS (1)..(744)

SEQ ID NO: 96664 - protein, 247 aa, Xiphophorus maculatus; identical to SEQ ID NO: 66929

SEQ ID NO: 96665 - DNA, 744 bp, Xiphophorus maculatus; identical to SEQ ID NO: 66930
  CDS (1)..(744)

SEQ ID NO: 96666 - protein, 247 aa, Xiphophorus maculatus; identical to SEQ ID NO: 66931

SEQ ID NO: 96667 - DNA, 747 bp, Brachydanio rerio; identical to SEQ ID NO: 66932
  CDS (1)..(747)

SEQ ID NO: 96668 - protein, 248 aa, Brachydanio rerio; identical to SEQ ID NO: 66933

SEQ ID NO: 96669 - DNA, 750 bp, Acipenser brevirostrum; identical to SEQ ID NO: 66934
  CDS (1)..(750)

SEQ ID NO: 96670 - protein, 249 aa, Acipenser brevirostrum; identical to SEQ ID NO: 66935

SEQ ID NO: 96671 - DNA, 723 bp, Cowdria ruminantium; identical to SEQ ID NO: 66936
  CDS (1)..(723): transl_table=11

SEQ ID NO: 96672 - protein, 240 aa, Cowdria ruminantium; identical to SEQ ID NO: 66937

SEQ ID NO: 96673 - DNA, 762 bp, Triticum aestivum; identical to SEQ ID NO: 66938
  CDS (1)..(762)

SEQ ID NO: 96674 - protein, 253 aa, Triticum aestivum; identical to SEQ ID NO: 66939

SEQ ID NO: 96675 - DNA, 744 bp, Drosophila melanogaster; identical to SEQ ID NO: 66940
  CDS (1)..(744)

SEQ ID NO: 96676 - protein, 247 aa, Drosophila melanogaster; identical to SEQ ID NO: 66941

SEQ ID NO: 96677 - DNA, 765 bp, Brucella melitensis; identical to SEQ ID NO: 66942
  CDS (1)..(765): transl_table=11

SEQ ID NO: 96678 - protein, 254 aa, Brucella melitensis; identical to SEQ ID NO: 66943

SEQ ID NO: 96679 - DNA, 774 bp, Giardia lamblia; identical to SEQ ID NO: 66944
  CDS (1)..(774)

SEQ ID NO: 96680 - protein, 257 aa, Giardia lamblia; identical to SEQ ID NO: 66945

SEQ ID NO: 96681 - DNA, 771 bp, Rhizobium loti; identical to SEQ ID NO: 66946
  CDS (1)..(771)

SEQ ID NO: 96682 - protein, 256 aa, Rhizobium loti; identical to SEQ ID NO: 66947

SEQ ID NO: 96683 - DNA, 771 bp, Brucella suis; identical to SEQ ID NO: 66948
  CDS (1)..(771)

SEQ ID NO: 96684 - protein, 256 aa, Brucella suis; identical to SEQ ID NO: 66949

SEQ ID NO: 96685 - DNA, 774 bp, Giardia lamblia; identical to SEQ ID NO: 66950
  CDS (1)..(774)

SEQ ID NO: 96686 - protein, 257 aa, Giardia lamblia; identical to SEQ ID NO: 66951

SEQ ID NO: 96687 - DNA, 765 bp, Rhizobium loti; identical to SEQ ID NO: 66952
  CDS (1)..(765)

SEQ ID NO: 96688 - protein, 254 aa, Rhizobium loti; identical to SEQ ID NO: 66953

SEQ ID NO: 96689 - DNA, 768 bp, Rhizobium meliloti; identical to SEQ ID NO: 66954
  CDS (1)..(768): transl_table=11

SEQ ID NO: 96690 - protein, 255 aa, Rhizobium meliloti; identical to SEQ ID NO: 66955

SEQ ID NO: 96691 - DNA, 948 bp, Arabidopsis thaliana; identical to SEQ ID NO: 66956
  CDS (1)..(948)

SEQ ID NO: 96692 - protein, 315 aa, Arabidopsis thaliana; identical to SEQ ID NO: 66957

SEQ ID NO: 96693 - DNA, 945 bp, Fragaria ananassa; identical to SEQ ID NO: 66958
  CDS (1)..(945)

SEQ ID NO: 96694 - protein, 314 aa, Fragaria ananassa; identical to SEQ ID NO: 66959

SEQ ID NO: 96695 - DNA, 897 bp, Secale cereale; identical to SEQ ID NO: 66960
  CDS (1)..(897)

SEQ ID NO: 96696 - protein, 298 aa, Secale cereale; identical to SEQ ID NO: 66961

SEQ ID NO: 96697 - DNA, 969 bp, Spinacia oleracea; identical to SEQ ID NO: 66962
  CDS (1)..(969)

SEQ ID NO: 96698 - protein, 322 aa, Spinacia oleracea; identical to SEQ ID NO: 66963

SEQ ID NO: 96699 - DNA, 771 bp, Agrobacterium tumefaciens; identical to SEQ ID NO: 66964
  CDS (1)..(771): transl_table=11

SEQ ID NO: 96700 - protein, 256 aa, Agrobacterium tumefaciens; identical to SEQ ID NO: 66965

SEQ ID NO: 96701 - DNA, 726 bp, Anabaena sp; identical to SEQ ID NO: 66966
  CDS (1)..(726)

SEQ ID NO: 96702 - protein, 241 aa, Anabaena sp; identical to SEQ ID NO: 66967

SEQ ID NO: 96703 - DNA, 744 bp, Aquifex aeolicus; identical to SEQ ID NO: 66968
  CDS (1)..(744): transl_table=11

SEQ ID NO: 96704 - protein, 247 aa, Aquifex aeolicus; identical to SEQ ID NO: 66969

SEQ ID NO: 96705 - DNA, 765 bp, Arabidopsis thaliana; identical to SEQ ID NO: 66970
  CDS (1)..(765)

SEQ ID NO: 96706 - protein, 254 aa, Arabidopsis thaliana; identical to SEQ ID NO: 66971

SEQ ID NO: 96707 - DNA, 747 bp, Ashbya gossypii; identical to SEQ ID NO: 66972
  CDS (1)..(747)

SEQ ID NO: 96708 - protein, 248 aa, Ashbya gossypii; identical to SEQ ID NO: 66973

SEQ ID NO: 96709 - DNA, 756 bp, Aspergillus oryzae; identical to SEQ ID NO: 66974
  CDS (1)..(756)

SEQ ID NO: 96710 - protein, 251 aa, Aspergillus oryzae; identical to SEQ ID NO: 66975

SEQ ID NO: 96711 - DNA, 756 bp, Bacillus megaterium; identical to SEQ ID NO: 66976
  CDS (1)..(756): transl_table=11

SEQ ID NO: 96712 - protein, 251 aa, Bacillus megaterium; identical to SEQ ID NO: 66977

SEQ ID NO: 96713 - DNA, 765 bp, Bartonella henselae; identical to SEQ ID NO: 66978
  CDS (1)..(765): transl_table=11

SEQ ID NO: 96714 - protein, 254 aa, Bartonella henselae; identical to SEQ ID NO: 66979

SEQ ID NO: 96715 - DNA, 804 bp, Bifidobacterium longum; identical to SEQ ID NO: 66980
  CDS (1)..(804): transl_table=11

SEQ ID NO: 96716 - protein, 267 aa, Bifidobacterium longum; identical to SEQ ID NO: 66981

SEQ ID NO: 96717 - DNA, 747 bp, Bordetella bronchiseptica; identical to SEQ ID NO: 66982
  CDS (1)..(747): transl_table=11

SEQ ID NO: 96718 - protein, 248 aa, Bordetella bronchiseptica; identical to SEQ ID NO: 66983

SEQ ID NO: 96719 - DNA, 762 bp, Borrelia burgdorferi; identical to SEQ ID NO: 66984
  CDS (1)..(762): transl_table=11

SEQ ID NO: 96720 - protein, 253 aa, Borrelia burgdorferi; identical to SEQ ID NO: 66985

SEQ ID NO: 96721 - DNA, 756 bp, Bradyrhizobium japonicum; identical to SEQ ID NO: 66986
  CDS (1)..(756)

SEQ ID NO: 96722 - protein, 251 aa, Bradyrhizobium japonicum; identical to SEQ ID NO: 66987

SEQ ID NO: 96723 - DNA, 765 bp, Buchnera aphidicola; identical to SEQ ID NO: 66988
  CDS (1)..(765): transl_table=11

SEQ ID NO: 96724 - protein, 254 aa, Buchnera aphidicola; identical to SEQ ID NO: 66989

SEQ ID NO: 96725 - DNA, 744 bp, Caenorhabditis elegans; identical to SEQ ID NO: 66990
  CDS (1)..(744)

SEQ ID NO: 96726 - protein, 247 aa, Caenorhabditis elegans; identical to SEQ ID NO: 66991

SEQ ID NO: 96727 - DNA, 747 bp, Candida albicans; identical to SEQ ID NO: 66992
  CDS (1)..(747)

SEQ ID NO: 96728 - protein, 248 aa, Candida albicans; identical to SEQ ID NO: 66993

SEQ ID NO: 96729 - DNA, 789 bp, Candidatus Blochmannia floridanus; identical to SEQ ID NO: 66994
  CDS (1)..(789): transl_table=11

SEQ ID NO: 96730 - protein, 262 aa, Candidatus Blochmannia floridanus; identical to SEQ ID NO: 66995

SEQ ID NO: 96731 - DNA, 747 bp, Candida glabrata; identical to SEQ ID NO: 66996
  CDS (1)..(747)

SEQ ID NO: 96732 - protein, 248 aa, Candida glabrata; identical to SEQ ID NO: 66997

SEQ ID NO: 96733 - DNA, 762 bp, Caulobacter crescentus; identical to SEQ ID NO: 66998
  CDS (1)..(762): transl_table=11

SEQ ID NO: 96734 - protein, 253 aa, Caulobacter crescentus; identical to SEQ ID NO: 66999

SEQ ID NO: 96735 - DNA, 765 bp, Chlamydophila caviae; identical to SEQ ID NO: 67000
  CDS (1)..(765): transl_table=11

SEQ ID NO: 96736 - protein, 254 aa, Chlamydophila caviae; identical to SEQ ID NO: 67001

SEQ ID NO: 96737 - DNA, 738 bp, Chlorobium tepidum; identical to SEQ ID NO: 67002
  CDS (1)..(738): transl_table=11

SEQ ID NO: 96738 - protein, 245 aa, Chlorobium tepidum; identical to SEQ ID NO: 67003

SEQ ID NO: 96739 - DNA, 825 bp, Chlamydia trachomatis; identical to SEQ ID NO: 67004
  CDS (1)..(825): transl_table=11

SEQ ID NO: 96740 - protein, 274 aa, Chlamydia trachomatis; identical to SEQ ID NO: 67005

SEQ ID NO: 96741 - DNA, 747 bp, Chromobacterium violaceum; identical to SEQ ID NO: 67006
  CDS (1)..(747): transl_table=11

SEQ ID NO: 96742 - protein, 248 aa, Chromobacterium violaceum; identical to SEQ ID NO: 67007

SEQ ID NO: 96743 - DNA, 747 bp, Clostridium acetobutylicum; identical to SEQ ID NO: 67008
  CDS (1)..(747): transl_table=11

SEQ ID NO: 96744 - protein, 248 aa, Clostridium acetobutylicum; identical to SEQ ID NO: 67009

SEQ ID NO: 96745 - DNA, 747 bp, Clostridium perfringens; identical to SEQ ID NO: 67010
  CDS (1)..(747)

SEQ ID NO: 96746 - protein, 248 aa, Clostridium perfringens; identical to SEQ ID NO: 67011

SEQ ID NO: 96747 - DNA, 768 bp, Clostridium tetani; identical to SEQ ID NO: 67012
  CDS (1)..(768): transl_table=11

SEQ ID NO: 96748 - protein, 255 aa, Clostridium tetani; identical to SEQ ID NO: 67013

SEQ ID NO: 96749 - DNA, 756 bp, Coprinus cinereus; identical to SEQ ID NO: 67014
  CDS (1)..(756)

SEQ ID NO: 96750 - protein, 251 aa, Coprinus cinereus; identical to SEQ ID NO: 67015

SEQ ID NO: 96751 - DNA, 762 bp, Coptis japonica; identical to SEQ ID NO: 67016
  CDS (1)..(762)

SEQ ID NO: 96752 - protein, 253 aa, Coptis japonica; identical to SEQ ID NO: 67017

SEQ ID NO: 96753 - DNA, 789 bp, Corynebacterium efficiens; identical to SEQ ID NO: 67018
  CDS (1)..(789)

SEQ ID NO: 96754 - protein, 262 aa, Corynebacterium efficiens; identical to SEQ ID NO: 67019

SEQ ID NO: 96755 - DNA, 780 bp, Corynebacterium glutamicum; identical to SEQ ID NO: 67020
  CDS (1)..(780): transl_table=11

SEQ ID NO: 96756 - protein, 259 aa, Corynebacterium glutamicum; identical to SEQ ID NO: 67021

SEQ ID NO: 96757 - DNA, 768 bp, Coxiella burnetii; identical to SEQ ID NO: 67022
  CDS (1)..(768): transl_table=11

SEQ ID NO: 96758 - protein, 255 aa, Coxiella burnetii; identical to SEQ ID NO: 67023

SEQ ID NO: 96759 - DNA, 744 bp, Culex tarsalis; identical to SEQ ID NO: 67024
  CDS (1)..(744)

SEQ ID NO: 96760 - protein, 247 aa, Culex tarsalis; identical to SEQ ID NO: 67025

SEQ ID NO: 96761 - DNA, 747 bp, Debaryomyces hansenii; identical to SEQ ID NO: 67026
  CDS (1)..(747)

SEQ ID NO: 96762 - protein, 248 aa, Debaryomyces hansenii; identical to SEQ ID NO: 67027

SEQ ID NO: 96763 - DNA, 744 bp, Drosophila melanogaster; identical to SEQ ID NO: 67028
  CDS (1)..(744)

SEQ ID NO: 96764 - protein, 247 aa, Drosophila melanogaster; identical to SEQ ID NO: 67029

SEQ ID NO: 96765 - DNA, 750 bp, Emericella nidulans; identical to SEQ ID NO: 67030
  CDS (1)..(750)

SEQ ID NO: 96766 - protein, 249 aa, Emericella nidulans; identical to SEQ ID NO: 67031

SEQ ID NO: 96767 - DNA, 768 bp, Enterobacter cloacae; identical to SEQ ID NO: 67032
  CDS (1)..(768): transl_table=11

SEQ ID NO: 96768 - protein, 255 aa, Enterobacter cloacae; identical to SEQ ID NO: 67033

SEQ ID NO: 96769 - DNA, 756 bp, Enterococcus faecalis; identical to SEQ ID NO: 67034
  CDS (1)..(756): transl_table=11

SEQ ID NO: 96770 - protein, 251 aa, Enterococcus faecalis; identical to SEQ ID NO: 67035

SEQ ID NO: 96771 - DNA, 756 bp, Fusobacterium nucleatum; identical to SEQ ID NO: 67036
  CDS (1)..(756): transl_table=11

SEQ ID NO: 96772 - protein, 251 aa, Fusobacterium nucleatum; identical to SEQ ID NO: 67037

SEQ ID NO: 96773 - DNA, 723 bp, Gloeobacter violaceus; identical to SEQ ID NO: 67038
  CDS (1)..(723)

SEQ ID NO: 96774 - protein, 240 aa, Gloeobacter violaceus; identical to SEQ ID NO: 67039

SEQ ID NO: 96775 - DNA, 771 bp, Haemophilus ducreyi; identical to SEQ ID NO: 67040
  CDS (1)..(771): transl_table=11

SEQ ID NO: 96776 - protein, 256 aa, Haemophilus ducreyi; identical to SEQ ID NO: 67041

SEQ ID NO: 96777 - DNA, 708 bp, Helicobacter hepaticus; identical to SEQ ID NO: 67042
  CDS (1)..(708): transl_table=11

SEQ ID NO: 96778 - protein, 235 aa, Helicobacter hepaticus; identical to SEQ ID NO: 67043

SEQ ID NO: 96779 - DNA, 705 bp, Helicobacter pylori J99; identical to SEQ ID NO: 67044
  CDS (1)..(705): transl_table=11

SEQ ID NO: 96780 - protein, 234 aa, Helicobacter pylori J99; identical to SEQ ID NO: 67045

SEQ ID NO: 96781 - DNA, 705 bp, Helicobacter pylori; identical to SEQ ID NO: 67046
  CDS (1)..(705): transl_table=11

SEQ ID NO: 96782 - protein, 234 aa, Helicobacter pylori; identical to SEQ ID NO: 67047

SEQ ID NO: 96783 - DNA, 762 bp, Hordeum vulgare; identical to SEQ ID NO: 67048
  CDS (1)..(762)

SEQ ID NO: 96784 - protein, 253 aa, Hordeum vulgare; identical to SEQ ID NO: 67049

SEQ ID NO: 96785 - DNA, 768 bp, Klebsiella pneumoniae; identical to SEQ ID NO: 67050
  CDS (1)..(768): transl_table=11

SEQ ID NO: 96786 - protein, 255 aa, Klebsiella pneumoniae; identical to SEQ ID NO: 67051

SEQ ID NO: 96787 - DNA, 747 bp, Kluyveromyces lactis; identical to SEQ ID NO: 67052
  CDS (1)..(747)

SEQ ID NO: 96788 - protein, 248 aa, Kluyveromyces lactis; identical to SEQ ID NO: 67053

SEQ ID NO: 96789 - DNA, 747 bp, Kluyveromyces marxianus; identical to SEQ ID NO: 67054
  CDS (1)..(747)

SEQ ID NO: 96790 - protein, 248 aa, Kluyveromyces marxianus; identical to SEQ ID NO: 67055

SEQ ID NO: 96791 - DNA, 759 bp, Lactobacillus delbrueckii; identical to SEQ ID NO: 67056
  CDS (1)..(759): transl_table=11

SEQ ID NO: 96792 - protein, 252 aa, Lactobacillus delbrueckii; identical to SEQ ID NO: 67057

SEQ ID NO: 96793 - DNA, 759 bp, Lactococcus lactis; identical to SEQ ID NO: 66672
  CDS (1)..(759)

SEQ ID NO: 96794 - protein, 252 aa, Lactococcus lactis; identical to SEQ ID NO: 66673

SEQ ID NO: 96795 - DNA, 756 bp, Leishmania mexicana; identical to SEQ ID NO: 67060
  CDS (1)..(756)

SEQ ID NO: 96796 - protein, 251 aa, Leishmania mexicana; identical to SEQ ID NO: 67061

SEQ ID NO: 96797 - DNA, 1141 bp, Zea mays; identical to SEQ ID NO: 67062
  CDS (83)..(844)

SEQ ID NO: 96798 - protein, 253 aa, Zea mays; identical to SEQ ID NO: 67063

SEQ ID NO: 96799 - DNA, 810 bp, Moraxella sp; identical to SEQ ID NO: 67064
  CDS (1)..(810): transl_table=11

SEQ ID NO: 96800 - protein, 269 aa, Moraxella sp; identical to SEQ ID NO: 67065

SEQ ID NO: 96801 - DNA, 735 bp, Mycoplasma genitalium; identical to SEQ ID NO: 67066
  CDS (1)..(735): transl_table=4

SEQ ID NO: 96802 - protein, 244 aa, Mycoplasma genitalium; identical to SEQ ID NO: 67067

SEQ ID NO: 96803 - DNA, 729 bp, Mycoplasma hyopneumoniae; identical to SEQ ID NO: 67068
  CDS (1)..(729): transl_table=4

SEQ ID NO: 96804 - protein, 242 aa, Mycoplasma hyopneumoniae; identical to SEQ ID NO: 67069

SEQ ID NO: 96805 - DNA, 786 bp, Mycobacterium leprae; identical to SEQ ID NO: 67070
  CDS (1)..(786): transl_table=11

SEQ ID NO: 96806 - protein, 261 aa, Mycobacterium leprae; identical to SEQ ID NO: 67071

SEQ ID NO: 96807 - DNA, 753 bp, Mycoplasma penetrans; identical to SEQ ID NO: 67072
  CDS (31)..(234)

SEQ ID NO: 96808 - protein, 67 aa, Mycoplasma penetrans; identical to SEQ ID NO: 67073

SEQ ID NO: 96809 - DNA, 747 bp, Mycoplasma pulmonis; identical to SEQ ID NO: 67074
  CDS (1)..(747): transl_table=4

SEQ ID NO: 96810 - protein, 248 aa, Mycoplasma pulmonis; identical to SEQ ID NO: 67075

SEQ ID NO: 96811 - DNA, 756 bp, Neisseria meningitidis; identical to SEQ ID NO: 67076
  CDS (1)..(756): transl_table=11

SEQ ID NO: 96812 - protein, 251 aa, Neisseria meningitidis; identical to SEQ ID NO: 67077

SEQ ID NO: 96813 - DNA, 747 bp, Neurospora crassa; identical to SEQ ID NO: 67078
  CDS (1)..(747)

SEQ ID NO: 96814 - protein, 248 aa, Neurospora crassa; identical to SEQ ID NO: 67079

SEQ ID NO: 96815 - DNA, 759 bp, Nitrosomonas europaea; identical to SEQ ID NO: 67080
  CDS (1)..(759): transl_table=11

SEQ ID NO: 96816 - protein, 252 aa, Nitrosomonas europaea; identical to SEQ ID NO: 67081

SEQ ID NO: 96817 - DNA, 759 bp, Oceanobacillus iheyensis; identical to SEQ ID NO: 67082
  CDS (1)..(759)

SEQ ID NO: 96818 - protein, 252 aa, Oceanobacillus iheyensis; identical to SEQ ID NO: 67083

SEQ ID NO: 96819 - DNA, 762 bp, Oryza sativa; identical to SEQ ID NO: 67084
  CDS (1)..(762)

SEQ ID NO: 96820 - protein, 253 aa, Oryza sativa; identical to SEQ ID NO: 67085

SEQ ID NO: 96821 - DNA, 750 bp, Paracoccidioides brasiliensis; identical to SEQ ID NO: 67086
  CDS (1)..(750)

SEQ ID NO: 96822 - protein, 249 aa, Paracoccidioides brasiliensis; identical to SEQ ID NO: 67087

SEQ ID NO: 96823 - DNA, 786 bp, Pasteurella multocida; identical to SEQ ID NO: 67088
  CDS (1)..(786): transl_table=11

SEQ ID NO: 96824 - protein, 261 aa, Pasteurella multocida; identical to SEQ ID NO: 67089

SEQ ID NO: 96825 - DNA, 765 bp, Petunia hybrida; identical to SEQ ID NO: 67090
  CDS (1)..(765)

SEQ ID NO: 96826 - protein, 254 aa, Petunia hybrida; identical to SEQ ID NO: 67091

SEQ ID NO: 96827 - DNA, 768 bp, Photorhabdus luminescens; identical to SEQ ID NO: 67092
  CDS (1)..(768): transl_table=11

SEQ ID NO: 96828 - protein, 255 aa, Photorhabdus luminescens; identical to SEQ ID NO: 67093

SEQ ID NO: 96829 - DNA, 747 bp, Plasmodium falciparum; identical to SEQ ID NO: 67094
  CDS (1)..(747)

SEQ ID NO: 96830 - protein, 248 aa, Plasmodium falciparum; identical to SEQ ID NO: 67095

SEQ ID NO: 96831 - DNA, 756 bp, Porphyromonas gingivalis; identical to SEQ ID NO: 67096
  CDS (1)..(756): transl_table=11

SEQ ID NO: 96832 - protein, 251 aa, Porphyromonas gingivalis; identical to SEQ ID NO: 67097

SEQ ID NO: 96833 - DNA, 732 bp, Prochlorococcus marinus; identical to SEQ ID NO: 67098
  CDS (1)..(732): transl_table=11

SEQ ID NO: 96834 - protein, 243 aa, Prochlorococcus marinus; identical to SEQ ID NO: 67099

SEQ ID NO: 96835 - DNA, 756 bp, Pseudomonas aeruginosa; identical to SEQ ID NO: 67100
  CDS (1)..(756): transl_table=11

SEQ ID NO: 96836 - protein, 251 aa, Pseudomonas aeruginosa; identical to SEQ ID NO: 67101

SEQ ID NO: 96837 - DNA, 756 bp, Pseudomonas putida; identical to SEQ ID NO: 67102
  CDS (1)..(756): transl_table=11

SEQ ID NO: 96838 - protein, 251 aa, Pseudomonas putida; identical to SEQ ID NO: 67103

SEQ ID NO: 96839 - DNA, 756 bp, Pseudomonas syringae; identical to SEQ ID NO: 67104
  CDS (1)..(756): transl_table=11

SEQ ID NO: 96840 - protein, 251 aa, Pseudomonas syringae; identical to SEQ ID NO: 67105

SEQ ID NO: 96841 - DNA, 756 bp, Pseudomonas syringae; identical to SEQ ID NO: 67106
  CDS (1)..(756): transl_table=11

SEQ ID NO: 96842 - protein, 251 aa, Pseudomonas syringae; identical to SEQ ID NO: 67107

SEQ ID NO: 96843 - DNA, 765 bp, Rhodopirellula baltica; identical to SEQ ID NO: 67108
  CDS (1)..(765): transl_table=11

SEQ ID NO: 96844 - protein, 254 aa, Rhodopirellula baltica; identical to SEQ ID NO: 67109

SEQ ID NO: 96845 - DNA, 768 bp, Salmonella typhimurium; identical to SEQ ID NO: 67110
  CDS (1)..(768): transl_table=11

SEQ ID NO: 96846 - protein, 255 aa, Salmonella typhimurium; identical to SEQ ID NO: 67111

SEQ ID NO: 96847 - DNA, 759 bp, Schistosoma japonicum; identical to SEQ ID NO: 67112
  CDS (1)..(759)

SEQ ID NO: 96848 - protein, 252 aa, Schistosoma japonicum; identical to SEQ ID NO: 67113

SEQ ID NO: 96849 - DNA, 762 bp, Schistosoma mansoni; identical to SEQ ID NO: 67114
  CDS (1)..(762)

SEQ ID NO: 96850 - protein, 253 aa, Schistosoma mansoni; identical to SEQ ID NO: 67115

SEQ ID NO: 96851 - DNA, 1033 bp, Secale cereale; identical to SEQ ID NO: 67116
  CDS (55)..(816)

SEQ ID NO: 96852 - protein, 253 aa, Secale cereale; identical to SEQ ID NO: 67117

SEQ ID NO: 96853 - DNA, 783 bp, Shewanella oneidensis; identical to SEQ ID NO: 67118
  CDS (1)..(783): transl_table=11

SEQ ID NO: 96854 - protein, 260 aa, Shewanella oneidensis; identical to SEQ ID NO: 67119

SEQ ID NO: 96855 - DNA, 762 bp, Staphylococcus aureus; identical to SEQ ID NO: 67120
  CDS (1)..(762): transl_table=11

SEQ ID NO: 96856 - protein, 253 aa, Staphylococcus aureus; identical to SEQ ID NO: 67121

SEQ ID NO: 96857 - DNA, 774 bp, Stellaria longipes; identical to SEQ ID NO: 67122
  CDS (1)..(774)

SEQ ID NO: 96858 - protein, 257 aa, Stellaria longipes; identical to SEQ ID NO: 67123

SEQ ID NO: 96859 - DNA, 798 bp, Synechococcus elongatus; identical to SEQ ID NO: 67124
  CDS (1)..(798)

SEQ ID NO: 96860 - protein, 265 aa, Synechococcus elongatus; identical to SEQ ID NO: 67125

SEQ ID NO: 96861 - DNA, 732 bp, Synechococcus sp; identical to SEQ ID NO: 67126
  CDS (1)..(732): transl_table=11

SEQ ID NO: 96862 - protein, 243 aa, Synechococcus sp; identical to SEQ ID NO: 67127

SEQ ID NO: 96863 - DNA, 729 bp, Synechocystis sp; identical to SEQ ID NO: 67128
  CDS (1)..(729)

SEQ ID NO: 96864 - protein, 242 aa, Synechocystis sp; identical to SEQ ID NO: 67129

SEQ ID NO: 96865 - DNA, 753 bp, Taenia solium; identical to SEQ ID NO: 67130
  CDS (1)..(753)

SEQ ID NO: 96866 - protein, 250 aa, Taenia solium; identical to SEQ ID NO: 67131

SEQ ID NO: 96867 - DNA, 747 bp, Thermoanaerobacter tengcongensis; identical to SEQ ID NO: 67132
  CDS (1)..(747): transl_table=11

SEQ ID NO: 96868 - protein, 248 aa, Thermoanaerobacter tengcongensis; identical to SEQ ID NO: 67133

SEQ ID NO: 96869 - DNA, 750 bp, Treponema pallidum; identical to SEQ ID NO: 67134
  CDS (1)..(750): transl_table=11

SEQ ID NO: 96870 - protein, 249 aa, Treponema pallidum; identical to SEQ ID NO: 67135

SEQ ID NO: 96871 - DNA, 756 bp, Trypanosoma cruzi; identical to SEQ ID NO: 67136
  CDS (1)..(756)

SEQ ID NO: 96872 - protein, 251 aa, Trypanosoma cruzi; identical to SEQ ID NO: 67137

SEQ ID NO: 96873 - DNA, 774 bp, Vibrio cholerae; identical to SEQ ID NO: 67138
  CDS (1)..(774)

SEQ ID NO: 96874 - protein, 257 aa, Vibrio cholerae; identical to SEQ ID NO: 67139

SEQ ID NO: 96875 - DNA, 771 bp, Vibrio marinus; identical to SEQ ID NO: 67140
  CDS (1)..(771): transl_table=11

SEQ ID NO: 96876 - protein, 256 aa, Vibrio marinus; identical to SEQ ID NO: 67141

SEQ ID NO: 96877 - DNA, 771 bp, Wigglesworthia glossinidia brevipalpis; identical to SEQ ID NO: 67142
  CDS (1)..(771)

SEQ ID NO: 96878 - protein, 256 aa, Wigglesworthia glossinidia brevipalpis; identical to SEQ ID NO: 67143

SEQ ID NO: 96879 - DNA, 699 bp, Wolinella succinogenes; identical to SEQ ID NO: 67144
  CDS (1)..(699): transl_table=11

SEQ ID NO: 96880 - protein, 232 aa, Wolinella succinogenes; identical to SEQ ID NO: 67145

SEQ ID NO: 96881 - DNA, 756 bp, Xanthomonas axonopodis; identical to SEQ ID NO: 67146
  CDS (1)..(756): transl_table=11

SEQ ID NO: 96882 - protein, 251 aa, Xanthomonas axonopodis; identical to SEQ ID NO: 67147

SEQ ID NO: 96883 - DNA, 750 bp, Xanthobacter flavus; identical to SEQ ID NO: 67148
  CDS (1)..(750): transl_table=11

SEQ ID NO: 96884 - protein, 249 aa, Xanthobacter flavus; identical to SEQ ID NO: 67149

SEQ ID NO: 96885 - DNA, 744 bp, Yarrowia lipolytica; identical to SEQ ID NO: 67150
  CDS (1)..(744)

SEQ ID NO: 96886 - protein, 247 aa, Yarrowia lipolytica; identical to SEQ ID NO: 67151

SEQ ID NO: 96887 - DNA, 768 bp, Yersinia pestis; identical to SEQ ID NO: 67152
  CDS (1)..(768): transl_table=11

SEQ ID NO: 96888 - protein, 255 aa, Yersinia pestis; identical to SEQ ID NO: 67153

SEQ ID NO: 96889 - DNA, 747 bp, Zygosaccharomyces bailii; identical to SEQ ID NO: 67154
  CDS (1)..(747)

SEQ ID NO: 96890 - protein, 248 aa, Zygosaccharomyces bailii; identical to SEQ ID NO: 67155

SEQ ID NO: 96891 - DNA, 23 bp, Primer
atgcgacatcctttagtgatggg

SEQ ID NO: 96892 - DNA, 23 bp, Primer
ttaagcctgtttagccgcttctg

SEQ ID NO: 96893 - protein, 264 aa, consensus; identical to SEQ ID NO: 67158
  MISC_FEATURE (1)..(264): consensus for the disclosure of xaa see table XV

SEQ ID NO: 96894 - protein, 138 aa, consensus; identical to SEQ ID NO: 67159
  MISC_FEATURE (1)..(138): consensus for the disclosure of xaa see table XV

SEQ ID NO: 96895 - protein, 79 aa, consensus; identical to SEQ ID NO: 67160
  MISC_FEATURE (1)..(79): consensus for the disclosure of xaa see table XV

SEQ ID NO: 96896 - DNA, 1659 bp, Escherichia coli; identical to SEQ ID NO: 67932
  CDS (1)..(1659)

SEQ ID NO: 96897 - protein, 552 aa, Escherichia coli; identical to SEQ ID NO: 67933

SEQ ID NO: 96898 - DNA, 1980 bp, Gluconobacter oxydans 621H; identical to SEQ ID NO: 67934
  CDS (1)..(1980)

SEQ ID NO: 96899 - protein, 659 aa, Gluconobacter oxydans 621H; identical to SEQ ID NO: 67935

SEQ ID NO: 96900 - DNA, 1989 bp, Wolbachia endosymbiont strain TRS of Brugia malayi; identical to SEQ ID NO: 67936
  CDS (1)..(1989)

SEQ ID NO: 96901 - protein, 662 aa, Wolbachia endosymbiont strain TRS of Brugia malayi; identical to SEQ ID NO: 67937

SEQ ID NO: 96902 - DNA, 1914 bp, Reclinomonas americana; identical to SEQ ID NO: 67938
  CDS (1)..(1914)

SEQ ID NO: 96903 - protein, 637 aa, Reclinomonas americana; identical to SEQ ID NO: 67939

SEQ ID NO: 96904 - DNA, 1863 bp, Cyanidioschyzon merolae; identical to SEQ ID NO: 67940
  CDS (1)..(1863)

SEQ ID NO: 96905 - protein, 620 aa, Cyanidioschyzon merolae; identical to SEQ ID NO: 67941

SEQ ID NO: 96906 - DNA, 1851 bp, Malawimonas jakobiformis; identical to SEQ ID NO: 67942
  CDS (1)..(1851)

SEQ ID NO: 96907 - protein, 616 aa, Malawimonas jakobiformis; identical to SEQ ID NO: 67943

SEQ ID NO: 96908 - DNA, 1512 bp, Archaeoglobus fulgidus DSM 4304; identical to SEQ ID NO: 67944
  CDS (1)..(1512): transl_table=11

SEQ ID NO: 96909 - protein, 503 aa, Archaeoglobus fulgidus DSM 4304; identical to SEQ ID NO: 67945

SEQ ID NO: 96910 - DNA, 1992 bp, Mesorhizobium loti MAFF303099; identical to SEQ ID NO: 67946
  CDS (1)..(1992): transl_table=11

SEQ ID NO: 96911 - protein, 663 aa, Mesorhizobium loti MAFF303099; identical to SEQ ID NO: 67947

SEQ ID NO: 96912 - DNA, 3000 bp, Aeropyrum pernix K1; identical to SEQ ID NO: 67948
  CDS (1)..(3000): transl_table=11

SEQ ID NO: 96913 - protein, 999 aa, Aeropyrum pernix K1; identical to SEQ ID NO: 67949

SEQ ID NO: 96914 - DNA, 1956 bp, Vibrio cholerae O1 biovar eltor str. N16961; identical to SEQ ID NO: 67950
  CDS (1)..(1956): transl_table=11

SEQ ID NO: 96915 - protein, 651 aa, Vibrio cholerae O1 biovar eltor str. N16961; identical to SEQ ID NO: 67951

SEQ ID NO: 96916 - DNA, 1926 bp, Pasteurella multocida subsp. multocida str. Pm70; identical to SEQ ID NO: 67952
  CDS (1)..(1926): transl_table=11

SEQ ID NO: 96917 - protein, 641 aa, Pasteurella multocida subsp. multocida str. Pm70; identical to SEQ ID NO: 67953

SEQ ID NO: 96918 - DNA, 1995 bp, Deinococcus radiodurans R1; identical to SEQ ID NO: 67954
  CDS (1)..(1995): transl_table=11

SEQ ID NO: 96919 - protein, 664 aa, Deinococcus radiodurans R1; identical to SEQ ID NO: 67955

SEQ ID NO: 96920 - DNA, 1941 bp, Xylella fastidiosa 9a5c; identical to SEQ ID NO: 67956
  CDS (1)..(1941): transl_table=11

SEQ ID NO: 96921 - protein, 646 aa, Xylella fastidiosa 9a5c; identical to SEQ ID NO: 67957

SEQ ID NO: 96922 - DNA, 1989 bp, Rickettsia conorii str. Malish 7; identical to SEQ ID NO: 67958
  CDS (1)..(1989): transl_table=11

SEQ ID NO: 96923 - protein, 662 aa, Rickettsia conorii str. Malish 7; identical to SEQ ID NO: 67959

SEQ ID NO: 96924 - DNA, 1983 bp, Caulobacter crescentus CB15; identical to SEQ ID NO: 67960
  CDS (1)..(1983): transl_table=11

SEQ ID NO: 96925 - protein, 660 aa, Caulobacter crescentus CB15; identical to SEQ ID NO: 67961

SEQ ID NO: 96926 - DNA, 1932 bp, Salmonella typhimurium LT2; identical to SEQ ID NO: 67962
  CDS (1)..(1932): transl_table=11

SEQ ID NO: 96927 - protein, 643 aa, Salmonella typhimurium LT2; identical to SEQ ID NO: 67963

SEQ ID NO: 96928 - DNA, 2223 bp, Salmonella typhimurium LT2; identical to SEQ ID NO: 67964
  CDS (1)..(2223): transl_table=11

SEQ ID NO: 96929 - protein, 740 aa, Salmonella typhimurium LT2; identical to SEQ ID NO: 67965

SEQ ID NO: 96930 - DNA, 1992 bp, Agrobacterium tumefaciens str. C58; identical to SEQ ID NO: 67966
  CDS (1)..(1992): transl_table=11

SEQ ID NO: 96931 - protein, 663 aa, Agrobacterium tumefaciens str. C58; identical to SEQ ID NO: 67967

SEQ ID NO: 96932 - DNA, 1992 bp, Brucella melitensis 16M; identical to SEQ ID NO: 67968
  CDS (1)..(1992)

SEQ ID NO: 96933 - protein, 663 aa, Brucella melitensis 16M; identical to SEQ ID NO: 67969

SEQ ID NO: 96934 - DNA, 2109 bp, Pyrobaculum aerophilum str. IM2; identical to SEQ ID NO: 67970
  CDS (1)..(2109): transl_table=11

SEQ ID NO: 96935 - protein, 702 aa, Pyrobaculum aerophilum str. IM2; identical to SEQ ID NO: 67971

SEQ ID NO: 96936 - DNA, 1998 bp, Xanthomonas campestris pv. campestris str. ATCC 33913; identical to SEQ ID NO: 67972
  CDS (1)..(1998): transl_table=11

SEQ ID NO: 96937 - protein, 665 aa, Xanthomonas campestris pv. campestris str. ATCC 33913; identical to SEQ ID NO: 67973

SEQ ID NO: 96938 - DNA, 1938 bp, Xanthomonas campestris pv. campestris str. ATCC 33913; identical to SEQ ID NO: 67974
  CDS (1)..(1938): transl_table=11

SEQ ID NO: 96939 - protein, 645 aa, Xanthomonas campestris pv. campestris str. ATCC 33913; identical to SEQ ID NO: 67975

SEQ ID NO: 96940 - DNA, 1938 bp, Xanthomonas axonopodis pv. citri str. 306; identical to SEQ ID NO: 67976
  CDS (1)..(1938): transl_table=11

SEQ ID NO: 96941 - protein, 645 aa, Xanthomonas axonopodis pv. citri str. 306; identical to SEQ ID NO: 67977

SEQ ID NO: 96942 - DNA, 1971 bp, Yersinia pestis KIM; identical to SEQ ID NO: 67978
  CDS (1)..(1971): transl_table=11

SEQ ID NO: 96943 - protein, 656 aa, Yersinia pestis KIM; identical to SEQ ID NO: 67979

SEQ ID NO: 96944 - DNA, 1980 bp, Shewanella oneidensis MR-1; identical to SEQ ID NO: 67980
  CDS (1)..(1980): transl_table=11

SEQ ID NO: 96945 - protein, 659 aa, Shewanella oneidensis MR-1; identical to SEQ ID NO: 67981

SEQ ID NO: 96946 - DNA, 2058 bp, Shewanella oneidensis MR-1; identical to SEQ ID NO: 67982
  CDS (1)..(2058): transl_table=11

SEQ ID NO: 96947 - protein, 685 aa, Shewanella oneidensis MR-1; identical to SEQ ID NO: 67983

SEQ ID NO: 96948 - DNA, 1989 bp, Pseudomonas putida KT2440; identical to SEQ ID NO: 67984
  CDS (1)..(1989): transl_table=11

SEQ ID NO: 96949 - protein, 662 aa, Pseudomonas putida KT2440; identical to SEQ ID NO: 67985

SEQ ID NO: 96950 - DNA, 1683 bp, Escherichia coli CFT073; identical to SEQ ID NO: 67986
  CDS (1)..(1683): transl_table=11

SEQ ID NO: 96951 - protein, 560 aa, Escherichia coli CFT073; identical to SEQ ID NO: 67987

SEQ ID NO: 96952 - DNA, 2052 bp, Nitrosomonas europaea ATCC 19718; identical to SEQ ID NO: 67988
  CDS (1)..(2052): transl_table=11

SEQ ID NO: 96953 - protein, 683 aa, Nitrosomonas europaea ATCC 19718; identical to SEQ ID NO: 67989

SEQ ID NO: 96954 - DNA, 1995 bp, Bordetella parapertussis 12822; identical to SEQ ID NO: 67990
  CDS (1)..(1995): transl_table=11

SEQ ID NO: 96955 - protein, 664 aa, Bordetella parapertussis 12822; identical to SEQ ID NO: 67991

SEQ ID NO: 96956 - DNA, 2016 bp, Cupriavidus necator; identical to SEQ ID NO: 67992
  CDS (1)..(2016): transl_table=11

SEQ ID NO: 96957 - protein, 671 aa, Cupriavidus necator; identical to SEQ ID NO: 67993

SEQ ID NO: 96958 - DNA, 2001 bp, Chara vulgaris; identical to SEQ ID NO: 67994
  CDS (1)..(2001)

SEQ ID NO: 96959 - protein, 666 aa, Chara vulgaris; identical to SEQ ID NO: 67995

SEQ ID NO: 96960 - DNA, 1983 bp, Rhodopseudomonas palustris CGA009; identical to SEQ ID NO: 67996
  CDS (1)..(1983): transl_table=11

SEQ ID NO: 96961 - protein, 660 aa, Rhodopseudomonas palustris CGA009; identical to SEQ ID NO: 67997

SEQ ID NO: 96962 - DNA, 2190 bp, Leptospira interrogans serovar Copenhageni str. Fiocruz L1-130; identical to SEQ ID NO: 67998
  CDS (1)..(2190): transl_table=11

SEQ ID NO: 96963 - protein, 729 aa, Leptospira interrogans serovar Copenhageni str. Fiocruz L1-130; identical to SEQ ID NO: 67999

SEQ ID NO: 96964 - DNA, 1932 bp, Thermus thermophilus HB27; identical to SEQ ID NO: 68000
  CDS (1)..(1932): transl_table=11

SEQ ID NO: 96965 - protein, 643 aa, Thermus thermophilus HB27; identical to SEQ ID NO: 68001

SEQ ID NO: 96966 - DNA, 1896 bp, Desulfovibrio vulgaris subsp. vulgaris str. Hildenborough; identical to SEQ ID NO: 68002
  CDS (1)..(1896): transl_table=11

SEQ ID NO: 96967 - protein, 631 aa, Desulfovibrio vulgaris subsp. vulgaris str. Hildenborough; identical to SEQ ID NO: 68003

SEQ ID NO: 96968 - DNA, 1989 bp, Bartonella quintana str. Toulouse; identical to SEQ ID NO: 68004
  CDS (1)..(1989): transl_table=11

SEQ ID NO: 96969 - protein, 662 aa, Bartonella quintana str. Toulouse; identical to SEQ ID NO: 68005

SEQ ID NO: 96970 - DNA, 1986 bp, Bartonella henselae str. Houston-1; identical to SEQ ID NO: 68006
  CDS (1)..(1986): transl_table=11

SEQ ID NO: 96971 - protein, 661 aa, Bartonella henselae str. Houston-1; identical to SEQ ID NO: 68007

SEQ ID NO: 96972 - DNA, 1878 bp, Erwinia carotovora subsp. atroseptica SCRI1043; identical to SEQ ID NO: 68008
  CDS (1)..(1878)

SEQ ID NO: 96973 - protein, 625 aa, Erwinia carotovora subsp. atroseptica SCRI1043; identical to SEQ ID NO: 68009

SEQ ID NO: 96974 - DNA, 1956 bp, Erwinia carotovora subsp. atroseptica SCRI1043; identical to SEQ ID NO: 68010
  CDS (1)..(1956)

SEQ ID NO: 96975 - protein, 651 aa, Erwinia carotovora subsp. atroseptica SCRI1043; identical to SEQ ID NO: 68011

SEQ ID NO: 96976 - DNA, 1947 bp, Mannheimia succiniciproducens MBEL55E; identical to SEQ ID NO: 68012
  CDS (1)..(1947): transl_table=11

SEQ ID NO: 96977 - protein, 648 aa, Mannheimia succiniciproducens MBEL55E; identical to SEQ ID NO: 68013

SEQ ID NO: 96978 - DNA, 1935 bp, Mannheimia succiniciproducens MBEL55E; identical to SEQ ID NO: 68014
  CDS (1)..(1935): transl_table=11

SEQ ID NO: 96979 - protein, 644 aa, Mannheimia succiniciproducens MBEL55E; identical to SEQ ID NO: 68015

SEQ ID NO: 96980 - DNA, 1953 bp, Legionella pneumophila subsp. pneumophila str. Philadelphia 1; identical to SEQ ID NO: 68016
  CDS (1)..(1953): transl_table=11

SEQ ID NO: 96981 - protein, 650 aa, Legionella pneumophila subsp. pneumophila str. Philadelphia 1; identical to SEQ ID NO: 68017

SEQ ID NO: 96982 - DNA, 1974 bp, Methylococcus capsulatus str. Bath; identical to SEQ ID NO: 68018
  CDS (1)..(1974): transl_table=11

SEQ ID NO: 96983 - protein, 657 aa, Methylococcus capsulatus str. Bath; identical to SEQ ID NO: 68019

SEQ ID NO: 96984 - DNA, 2049 bp, Photobacterium profundum SS9; identical to SEQ ID NO: 68020
  CDS (1)..(2049): transl_table=11

SEQ ID NO: 96985 - protein, 682 aa, Photobacterium profundum SS9; identical to SEQ ID NO: 68021

SEQ ID NO: 96986 - DNA, 2367 bp, Haloarcula marismortui ATCC 43049; identical to SEQ ID NO: 68022
  CDS (1)..(2367): transl_table=11

SEQ ID NO: 96987 - protein, 788 aa, Haloarcula marismortui ATCC 43049; identical to SEQ ID NO: 68023

SEQ ID NO: 96988 - DNA, 1923 bp, Anaplasma marginale str. St. Maries; identical to SEQ ID NO: 68024
  CDS (1)..(1923): transl_table=11

SEQ ID NO: 96989 - protein, 640 aa, Anaplasma marginale str. St. Maries; identical to SEQ ID NO: 68025

SEQ ID NO: 96990 - DNA, 1956 bp, Idiomarina loihiensis L2TR; identical to SEQ ID NO: 68026
  CDS (1)..(1956): transl_table=11

SEQ ID NO: 96991 - protein, 651 aa, Idiomarina loihiensis L2TR; identical to SEQ ID NO: 68027

SEQ ID NO: 96992 - DNA, 2142 bp, Azoarcus sp. EbN1; identical to SEQ ID NO: 68028
  CDS (1)..(2142): transl_table=11

SEQ ID NO: 96993 - protein, 713 aa, Azoarcus sp. EbN1; identical to SEQ ID NO: 68029

SEQ ID NO: 96994 - DNA, 1974 bp, Azoarcus sp. EbN1; identical to SEQ ID NO: 68030
  CDS (1)..(1974): transl_table=11

SEQ ID NO: 96995 - protein, 657 aa, Azoarcus sp. EbN1; identical to SEQ ID NO: 68031

SEQ ID NO: 96996 - DNA, 1947 bp, Zymomonas mobilis subsp. mobilis ZM4; identical to SEQ ID NO: 68032
  CDS (1)..(1947): transl_table=11

SEQ ID NO: 96997 - protein, 648 aa, Zymomonas mobilis subsp. mobilis ZM4; identical to SEQ ID NO: 68033

SEQ ID NO: 96998 - DNA, 2001 bp, Silicibacter pomeroyi DSS-3; identical to SEQ ID NO: 68034
  CDS (1)..(2001): transl_table=11

SEQ ID NO: 96999 - protein, 666 aa, Silicibacter pomeroyi DSS-3; identical to SEQ ID NO: 68035

SEQ ID NO: 97000 - DNA, 1965 bp, Silicibacter pomeroyi DSS-3; identical to SEQ ID NO: 68036
  CDS (1)..(1965): transl_table=11

SEQ ID NO: 97001 - protein, 654 aa, Silicibacter pomeroyi DSS-3; identical to SEQ ID NO: 68037

SEQ ID NO: 97002 - DNA, 1971 bp, Rhodobacter sphaeroides 2.4.1; identical to SEQ ID NO: 68038
  CDS (1)..(1971)

SEQ ID NO: 97003 - protein, 656 aa, Rhodobacter sphaeroides 2.4.1; identical to SEQ ID NO: 68039

SEQ ID NO: 97004 - DNA, 1941 bp, Xylella fastidiosa Dixon; identical to SEQ ID NO: 68040
  CDS (1)..(1941)

SEQ ID NO: 97005 - protein, 646 aa, Xylella fastidiosa Dixon; identical to SEQ ID NO: 68041

SEQ ID NO: 97006 - DNA, 1917 bp, Actinobacillus pleuropneumoniae serovar 1 str. 4074; identical to SEQ ID NO: 68042
  CDS (1)..(1917)

SEQ ID NO: 97007 - protein, 638 aa, Actinobacillus pleuropneumoniae serovar 1 str. 4074; identical to SEQ ID NO: 68043

SEQ ID NO: 97008 - DNA, 1974 bp, Pseudomonas aeruginosa UCBPP-PA14; identical to SEQ ID NO: 68044
  CDS (1)..(1974)

SEQ ID NO: 97009 - protein, 657 aa, Pseudomonas aeruginosa UCBPP-PA14; identical to SEQ ID NO: 68045

SEQ ID NO: 97010 - DNA, 1659 bp, Rickettsia sibirica 246; identical to SEQ ID NO: 68046
  CDS (1)..(1659): transl_table=11

SEQ ID NO: 97011 - protein, 552 aa, Rickettsia sibirica 246; identical to SEQ ID NO: 68047

SEQ ID NO: 97012 - DNA, 2046 bp, Psychrobacter sp. 273-4; identical to SEQ ID NO: 68048
  CDS (1)..(2046)

SEQ ID NO: 97013 - protein, 681 aa, Psychrobacter sp. 273-4; identical to SEQ ID NO: 68049

SEQ ID NO: 97014 - DNA, 1995 bp, Dechloromonas aromatica RCB; identical to SEQ ID NO: 68050
  CDS (1)..(1995)

SEQ ID NO: 97015 - protein, 664 aa, Dechloromonas aromatica RCB; identical to SEQ ID NO: 68051

SEQ ID NO: 97016 - DNA, 1989 bp, Mesorhizobium sp. BNC1; identical to SEQ ID NO: 68052
  CDS (1)..(1989)

SEQ ID NO: 97017 - protein, 662 aa, Mesorhizobium sp. BNC1; identical to SEQ ID NO: 68053

SEQ ID NO: 97018 - DNA, 1908 bp, Haemophilus influenzae R2866; identical to SEQ ID NO: 68054
  CDS (1)..(1908)

SEQ ID NO: 97019 - protein, 635 aa, Haemophilus influenzae R2866; identical to SEQ ID NO: 68055

SEQ ID NO: 97020 - DNA, 1935 bp, Ehrlichia canis str. Jake; identical to SEQ ID NO: 68056
  CDS (1)..(1935)

SEQ ID NO: 97021 - protein, 644 aa, Ehrlichia canis str. Jake; identical to SEQ ID NO: 68057

SEQ ID NO: 97022 - DNA, 1986 bp, Rubrivivax gelatinosus PM1; identical to SEQ ID NO: 68058
  CDS (1)..(1986)

SEQ ID NO: 97023 - protein, 661 aa, Rubrivivax gelatinosus PM1; identical to SEQ ID NO: 68059

SEQ ID NO: 97024 - DNA, 1962 bp, Pseudomonas fluorescens PfO-1; identical to SEQ ID NO: 68060
  CDS (1)..(1962)

SEQ ID NO: 97025 - protein, 653 aa, Pseudomonas fluorescens PfO-1; identical to SEQ ID NO: 68061

SEQ ID NO: 97026 - DNA, 2016 bp, Rhodospirillum rubrum; identical to SEQ ID NO: 68062
  CDS (1)..(2016)

SEQ ID NO: 97027 - protein, 671 aa, Rhodospirillum rubrum; identical to SEQ ID NO: 68063

SEQ ID NO: 97028 - DNA, 1962 bp, Ralstonia metallidurans CH34; identical to SEQ ID NO: 68064
  CDS (1)..(1962)

SEQ ID NO: 97029 - protein, 653 aa, Ralstonia metallidurans CH34; identical to SEQ ID NO: 68065

SEQ ID NO: 97030 - DNA, 2043 bp, Ralstonia metallidurans CH34; identical to SEQ ID NO: 68066
  CDS (1)..(2043)

SEQ ID NO: 97031 - protein, 680 aa, Ralstonia metallidurans CH34; identical to SEQ ID NO: 68067

SEQ ID NO: 97032 - DNA, 2079 bp, Burkholderia fungorum LB400; identical to SEQ ID NO: 68068
  CDS (1)..(2079)

SEQ ID NO: 97033 - protein, 692 aa, Burkholderia fungorum LB400; identical to SEQ ID NO: 68069

SEQ ID NO: 97034 - DNA, 1965 bp, Magnetococcus sp. MC-1; identical to SEQ ID NO: 68070
  CDS (1)..(1965)

SEQ ID NO: 97035 - protein, 654 aa, Magnetococcus sp. MC-1; identical to SEQ ID NO: 68071

SEQ ID NO: 97036 - DNA, 1968 bp, Novosphingobium aromaticivorans DSM 12444; identical to SEQ ID NO: 68072
  CDS (1)..(1968)

SEQ ID NO: 97037 - protein, 655 aa, Novosphingobium aromaticivorans DSM 12444; identical to SEQ ID NO: 68073

SEQ ID NO: 97038 - DNA, 1956 bp, Microbulbifer degradans 2-40; identical to SEQ ID NO: 68074
  CDS (1)..(1956)

SEQ ID NO: 97039 - protein, 651 aa, Microbulbifer degradans 2-40; identical to SEQ ID NO: 68075

SEQ ID NO: 97040 - DNA, 1524 bp, Haemophilus influenzae 86-028NP; identical to SEQ ID NO: 68076
  CDS (1)..(1524)

SEQ ID NO: 97041 - protein, 507 aa, Haemophilus influenzae 86-028NP; identical to SEQ ID NO: 68077

SEQ ID NO: 97042 - DNA, 1965 bp, Silicibacter sp. TM1040; identical to SEQ ID NO: 68078
  CDS (1)..(1965)

SEQ ID NO: 97043 - protein, 654 aa, Silicibacter sp. TM1040; identical to SEQ ID NO: 68079

SEQ ID NO: 97044 - DNA, 1974 bp, Azotobacter vinelandii; identical to SEQ ID NO: 68080
  CDS (1)..(1974)

SEQ ID NO: 97045 - protein, 657 aa, Azotobacter vinelandii; identical to SEQ ID NO: 68081

SEQ ID NO: 97046 - DNA, 1950 bp, Actinobacillus pleuropneumoniae serovar 1 str. 4074; identical to SEQ ID NO: 68082
  CDS (1)..(1950)

SEQ ID NO: 97047 - protein, 649 aa, Actinobacillus pleuropneumoniae serovar 1 str. 4074; identical to SEQ ID NO: 68083

SEQ ID NO: 97048 - DNA, 2394 bp, Chloroflexus aurantiacus; identical to SEQ ID NO: 68084
  CDS (1)..(2394)

SEQ ID NO: 97049 - protein, 797 aa, Chloroflexus aurantiacus; identical to SEQ ID NO: 68085

SEQ ID NO: 97050 - DNA, 1962 bp, Paracoccus denitrificans; identical to SEQ ID NO: 68086
  CDS (1)..(1962): transl_table=11

SEQ ID NO: 97051 - protein, 653 aa, Paracoccus denitrificans; identical to SEQ ID NO: 68087

SEQ ID NO: 97052 - DNA, 2145 bp, Pseudomonas fluorescens; identical to SEQ ID NO: 68088
  CDS (1)..(2145): transl_table=11

SEQ ID NO: 97053 - protein, 714 aa, Pseudomonas fluorescens; identical to SEQ ID NO: 68089

SEQ ID NO: 97054 - DNA, 2001 bp, Rhizobium etli; identical to SEQ ID NO: 68090
  CDS (1)..(2001): transl_table=11

SEQ ID NO: 97055 - protein, 666 aa, Rhizobium etli; identical to SEQ ID NO: 68091

SEQ ID NO: 97056 - DNA, 1995 bp, Rhizobium leguminosarum; identical to SEQ ID NO: 68092
  CDS (1)..(1995): transl_table=11

SEQ ID NO: 97057 - protein, 664 aa, Rhizobium leguminosarum; identical to SEQ ID NO: 68093

SEQ ID NO: 97058 - DNA, 1977 bp, Acetobacter diazotrophicus; identical to SEQ ID NO: 68094
  CDS (1)..(1977): transl_table=11

SEQ ID NO: 97059 - protein, 658 aa, Acetobacter diazotrophicus; identical to SEQ ID NO: 68095

SEQ ID NO: 97060 - DNA, 1953 bp, Legionella pneumophila; identical to SEQ ID NO: 68096
  CDS (1)..(1953): transl_table=11

SEQ ID NO: 97061 - protein, 650 aa, Legionella pneumophila; identical to SEQ ID NO: 68097

SEQ ID NO: 97062 - DNA, 1965 bp, Rhodobacter sphaeroides; identical to SEQ ID NO: 68098
  CDS (1)..(1965): transl_table=11

SEQ ID NO: 97063 - protein, 654 aa, Rhodobacter sphaeroides; identical to SEQ ID NO: 68099

SEQ ID NO: 97064 - DNA, 1968 bp, Pantoea citrea; identical to SEQ ID NO: 68100
  CDS (1)..(1968): transl_table=11

SEQ ID NO: 97065 - protein, 655 aa, Pantoea citrea; identical to SEQ ID NO: 68101

SEQ ID NO: 97066 - DNA, 1983 bp, Bradyrhizobium japonicum; identical to SEQ ID NO: 68102
  CDS (1)..(1983)

SEQ ID NO: 97067 - protein, 660 aa, Bradyrhizobium japonicum; identical to SEQ ID NO: 68103

SEQ ID NO: 97068 - DNA, 1944 bp, Escherichia coli; identical to SEQ ID NO: 68104
  CDS (1)..(1944): transl_table=11

SEQ ID NO: 97069 - protein, 647 aa, Escherichia coli; identical to SEQ ID NO: 68105

SEQ ID NO: 97070 - DNA, 1983 bp, Pseudomonas fluorescens; identical to SEQ ID NO: 68106
  CDS (1)..(1983): transl_table=11

SEQ ID NO: 97071 - protein, 660 aa, Pseudomonas fluorescens; identical to SEQ ID NO: 68107

SEQ ID NO: 97072 - DNA, 2031 bp, Rhizobium meliloti; identical to SEQ ID NO: 68108
  CDS (1)..(2031): transl_table=11

SEQ ID NO: 97073 - protein, 676 aa, Rhizobium meliloti; identical to SEQ ID NO: 68109

SEQ ID NO: 97074 - DNA, 1962 bp, Rhodobacter capsulatus; identical to SEQ ID NO: 68110
  CDS (1)..(1962): transl_table=11

SEQ ID NO: 97075 - protein, 653 aa, Rhodobacter capsulatus; identical to SEQ ID NO: 68111

SEQ ID NO: 97076 - DNA, 1908 bp, Haemophilus influenzae; identical to SEQ ID NO: 68112
  CDS (1)..(1908): transl_table=11

SEQ ID NO: 97077 - protein, 635 aa, Haemophilus influenzae; identical to SEQ ID NO: 68113

SEQ ID NO: 97078 - DNA, 22 bp, Primer
atgttgaccccgttgacggcct

SEQ ID NO: 97079 - DNA, 23 bp, Primer
ttattcatcgcgcttcttccccc

SEQ ID NO: 97080 - protein, 954 aa, consensus; identical to SEQ ID NO: 68116
  MISC_FEATURE (1)..(954): consensus for the disclosure of xaa see table XV

SEQ ID NO: 97081 - protein, 43 aa, consensus; identical to SEQ ID NO: 68117
  MISC_FEATURE (1)..(43): consensus for the disclosure of xaa see table XV

SEQ ID NO: 97082 - protein, 37 aa, consensus; identical to SEQ ID NO: 68118
  MISC_FEATURE (1)..(37): consensus for the disclosure of xaa see table XV

SEQ ID NO: 97083 - protein, 51 aa, consensus; identical to SEQ ID NO: 68119
  MISC_FEATURE (1)..(51): consensus for the disclosure of xaa see table XV

SEQ ID NO: 97084 - protein, 19 aa, consensus
  MISC_FEATURE (1)..(19): consensus for the disclosure of xaa see table XV
XXXXXXXRSXXXXSXHXFX

SEQ ID NO: 97085 - DNA, 1647 bp, Escherichia coli; identical to SEQ ID NO: 89791
  CDS (1)..(1647)

SEQ ID NO: 97086 - protein, 548 aa, Escherichia coli; identical to SEQ ID NO: 89792

SEQ ID NO: 97087 - DNA, 1545 bp, Mesorhizobium loti MAFF303099; identical to SEQ ID NO: 89793
  CDS (1)..(1545): transl_table=11

SEQ ID NO: 97088 - protein, 514 aa, Mesorhizobium loti MAFF303099; identical to SEQ ID NO: 89794

SEQ ID NO: 97089 - DNA, 1539 bp, Bacillus halodurans C-125; identical to SEQ ID NO: 89795
  CDS (1)..(1539): transl_table=11

SEQ ID NO: 97090 - protein, 512 aa, Bacillus halodurans C-125; identical to SEQ ID NO: 89796

SEQ ID NO: 97091 - DNA, 1524 bp, Pseudomonas aeruginosa PAO1; identical to SEQ ID NO: 89797
  CDS (1)..(1524): transl_table=11

SEQ ID NO: 97092 - protein, 507 aa, Pseudomonas aeruginosa PAO1; identical to SEQ ID NO: 89798

SEQ ID NO: 97093 - DNA, 1524 bp, Neisseria meningitidis MC58; identical to SEQ ID NO: 89799
  CDS (1)..(1524): transl_table=11

SEQ ID NO: 97094 - protein, 507 aa, Neisseria meningitidis MC58; identical to SEQ ID NO: 89800

SEQ ID NO: 97095 - DNA, 1641 bp, Neisseria meningitidis Z2491; identical to SEQ ID NO: 89801
  CDS (1)..(1641): transl_table=11

SEQ ID NO: 97096 - protein, 546 aa, Neisseria meningitidis Z2491; identical to SEQ ID NO: 89802

SEQ ID NO: 97097 - DNA, 1656 bp, Xylella fastidiosa 9a5c; identical to SEQ ID NO: 89803
  CDS (1)..(1656): transl_table=11

SEQ ID NO: 97098 - protein, 551 aa, Xylella fastidiosa 9a5c; identical to SEQ ID NO: 89804

SEQ ID NO: 97099 - DNA, 1647 bp, Escherichia coli K12; identical to SEQ ID NO: 89805
  CDS (1)..(1647): transl_table=11

SEQ ID NO: 97100 - protein, 548 aa, Escherichia coli K12; identical to SEQ ID NO: 89806

SEQ ID NO: 97101 - DNA, 1524 bp, Ralstonia solanacearum GMI1000; identical to SEQ ID NO: 89807
  CDS (1)..(1524): transl_table=11

SEQ ID NO: 97102 - protein, 507 aa, Ralstonia solanacearum GMI1000; identical to SEQ ID NO: 89808

SEQ ID NO: 97103 - DNA, 1677 bp, Streptomyces coelicolor A3(2); identical to SEQ ID NO: 89809
  CDS (1)..(1677)

SEQ ID NO: 97104 - protein, 558 aa, Streptomyces coelicolor A3(2); identical to SEQ ID NO: 89810

SEQ ID NO: 97105 - DNA, 1512 bp, Chlorobium tepidum TLS; identical to SEQ ID NO: 89811
  CDS (1)..(1512): transl_table=11

SEQ ID NO: 97106 - protein, 503 aa, Chlorobium tepidum TLS; identical to SEQ ID NO: 89812

SEQ ID NO: 97107 - DNA, 1644 bp, Yersinia pestis KIM; identical to SEQ ID NO: 89813
  CDS (1)..(1644): transl_table=11

SEQ ID NO: 97108 - protein, 547 aa, Yersinia pestis KIM; identical to SEQ ID NO: 89814

SEQ ID NO: 97109 - DNA, 1620 bp, Brucella suis 1330; identical to SEQ ID NO: 89815
  CDS (1)..(1620): transl_table=11

SEQ ID NO: 97110 - protein, 539 aa, Brucella suis 1330; identical to SEQ ID NO: 89816

SEQ ID NO: 97111 - DNA, 1551 bp, Shewanella oneidensis MR-1; identical to SEQ ID NO: 89817
  CDS (1)..(1551): transl_table=11

SEQ ID NO: 97112 - protein, 516 aa, Shewanella oneidensis MR-1; identical to SEQ ID NO: 89818

SEQ ID NO: 97113 - DNA, 1524 bp, Pseudomonas putida KT2440; identical to SEQ ID NO: 89819
  CDS (1)..(1524): transl_table=11

SEQ ID NO: 97114 - protein, 507 aa, Pseudomonas putida KT2440; identical to SEQ ID NO: 89820

SEQ ID NO: 97115 - DNA, 1656 bp, Bradyrhizobium japonicum USDA 110; identical to SEQ ID NO: 89821
  CDS (1)..(1656)

SEQ ID NO: 97116 - protein, 551 aa, Bradyrhizobium japonicum USDA 110; identical to SEQ ID NO: 89822

SEQ ID NO: 97117 - DNA, 1524 bp, Pseudomonas syringae pv. tomato str. DC3000; identical to SEQ ID NO: 89823
  CDS (1)..(1524): transl_table=11

SEQ ID NO: 97118 - protein, 507 aa, Pseudomonas syringae pv. tomato str. DC3000; identical to SEQ ID NO: 89824

SEQ ID NO: 97119 - DNA, 1518 bp, Vibrio parahaemolyticus RIMD 2210633; identical to SEQ ID NO: 89825
  CDS (1)..(1518): transl_table=11

SEQ ID NO: 97120 - protein, 505 aa, Vibrio parahaemolyticus RIMD 2210633; identical to SEQ ID NO: 89826

SEQ ID NO: 97121 - DNA, 1647 bp, Salmonella enterica subsp. enterica serovar Typhi Ty2; identical to SEQ ID NO: 89827
  CDS (1)..(1647): transl_table=11

SEQ ID NO: 97122 - protein, 548 aa, Salmonella enterica subsp. enterica serovar Typhi Ty2; identical to SEQ ID NO: 89828

SEQ ID NO: 97123 - DNA, 1647 bp, Salmonella enterica subsp. enterica serovar Typhi Ty2; identical to SEQ ID NO: 89829
  CDS (1)..(1647): transl_table=11

SEQ ID NO: 97124 - protein, 548 aa, Salmonella enterica subsp. enterica serovar Typhi Ty2; identical to SEQ ID NO: 89830

SEQ ID NO: 97125 - DNA, 1635 bp, Bacteroides thetaiotaomicron VPI-5482; identical to SEQ ID NO: 89831
  CDS (1)..(1635): transl_table=11

SEQ ID NO: 97126 - protein, 544 aa, Bacteroides thetaiotaomicron VPI-5482; identical to SEQ ID NO: 89832

SEQ ID NO: 97127 - DNA, 1524 bp, Bordetella bronchiseptica RB50; identical to SEQ ID NO: 89833
  CDS (1)..(1524)

SEQ ID NO: 97128 - protein, 507 aa, Bordetella bronchiseptica RB50; identical to SEQ ID NO: 89834

SEQ ID NO: 97129 - DNA, 1527 bp, Chromobacterium violaceum ATCC 12472; identical to SEQ ID NO: 89835
  CDS (1)..(1527): transl_table=11

SEQ ID NO: 97130 - protein, 508 aa, Chromobacterium violaceum ATCC 12472; identical to SEQ ID NO: 89836

SEQ ID NO: 97131 - DNA, 1647 bp, Porphyromonas gingivalis W83; identical to SEQ ID NO: 89837
  CDS (1)..(1647): transl_table=11

SEQ ID NO: 97132 - protein, 548 aa, Porphyromonas gingivalis W83; identical to SEQ ID NO: 89838

SEQ ID NO: 97133 - DNA, 1524 bp, Vibrio vulnificus YJ016; identical to SEQ ID NO: 89839
  CDS (1)..(1524): transl_table=11

SEQ ID NO: 97134 - protein, 507 aa, Vibrio vulnificus YJ016; identical to SEQ ID NO: 89840

SEQ ID NO: 97135 - DNA, 1656 bp, Rhodopseudomonas palustris CGA009; identical to SEQ ID NO: 89841
  CDS (1)..(1656): transl_table=11

SEQ ID NO: 97136 - protein, 551 aa, Rhodopseudomonas palustris CGA009; identical to SEQ ID NO: 89842

SEQ ID NO: 97137 - DNA, 1626 bp, Geobacter sulfurreducens PCA; identical to SEQ ID NO: 89843
  CDS (1)..(1626): transl_table=11

SEQ ID NO: 97138 - protein, 541 aa, Geobacter sulfurreducens PCA; identical to SEQ ID NO: 89844

SEQ ID NO: 97139 - DNA, 1836 bp, Bdellovibrio bacteriovorus HD100; identical to SEQ ID NO: 89845
  CDS (1)..(1836): transl_table=11

SEQ ID NO: 97140 - protein, 611 aa, Bdellovibrio bacteriovorus HD100; identical to SEQ ID NO: 89846

SEQ ID NO: 97141 - DNA, 1527 bp, Acinetobacter sp. ADP1; identical to SEQ ID NO: 89847
  CDS (1)..(1527): transl_table=11

SEQ ID NO: 97142 - protein, 508 aa, Acinetobacter sp. ADP1; identical to SEQ ID NO: 89848

SEQ ID NO: 97143 - DNA, 1644 bp, Erwinia carotovora subsp. atroseptica SCRI1043; identical to SEQ ID NO: 89849
  CDS (1)..(1644)

SEQ ID NO: 97144 - protein, 547 aa, Erwinia carotovora subsp. atroseptica SCRI1043; identical to SEQ ID NO: 89850

SEQ ID NO: 97145 - DNA, 1545 bp, Desulfotalea psychrophila LSv54; identical to SEQ ID NO: 89851
  CDS (1)..(1545): transl_table=11

SEQ ID NO: 97146 - protein, 514 aa, Desulfotalea psychrophila LSv54; identical to SEQ ID NO: 89852

SEQ ID NO: 97147 - DNA, 1521 bp, Bacillus cereus ZK; identical to SEQ ID NO: 89853
  CDS (1)..(1521): transl_table=11

SEQ ID NO: 97148 - protein, 506 aa, Bacillus cereus ZK; identical to SEQ ID NO: 89854

SEQ ID NO: 97149 - DNA, 1647 bp, Bacteroides fragilis YCH46; identical to SEQ ID NO: 89855
  CDS (1)..(1647): transl_table=11

SEQ ID NO: 97150 - protein, 548 aa, Bacteroides fragilis YCH46; identical to SEQ ID NO: 89856

SEQ ID NO: 97151 - DNA, 1536 bp, Burkholderia mallei ATCC 23344; identical to SEQ ID NO: 89857
  CDS (1)..(1536): transl_table=11

SEQ ID NO: 97152 - protein, 511 aa, Burkholderia mallei ATCC 23344; identical to SEQ ID NO: 89858

SEQ ID NO: 97153 - DNA, 1677 bp, Nocardia farcinica IFM 10152; identical to SEQ ID NO: 89859
  CDS (1)..(1677): transl_table=11

SEQ ID NO: 97154 - protein, 558 aa, Nocardia farcinica IFM 10152; identical to SEQ ID NO: 89860

SEQ ID NO: 97155 - DNA, 1509 bp, Photobacterium profundum SS9; identical to SEQ ID NO: 89861
  CDS (1)..(1509): transl_table=11

SEQ ID NO: 97156 - protein, 502 aa, Photobacterium profundum SS9; identical to SEQ ID NO: 89862

SEQ ID NO: 97157 - DNA, 1548 bp, Geobacillus kaustophilus HTA426; identical to SEQ ID NO: 89863
  CDS (1)..(1548): transl_table=11

SEQ ID NO: 97158 - protein, 515 aa, Geobacillus kaustophilus HTA426; identical to SEQ ID NO: 89864

SEQ ID NO: 97159 - DNA, 1524 bp, Idiomarina loihiensis L2TR; identical to SEQ ID NO: 89865
  CDS (1)..(1524): transl_table=11

SEQ ID NO: 97160 - protein, 507 aa, Idiomarina loihiensis L2TR; identical to SEQ ID NO: 89866

SEQ ID NO: 97161 - DNA, 1533 bp, Azoarcus sp. EbN1; identical to SEQ ID NO: 89867
  CDS (1)..(1533): transl_table=11

SEQ ID NO: 97162 - protein, 510 aa, Azoarcus sp. EbN1; identical to SEQ ID NO: 89868

SEQ ID NO: 97163 - DNA, 1524 bp, Zymomonas mobilis subsp. mobilis ZM4; identical to SEQ ID NO: 89869
  CDS (1)..(1524): transl_table=11

SEQ ID NO: 97164 - protein, 507 aa, Zymomonas mobilis subsp. mobilis ZM4; identical to SEQ ID NO: 89870

SEQ ID NO: 97165 - DNA, 1509 bp, Silicibacter pomeroyi DSS-3; identical to SEQ ID NO: 89871
  CDS (1)..(1509): transl_table=11

SEQ ID NO: 97166 - protein, 502 aa, Silicibacter pomeroyi DSS-3; identical to SEQ ID NO: 89872

SEQ ID NO: 97167 - DNA, 1515 bp, Francisella tularensis subsp. tularensis Schu 4; identical to SEQ ID NO: 89873
  CDS (1)..(1515): transl_table=11

SEQ ID NO: 97168 - protein, 504 aa, Francisella tularensis subsp. tularensis Schu 4; identical to SEQ ID NO: 89874

SEQ ID NO: 97169 - DNA, 1518 bp, Xanthomonas oryzae pv. oryzae KACC10331; identical to SEQ ID NO: 89875
  CDS (1)..(1518): transl_table=11

SEQ ID NO: 97170 - protein, 505 aa, Xanthomonas oryzae pv. oryzae KACC10331; identical to SEQ ID NO: 89876

SEQ ID NO: 97171 - DNA, 1530 bp, Vibrio fischeri ES114; identical to SEQ ID NO: 89877
  CDS (1)..(1530): transl_table=11

SEQ ID NO: 97172 - protein, 509 aa, Vibrio fischeri ES114; identical to SEQ ID NO: 89878

SEQ ID NO: 97173 - DNA, 1593 bp, Xylella fastidiosa Ann-1; identical to SEQ ID NO: 89879
  CDS (1)..(1593)

SEQ ID NO: 97174 - protein, 530 aa, Xylella fastidiosa Ann-1; identical to SEQ ID NO: 89880

SEQ ID NO: 97175 - DNA, 1524 bp, Pseudomonas syringae pv. syringae B728a; identical to SEQ ID NO: 89881
  CDS (1)..(1524)

SEQ ID NO: 97176 - protein, 507 aa, Pseudomonas syringae pv. syringae B728a; identical to SEQ ID NO: 89882

SEQ ID NO: 97177 - DNA, 1533 bp, Dechloromonas aromatica RCB; identical to SEQ ID NO: 89883
  CDS (1)..(1533)

SEQ ID NO: 97178 - protein, 510 aa, Dechloromonas aromatica RCB; identical to SEQ ID NO: 89884

SEQ ID NO: 97179 - DNA, 1524 bp, Methylobacillus flagellatus KT; identical to SEQ ID NO: 89885
  CDS (1)..(1524)

SEQ ID NO: 97180 - protein, 507 aa, Methylobacillus flagellatus KT; identical to SEQ ID NO: 89886

SEQ ID NO: 97181 - DNA, 1509 bp, Mesorhizobium sp. BNC1; identical to SEQ ID NO: 89887
  CDS (1)..(1509)

SEQ ID NO: 97182 - protein, 502 aa, Mesorhizobium sp. BNC1; identical to SEQ ID NO: 89888

SEQ ID NO: 97183 - DNA, 1524 bp, Burkholderia cepacia R18194; identical to SEQ ID NO: 89889
  CDS (1)..(1524)

SEQ ID NO: 97184 - protein, 507 aa, Burkholderia cepacia R18194; identical to SEQ ID NO: 89890

SEQ ID NO: 97185 - DNA, 1524 bp, Burkholderia cepacia R1808; identical to SEQ ID NO: 89891
  CDS (1)..(1524)

SEQ ID NO: 97186 - protein, 507 aa, Burkholderia cepacia R1808; identical to SEQ ID NO: 89892

SEQ ID NO: 97187 - DNA, 1521 bp, Bacillus cereus G9241; identical to SEQ ID NO: 89893
  CDS (1)..(1521): transl_table=11

SEQ ID NO: 97188 - protein, 506 aa, Bacillus cereus G9241; identical to SEQ ID NO: 89894

SEQ ID NO: 97189 - DNA, 1524 bp, Rubrivivax gelatinosus PM1; identical to SEQ ID NO: 89895
  CDS (1)..(1524)

SEQ ID NO: 97190 - protein, 507 aa, Rubrivivax gelatinosus PM1; identical to SEQ ID NO: 89896

SEQ ID NO: 97191 - DNA, 1524 bp, Pseudomonas fluorescens PfO-1; identical to SEQ ID NO: 89897
  CDS (1)..(1524)

SEQ ID NO: 97192 - protein, 507 aa, Pseudomonas fluorescens PfO-1; identical to SEQ ID NO: 89898

SEQ ID NO: 97193 - DNA, 1617 bp, Rhodospirillum rubrum; identical to SEQ ID NO: 89899
  CDS (1)..(1617)

SEQ ID NO: 97194 - protein, 538 aa, Rhodospirillum rubrum; identical to SEQ ID NO: 89900

SEQ ID NO: 97195 - DNA, 1524 bp, Ralstonia metallidurans CH34; identical to SEQ ID NO: 89901
  CDS (1)..(1524)

SEQ ID NO: 97196 - protein, 507 aa, Ralstonia metallidurans CH34; identical to SEQ ID NO: 89902

SEQ ID NO: 97197 - DNA, 1524 bp, Burkholderia fungorum LB400; identical to SEQ ID NO: 89903
  CDS (1)..(1524)

SEQ ID NO: 97198 - protein, 507 aa, Burkholderia fungorum LB400; identical to SEQ ID NO: 89904

SEQ ID NO: 97199 - DNA, 1608 bp, Magnetococcus sp. MC-1; identical to SEQ ID NO: 89905
  CDS (1)..(1608)

SEQ ID NO: 97200 - protein, 535 aa, Magnetococcus sp. MC-1; identical to SEQ ID NO: 89906

SEQ ID NO: 97201 - DNA, 1626 bp, Geobacter metallireducens GS-15; identical to SEQ ID NO: 89907
  CDS (1)..(1626)

SEQ ID NO: 97202 - protein, 541 aa, Geobacter metallireducens GS-15; identical to SEQ ID NO: 89908

SEQ ID NO: 97203 - DNA, 1524 bp, Novosphingobium aromaticivorans DSM 12444; identical to SEQ ID NO: 89909
  CDS (1)..(1524)

SEQ ID NO: 97204 - protein, 507 aa, Novosphingobium aromaticivorans DSM 12444; identical to SEQ ID NO: 89910

SEQ ID NO: 97205 - DNA, 1605 bp, Cytophaga hutchinsonii; identical to SEQ ID NO: 89911
  CDS (1)..(1605)

SEQ ID NO: 97206 - protein, 534 aa, Cytophaga hutchinsonii; identical to SEQ ID NO: 89912

SEQ ID NO: 97207 - DNA, 1554 bp, Polaromonas sp. JS666; identical to SEQ ID NO: 89913
  CDS (1)..(1554)

SEQ ID NO: 97208 - protein, 517 aa, Polaromonas sp. JS666; identical to SEQ ID NO: 89914

SEQ ID NO: 97209 - DNA, 1698 bp, Schistosoma japonicum; identical to SEQ ID NO: 89915
  CDS (1)..(1698)

SEQ ID NO: 97210 - protein, 565 aa, Schistosoma japonicum; identical to SEQ ID NO: 89916

SEQ ID NO: 97211 - DNA, 1545 bp, Rhizobium loti; identical to SEQ ID NO: 89917
  CDS (1)..(1545): transl_table=11

SEQ ID NO: 97212 - protein, 514 aa, Rhizobium loti; identical to SEQ ID NO: 89918

SEQ ID NO: 97213 - DNA, 1545 bp, Bacillus stearothermophilus; identical to SEQ ID NO: 89919
  CDS (1)..(1545): transl_table=11

SEQ ID NO: 97214 - protein, 514 aa, Bacillus stearothermophilus; identical to SEQ ID NO: 89920

SEQ ID NO: 97215 - DNA, 25 bp, Primer
atgtcaaacaaaccctttatctacc

SEQ ID NO: 97216 - DNA, 22 bp, Primer
ttacttagtgcagttcgcgcac

SEQ ID NO: 97217 - protein, 520 aa, consensus; identical to SEQ ID NO: 89923
  MISC_FEATURE (1)..(520): consensus for the disclosure of xaa see table XV

SEQ ID NO: 97218 - protein, 109 aa, consensus; identical to SEQ ID NO: 89924
  MISC_FEATURE (1)..(109): consensus for the disclosure of xaa see table XV

SEQ ID NO: 97219 - protein, 28 aa, consensus
  MISC_FEATURE (1)..(28): consensus for the disclosure of xaa see table XV
XXXXXXXXXXXXGXXXCPPXXXXXXXGG

SEQ ID NO: 97220 - protein, 58 aa, consensus; identical to SEQ ID NO: 89926
  MISC_FEATURE (1)..(58): consensus for the disclosure of xaa see table XV

SEQ ID NO: 97221 - protein, 89 aa, consensus; identical to SEQ ID NO: 89927
  MISC_FEATURE (1)..(89): consensus for the disclosure of xaa see table XV

SEQ ID NO: 97222 - protein, 60 aa, consensus; identical to SEQ ID NO: 89928
  MISC_FEATURE (1)..(60): consensus for the disclosure of xaa see table XV

SEQ ID NO: 97223 - DNA, 999 bp, Escherichia coli; identical to SEQ ID NO: 39905
  CDS (1)..(999)

SEQ ID NO: 97224 - protein, 332 aa, Escherichia coli; identical to SEQ ID NO: 39906

SEQ ID NO: 97225 - DNA, 1220 bp, Danio rerio; identical to SEQ ID NO: 39907
  CDS (54)..(1070)

SEQ ID NO: 97226 - protein, 338 aa, Danio rerio; identical to SEQ ID NO: 39908

SEQ ID NO: 97227 - DNA, 1017 bp, Homo sapiens; identical to SEQ ID NO: 39909
  CDS (1)..(1017)

SEQ ID NO: 97228 - protein, 338 aa, Homo sapiens [sequence omitted]

SEQ ID NO: 97229 - DNA, 1047 bp, Saccharomyces cerevisiae; identical to SEQ ID NO: 39911
  CDS (1)..(1047)

SEQ ID NO: 97230 - protein, 348 aa, Saccharomyces cerevisiae; identical to SEQ ID NO: 39912

SEQ ID NO: 97231 - DNA, 1008 bp, Agrobacterium rhizogenes; identical to SEQ ID NO: 39913
  CDS (1)..(1008): transl_table=11

SEQ ID NO: 97232 - protein, 335 aa, Agrobacterium rhizogenes; identical to SEQ ID NO: 39914

SEQ ID NO: 97233 - DNA, 1026 bp, Arabidopsis thaliana; identical to SEQ ID NO: 39915
  CDS (1)..(1026)

SEQ ID NO: 97234 - protein, 341 aa, Arabidopsis thaliana; identical to SEQ ID NO: 39916

SEQ ID NO: 97235 - DNA, 1215 bp, Arabidopsis thaliana; identical to SEQ ID NO: 39917
  CDS (1)..(1215)

SEQ ID NO: 97236 - protein, 404 aa, Arabidopsis thaliana; identical to SEQ ID NO: 39918

SEQ ID NO: 97237 - DNA, 1011 bp, Vibrio cholerae O1 biovar eltor str. N16961; identical to SEQ ID NO: 39919
  CDS (1)..(1011): transl_table=11

SEQ ID NO: 97238 - protein, 336 aa, Vibrio cholerae O1 biovar eltor str. N16961; identical to SEQ ID NO: 39920

SEQ ID NO: 97239 - DNA, 1002 bp, Pasteurella multocida subsp. multocida str. Pm70; identical to SEQ ID NO: 39921
  CDS (1)..(1002): transl_table=11

SEQ ID NO: 97240 - protein, 333 aa, Pasteurella multocida subsp. multocida str. Pm70; identical to SEQ ID NO: 39922

SEQ ID NO: 97241 - DNA, 864 bp, Halobacterium salinarum NRC-1; identical to SEQ ID NO: 39923
  CDS (1)..(864): transl_table=11

SEQ ID NO: 97242 - protein, 287 aa, Halobacterium salinarum NRC-1; identical to SEQ ID NO: 39924

SEQ ID NO: 97243 - DNA, 843 bp, Campylobacter jejuni subsp. jejuni NCTC 11168; identical to SEQ ID NO: 39925
  CDS (1)..(843): transl_table=11

SEQ ID NO: 97244 - protein, 280 aa, Campylobacter jejuni subsp. jejuni NCTC 11168; identical to SEQ ID NO: 39926

SEQ ID NO: 97245 - DNA, 975 bp, Neisseria meningitidis Z2491; identical to SEQ ID NO: 39927
  CDS (1)..(975): transl_table=11

SEQ ID NO: 97246 - protein, 324 aa, Neisseria meningitidis Z2491; identical to SEQ ID NO: 39928

SEQ ID NO: 97247 - DNA, 1014 bp, Yersinia pestis CO92; identical to SEQ ID NO: 39929
  CDS (1)..(1014)

SEQ ID NO: 97248 - protein, 337 aa, Yersinia pestis CO92; identical to SEQ ID NO: 39930

SEQ ID NO: 97249 - DNA, 1011 bp, Caulobacter crescentus CB15; identical to SEQ ID NO: 39931
  CDS (1)..(1011): transl_table=11

SEQ ID NO: 97250 - protein, 336 aa, Caulobacter crescentus CB15; identical to SEQ ID NO: 39932

SEQ ID NO: 97251 - DNA, 1026 bp, Caenorhabditis elegans; identical to SEQ ID NO: 39933
  CDS (1)..(1026)

SEQ ID NO: 97252 - protein, 341 aa, Caenorhabditis elegans; identical to SEQ ID NO: 39934

SEQ ID NO: 97253 - DNA, 1023 bp, Brucella melitensis 16M; identical to SEQ ID NO: 39935
  CDS (1)..(1023): transl_table=11

SEQ ID NO: 97254 - protein, 340 aa, Brucella melitensis 16M; identical to SEQ ID NO: 39936

SEQ ID NO: 97255 - DNA, 1038 bp, Schizosaccharomyces pombe; identical to SEQ ID NO: 39937
  CDS (1)..(1038)

SEQ ID NO: 97256 - protein, 345 aa, Schizosaccharomyces pombe; identical to SEQ ID NO: 39938

SEQ ID NO: 97257 - DNA, 1005 bp, Drosophila melanogaster; identical to SEQ ID NO: 39939
  CDS (1)..(1005)

SEQ ID NO: 97258 - protein, 334 aa, Drosophila melanogaster; identical to SEQ ID NO: 39940

SEQ ID NO: 97259 - DNA, 1011 bp, Xanthomonas axonopodis pv. citri str. 306; identical to SEQ ID NO: 39941
  CDS (1)..(1011): transl_table=11

SEQ ID NO: 97260 - protein, 336 aa, Xanthomonas axonopodis pv. citri str. 306; identical to SEQ ID NO: 39942

SEQ ID NO: 97261 - DNA, 1002 bp, Chlorobium tepidum TLS; identical to SEQ ID NO: 39943
  CDS (1)..(1002): transl_table=11

SEQ ID NO: 97262 - protein, 333 aa, Chlorobium tepidum TLS; identical to SEQ ID NO: 39944

SEQ ID NO: 97263 - DNA, 1047 bp, Thermosynechococcus elongatus BP-1; identical to SEQ ID NO: 39945
  CDS (1)..(1047): transl_table=11

SEQ ID NO: 97264 - protein, 348 aa, Thermosynechococcus elongatus BP-1; identical to SEQ ID NO: 39946

SEQ ID NO: 97265 - DNA, 1125 bp, Leptospira interrogans serovar Lai str. 56601; identical to SEQ ID NO: 39947
  CDS (1)..(1125): transl_table=11

SEQ ID NO: 97266 - protein, 374 aa, Leptospira interrogans serovar Lai str. 56601; identical to SEQ ID NO: 39948

SEQ ID NO: 97267 - DNA, 978 bp, Shewanella oneidensis MR-1; identical to SEQ ID NO: 39949
  CDS (1)..(978): transl_table=11

SEQ ID NO: 97268 - protein, 325 aa, Shewanella oneidensis MR-1; identical to SEQ ID NO: 39950

SEQ ID NO: 97269 - DNA, 1011 bp, Pseudomonas putida KT2440; identical to SEQ ID NO: 39951
  CDS (1)..(1011): transl_table=11

SEQ ID NO: 97270 - protein, 336 aa, Pseudomonas putida KT2440; identical to SEQ ID NO: 39952

SEQ ID NO: 97271 - DNA, 1038 bp, Bradyrhizobium japonicum USDA 110; identical to SEQ ID NO: 39953
  CDS (1)..(1038)

SEQ ID NO: 97272 - protein, 345 aa, Bradyrhizobium japonicum USDA 110; identical to SEQ ID NO: 39954

SEQ ID NO: 97273 - DNA, 1011 bp, Pseudomonas syringae pv. tomato str. DC3000; identical to SEQ ID NO: 39955
  CDS (1)..(1011): transl_table=11

SEQ ID NO: 97274 - protein, 336 aa, Pseudomonas syringae pv. tomato str. DC3000; identical to SEQ ID NO: 39956

SEQ ID NO: 97275 - DNA, 999 bp, Salmonella enterica subsp. enterica serovar Typhi Ty2; identical to SEQ ID NO: 39957
  CDS (1)..(999): transl_table=11

SEQ ID NO: 97276 - protein, 332 aa, Salmonella enterica subsp. enterica serovar Typhi Ty2; identical to SEQ ID NO: 39958

SEQ ID NO: 97277 - DNA, 1005 bp, Nitrosomonas europaea ATCC 19718; identical to SEQ ID NO: 39959
  CDS (1)..(1005): transl_table=11

SEQ ID NO: 97278 - protein, 334 aa, Nitrosomonas europaea ATCC 19718; identical to SEQ ID NO: 39960

SEQ ID NO: 97279 - DNA, 840 bp, Helicobacter hepaticus ATCC 51449; identical to SEQ ID NO: 39961
  CDS (1)..(840): transl_table=11

SEQ ID NO: 97280 - protein, 279 aa, Helicobacter hepaticus ATCC 51449; identical to SEQ ID NO: 39962

SEQ ID NO: 97281 - DNA, 987 bp, Wigglesworthia glossinidia endosymbiont of Glossina brevipalpis; identical to SEQ ID NO: 39963
  CDS (1)..(987): transl_table=11

SEQ ID NO: 97282 - protein, 328 aa, Wigglesworthia glossinidia endosymbiont of Glossina brevipalpis; identical to SEQ ID NO: 39964

SEQ ID NO: 97283 - DNA, 1020 bp, Bordetella bronchiseptica RB50; identical to SEQ ID NO: 39965
  CDS (1)..(1020): transl_table=11

SEQ ID NO: 97284 - protein, 339 aa, Bordetella bronchiseptica RB50; identical to SEQ ID NO: 39966

SEQ ID NO: 97285 - DNA, 1008 bp, Chromobacterium violaceum ATCC 12472; identical to SEQ ID NO: 39967
  CDS (1)..(1008): transl_table=11

SEQ ID NO: 97286 - protein, 335 aa, Chromobacterium violaceum ATCC 12472; identical to SEQ ID NO: 39968

SEQ ID NO: 97287 - DNA, 843 bp, Wolinella succinogenes DSM 1740; identical to SEQ ID NO: 39969
  CDS (1)..(843): transl_table=11

SEQ ID NO: 97288 - protein, 280 aa, Wolinella succinogenes DSM 1740; identical to SEQ ID NO: 39970

SEQ ID NO: 97289 - DNA, 1110 bp, Oryza sativa (japonica cultivar-group); identical to SEQ ID NO: 39971
  CDS (1)..(1110)

SEQ ID NO: 97290 - protein, 369 aa, Oryza sativa (japonica cultivar-group); identical to SEQ ID NO: 39972

SEQ ID NO: 97291 - DNA, 1047 bp, Gloeobacter violaceus PCC 7421; identical to SEQ ID NO: 39973
  CDS (1)..(1047): transl_table=11

SEQ ID NO: 97292 - protein, 348 aa, Gloeobacter violaceus PCC 7421; identical to SEQ ID NO: 39974

SEQ ID NO: 97293 - DNA, 1005 bp, Photorhabdus luminescens subsp. laumondii TTO1; identical to SEQ ID NO: 39975
  CDS (1)..(1005): transl_table=11

SEQ ID NO: 97294 - protein, 334 aa, Photorhabdus luminescens subsp. laumondii TTO1; identical to SEQ ID NO: 39976

SEQ ID NO: 97295 - DNA, 1017 bp, Vibrio vulnificus YJ016; identical to SEQ ID NO: 39977
  CDS (1)..(1017): transl_table=11

SEQ ID NO: 97296 - protein, 338 aa, Vibrio vulnificus YJ016; identical to SEQ ID NO: 39978

SEQ ID NO: 97297 - DNA, 1032 bp, Rhodopseudomonas palustris CGA009; identical to SEQ ID NO: 39979
  CDS (1)..(1032): transl_table=11

SEQ ID NO: 97298 - protein, 343 aa, Rhodopseudomonas palustris CGA009; identical to SEQ ID NO: 39980

SEQ ID NO: 97299 - DNA, 942 bp, Geobacter sulfurreducens PCA; identical to SEQ ID NO: 39981
  CDS (1)..(942): transl_table=11

SEQ ID NO: 97300 - protein, 313 aa, Geobacter sulfurreducens PCA; identical to SEQ ID NO: 39982

SEQ ID NO: 97301 - DNA, 1014 bp, Danio rerio; identical to SEQ ID NO: 39983
  CDS (1)..(1014)

SEQ ID NO: 97302 - protein, 337 aa, Danio rerio; identical to SEQ ID NO: 39984

SEQ ID NO: 97303 - DNA, 1029 bp, Eremothecium gossypii; identical to SEQ ID NO: 39985
  CDS (1)..(1029)

SEQ ID NO: 97304 - protein, 342 aa, Eremothecium gossypii; identical to SEQ ID NO: 39986

SEQ ID NO: 97305 - DNA, 1017 bp, Xenopus tropicalis; identical to SEQ ID NO: 39987
  CDS (1)..(1017)

SEQ ID NO: 97306 - protein, 338 aa, Xenopus tropicalis; identical to SEQ ID NO: 39988

SEQ ID NO: 97307 - DNA, 1017 bp, Sus scrofa; identical to SEQ ID NO: 39989
  CDS (1)..(1017)

SEQ ID NO: 97308 - protein, 338 aa, Sus scrofa; identical to SEQ ID NO: 39990

SEQ ID NO: 97309 - DNA, 1026 bp, Anopheles gambiae str. PEST; identical to SEQ ID NO: 39991
  CDS (1)..(1026)

SEQ ID NO: 97310 - protein, 341 aa, Anopheles gambiae str. PEST; identical to SEQ ID NO: 39992

SEQ ID NO: 97311 - DNA, 1053 bp, Neurospora crassa; identical to SEQ ID NO: 39993
  CDS (1)..(1053)

SEQ ID NO: 97312 - protein, 350 aa, Neurospora crassa; identical to SEQ ID NO: 39994

SEQ ID NO: 97313 - DNA, 1035 bp, Magnaporthe grisea 70-15; identical to SEQ ID NO: 39995
  CDS (1)..(1035)

SEQ ID NO: 97314 - protein, 344 aa, Magnaporthe grisea 70-15; identical to SEQ ID NO: 39996

SEQ ID NO: 97315 - DNA, 1029 bp, Gibberella zeae PH-1; identical to SEQ ID NO: 39997
  CDS (1)..(1029)

SEQ ID NO: 97316 - protein, 342 aa, Gibberella zeae PH-1; identical to SEQ ID NO: 39998

SEQ ID NO: 97317 - DNA, 1047 bp, Ustilago maydis 521; identical to SEQ ID NO: 39999
  CDS (1)..(1047)

SEQ ID NO: 97318 - protein, 348 aa, Ustilago maydis 521; identical to SEQ ID NO: 40000

SEQ ID NO: 97319 - DNA, 1068 bp, Aspergillus nidulans FGSC A4; identical to SEQ ID NO: 40001
  CDS (1)..(1068)

SEQ ID NO: 97320 - protein, 355 aa, Aspergillus nidulans FGSC A4; identical to SEQ ID NO: 40002

SEQ ID NO: 97321 - DNA, 1020 bp, Gallus gallus; identical to SEQ ID NO: 40003
  CDS (1)..(1020)

SEQ ID NO: 97322 - protein, 339 aa, Gallus gallus; identical to SEQ ID NO: 40004

SEQ ID NO: 97323 - DNA, 1038 bp, Candida glabrata CBS138; identical to SEQ ID NO: 40005
  CDS (1)..(1038)

SEQ ID NO: 97324 - protein, 345 aa, Candida glabrata CBS138; identical to SEQ ID NO: 40006

SEQ ID NO: 97325 - DNA, 1011 bp, Candida glabrata CBS138; identical to SEQ ID NO: 40007
  CDS (1)..(1011)

SEQ ID NO: 97326 - protein, 336 aa, Candida glabrata CBS138; identical to SEQ ID NO: 40008

SEQ ID NO: 97327 - DNA, 1068 bp, Kluyveromyces lactis NRRL Y-1140; identical to SEQ ID NO: 40009
  CDS (1)..(1068)

SEQ ID NO: 97328 - protein, 355 aa, Kluyveromyces lactis NRRL Y-1140; identical to SEQ ID NO: 40010

SEQ ID NO: 97329 - DNA, 993 bp, Debaryomyces hansenii CBS767; identical to SEQ ID NO: 40011
  CDS (1)..(993)

SEQ ID NO: 97330 - protein, 330 aa, Debaryomyces hansenii CBS767; identical to SEQ ID NO: 40012

SEQ ID NO: 97331 - DNA, 1032 bp, Oryza sativa (japonica cultivar-group); identical to SEQ ID NO: 40013
  CDS (1)..(1032)

SEQ ID NO: 97332 - protein, 343 aa, Oryza sativa (japonica cultivar-group); identical to SEQ ID NO: 40014

SEQ ID NO: 97333 - DNA, 1017 bp, Yarrowia lipolytica CLIB99; identical to SEQ ID NO: 40015
  CDS (1)..(1017)

SEQ ID NO: 97334 - protein, 338 aa, Yarrowia lipolytica CLIB99; identical to SEQ ID NO: 40016

SEQ ID NO: 97335 - DNA, 1008 bp, Pan troglodytes; identical to SEQ ID NO: 40017
  CDS (1)..(1008)

SEQ ID NO: 97336 - protein, 335 aa, Pan troglodytes; identical to SEQ ID NO: 40018

SEQ ID NO: 97337 - DNA, 1014 bp, Desulfovibrio vulgaris subsp. vulgaris str. Hildenborough; identical to SEQ ID NO: 40019
  CDS (1)..(1014): transl_table=11

SEQ ID NO: 97338 - protein, 337 aa, Desulfovibrio vulgaris subsp. vulgaris str. Hildenborough; identical to SEQ ID NO: 40020

SEQ ID NO: 97339 - DNA, 1038 bp, Oligotropha carboxidovorans; identical to SEQ ID NO: 40021
  CDS (1)..(1038): transl_table=11

SEQ ID NO: 97340 - protein, 345 aa, Oligotropha carboxidovorans; identical to SEQ ID NO: 40022

SEQ ID NO: 97341 - DNA, 972 bp, Acinetobacter sp. ADP1; identical to SEQ ID NO: 40023
  CDS (1)..(972): transl_table=11

SEQ ID NO: 97342 - protein, 323 aa, Acinetobacter sp. ADP1; identical to SEQ ID NO: 40024

SEQ ID NO: 97343 - DNA, 1005 bp, Erwinia carotovora subsp. atroseptica SCRI1043; identical to SEQ ID NO: 40025
  CDS (1)..(1005)

SEQ ID NO: 97344 - protein, 334 aa, Erwinia carotovora subsp. atroseptica SCRI1043; identical to SEQ ID NO: 40026

SEQ ID NO: 97345 - DNA, 1008 bp, Mannheimia succiniciproducens MBEL55E; identical to SEQ ID NO: 40027
  CDS (1)..(1008): transl_table=11

SEQ ID NO: 97346 - protein, 335 aa, Mannheimia succiniciproducens MBEL55E; identical to SEQ ID NO: 40028

SEQ ID NO: 97347 - DNA, 1035 bp, Photobacterium profundum SS9; identical to SEQ ID NO: 40029
  CDS (1)..(1035): transl_table=11

SEQ ID NO: 97348 - protein, 344 aa, Photobacterium profundum SS9; identical to SEQ ID NO: 40030

SEQ ID NO: 97349 - DNA, 876 bp, Haloarcula marismortui ATCC 43049; identical to SEQ ID NO: 40031
  CDS (1)..(876): transl_table=11

SEQ ID NO: 97350 - protein, 291 aa, Haloarcula marismortui ATCC 43049; identical to SEQ ID NO: 40032

SEQ ID NO: 97351 - DNA, 984 bp, Idiomarina loihiensis L2TR; identical to SEQ ID NO: 40033
  CDS (1)..(984): transl_table=11

SEQ ID NO: 97352 - protein, 327 aa, Idiomarina loihiensis L2TR; identical to SEQ ID NO: 40034

SEQ ID NO: 97353 - DNA, 1002 bp, Azoarcus sp. EbN1; identical to SEQ ID NO: 40035
  CDS (1)..(1002): transl_table=11

SEQ ID NO: 97354 - protein, 333 aa, Azoarcus sp. EbN1; identical to SEQ ID NO: 40036

SEQ ID NO: 97355 - DNA, 909 bp, Synechococcus elongatus PCC 6301; identical to SEQ ID NO: 40037
  CDS (1)..(909): transl_table=11

SEQ ID NO: 97356 - protein, 302 aa, Synechococcus elongatus PCC 6301; identical to SEQ ID NO: 40038

SEQ ID NO: 97357 - DNA, 1014 bp, Magnetospirillum magnetotacticum MS-1; identical to SEQ ID NO: 40039
  CDS (1)..(1014)

SEQ ID NO: 97358 - protein, 337 aa, Magnetospirillum magnetotacticum MS-1; identical to SEQ ID NO: 40040

SEQ ID NO: 97359 - DNA, 1014 bp, Azotobacter vinelandii; identical to SEQ ID NO: 40041
  CDS (1)..(1014)

SEQ ID NO: 97360 - protein, 337 aa, Azotobacter vinelandii; identical to SEQ ID NO: 40042

SEQ ID NO: 97361 - DNA, 1017 bp, Desulfovibrio desulfuricans G20; identical to SEQ ID NO: 40043
  CDS (1)..(1017)

SEQ ID NO: 97362 - protein, 338 aa, Desulfovibrio desulfuricans G20; identical to SEQ ID NO: 40044

SEQ ID NO: 97363 - DNA, 1005 bp, Actinobacillus pleuropneumoniae serovar 1 str. 4074; identical to SEQ ID NO: 40045
  CDS (1)..(1005)

SEQ ID NO: 97364 - protein, 334 aa, Actinobacillus pleuropneumoniae serovar 1 str. 4074; identical to SEQ ID NO: 40046

SEQ ID NO: 97365 - DNA, 1011 bp, Pseudomonas aeruginosa UCBPP-PA14; identical to SEQ ID NO: 40047
  CDS (1)..(1011)

SEQ ID NO: 97366 - protein, 336 aa, Pseudomonas aeruginosa UCBPP-PA14; identical to SEQ ID NO: 40048

SEQ ID NO: 97367 - DNA, 984 bp, Psychrobacter sp. 273-4; identical to SEQ ID NO: 40049
  CDS (1)..(984)

SEQ ID NO: 97368 - protein, 327 aa, Psychrobacter sp. 273-4; identical to SEQ ID NO: 40050

SEQ ID NO: 97369 - DNA, 1089 bp, Dechloromonas aromatica RCB; identical to SEQ ID NO: 40051
  CDS (1)..(1089)

SEQ ID NO: 97370 - protein, 362 aa, Dechloromonas aromatica RCB; identical to SEQ ID NO: 40052

SEQ ID NO: 97371 - DNA, 1017 bp, Dechloromonas aromatica RCB; identical to SEQ ID NO: 40053
  CDS (1)..(1017)

SEQ ID NO: 97372 - protein, 338 aa, Dechloromonas aromatica RCB; identical to SEQ ID NO: 40054

SEQ ID NO: 97373 - DNA, 1005 bp, Haemophilus influenzae R2866; identical to SEQ ID NO: 40055
  CDS (1)..(1005)

SEQ ID NO: 97374 - protein, 334 aa, Haemophilus influenzae R2866; identical to SEQ ID NO: 40056

SEQ ID NO: 97375 - DNA, 1104 bp, Anabaena variabilis ATCC 29413; identical to SEQ ID NO: 40057
  CDS (1)..(1104)

SEQ ID NO: 97376 - protein, 367 aa, Anabaena variabilis ATCC 29413; identical to SEQ ID NO: 40058

SEQ ID NO: 97377 - DNA, 1035 bp, Synechococcus elongatus PCC 7942; identical to SEQ ID NO: 40059
  CDS (1)..(1035)

SEQ ID NO: 97378 - protein, 344 aa, Synechococcus elongatus PCC 7942; identical to SEQ ID NO: 40060

SEQ ID NO: 97379 - DNA, 996 bp, Methylobacillus flagellatus KT; identical to SEQ ID NO: 40061
  CDS (1)..(996)

SEQ ID NO: 97380 - protein, 331 aa, Methylobacillus flagellatus KT; identical to SEQ ID NO: 40062

SEQ ID NO: 97381 - DNA, 1047 bp, Crocosphaera watsonii WH 8501; identical to SEQ ID NO: 40063
  CDS (1)..(1047)

SEQ ID NO: 97382 - protein, 348 aa, Crocosphaera watsonii WH 8501; identical to SEQ ID NO: 40064

SEQ ID NO: 97383 - DNA, 1011 bp, Rubrivivax gelatinosus PM1; identical to SEQ ID NO: 40065
  CDS (1)..(1011)

SEQ ID NO: 97384 - protein, 336 aa, Rubrivivax gelatinosus PM1; identical to SEQ ID NO: 40066

SEQ ID NO: 97385 - DNA, 1074 bp, Rubrivivax gelatinosus PM1; identical to SEQ ID NO: 40067
  CDS (1)..(1074)

SEQ ID NO: 97386 - protein, 357 aa, Rubrivivax gelatinosus PM1; identical to SEQ ID NO: 40068

SEQ ID NO: 97387 - DNA, 1056 bp, Rubrivivax gelatinosus PM1; identical to SEQ ID NO: 40069
  CDS (1)..(1056)

SEQ ID NO: 97388 - protein, 351 aa, Rubrivivax gelatinosus PM1; identical to SEQ ID NO: 40070

SEQ ID NO: 97389 - DNA, 1068 bp, Rhodospirillum rubrum; identical to SEQ ID NO: 40071
  CDS (1)..(1068)

SEQ ID NO: 97390 - protein, 355 aa, Rhodospirillum rubrum; identical to SEQ ID NO: 40072

SEQ ID NO: 97391 - DNA, 1017 bp, Ralstonia metallidurans CH34; identical to SEQ ID NO: 40073
  CDS (1)..(1017)

SEQ ID NO: 97392 - protein, 338 aa, Ralstonia metallidurans CH34; identical to SEQ ID NO: 40074

SEQ ID NO: 97393 - DNA, 1017 bp, Burkholderia fungorum LB400; identical to SEQ ID NO: 40075
  CDS (1)..(1017)

SEQ ID NO: 97394 - protein, 338 aa, Burkholderia fungorum LB400; identical to SEQ ID NO: 40076

SEQ ID NO: 97395 - DNA, 1137 bp, Burkholderia fungorum LB400; identical to SEQ ID NO: 40077
  CDS (1)..(1137)

SEQ ID NO: 97396 - protein, 378 aa, Burkholderia fungorum LB400; identical to SEQ ID NO: 40078

SEQ ID NO: 97397 - DNA, 945 bp, Geobacter metallireducens GS-15; identical to SEQ ID NO: 40079
  CDS (1)..(945)

SEQ ID NO: 97398 - protein, 314 aa, Geobacter metallireducens GS-15; identical to SEQ ID NO: 40080

SEQ ID NO: 97399 - DNA, 1041 bp, Cytophaga hutchinsonii; identical to SEQ ID NO: 40081
  CDS (1)..(1041)

SEQ ID NO: 97400 - protein, 346 aa, Cytophaga hutchinsonii; identical to SEQ ID NO: 40082

SEQ ID NO: 97401 - DNA, 969 bp, Microbulbifer degradans 2-40; identical to SEQ ID NO: 40083
  CDS (1)..(969)

SEQ ID NO: 97402 - protein, 322 aa, Microbulbifer degradans 2-40; identical to SEQ ID NO: 40084

SEQ ID NO: 97403 - DNA, 1101 bp, Trichodesmium erythraeum IMS101; identical to SEQ ID NO: 40085
  CDS (1)..(1101)

SEQ ID NO: 97404 - protein, 366 aa, Trichodesmium erythraeum IMS101; identical to SEQ ID NO: 40086

SEQ ID NO: 97405 - DNA, 1014 bp, Thiobacillus denitrificans ATCC 25259; identical to SEQ ID NO: 40087
  CDS (1)..(1014)

SEQ ID NO: 97406 - protein, 337 aa, Thiobacillus denitrificans ATCC 25259; identical to SEQ ID NO: 40088

SEQ ID NO: 97407 - DNA, 936 bp, Polaromonas sp. JS666; identical to SEQ ID NO: 40089
  CDS (1)..(936)

SEQ ID NO: 97408 - protein, 311 aa, Polaromonas sp. JS666; identical to SEQ ID NO: 40090

SEQ ID NO: 97409 - DNA, 1056 bp, Leishmania major; identical to SEQ ID NO: 40091
  CDS (1)..(1056)

SEQ ID NO: 97410 - protein, 351 aa, Leishmania major; identical to SEQ ID NO: 40092

SEQ ID NO: 97411 - DNA, 1206 bp, Oryza sativa; identical to SEQ ID NO: 40093
  CDS (1)..(1206)

SEQ ID NO: 97412 - protein, 401 aa, Oryza sativa; identical to SEQ ID NO: 40094

SEQ ID NO: 97413 - DNA, 1020 bp, Xenopus laevis; identical to SEQ ID NO: 40095
  CDS (1)..(1020)

SEQ ID NO: 97414 - protein, 339 aa, Xenopus laevis; identical to SEQ ID NO: 40096

SEQ ID NO: 97415 - DNA, 1041 bp, Dictyostelium discoideum; identical to SEQ ID NO: 40097
  CDS (1)..(1041)

SEQ ID NO: 97416 - protein, 346 aa, Dictyostelium discoideum; identical to SEQ ID NO: 40098

SEQ ID NO: 97417 - DNA, 1017 bp, Xenopus laevis; identical to SEQ ID NO: 40099
  CDS (1)..(1017)

SEQ ID NO: 97418 - protein, 338 aa, Xenopus laevis; identical to SEQ ID NO: 40100

SEQ ID NO: 97419 - DNA, 1263 bp, Chlorarachnion sp; identical to SEQ ID NO: 40101
  CDS (1)..(1263)

SEQ ID NO: 97420 - protein, 420 aa, Chlorarachnion sp; identical to SEQ ID NO: 40102

SEQ ID NO: 97421 - DNA, 1017 bp, Yarrowia lipolytica; identical to SEQ ID NO: 40103
  CDS (1)..(1017)

SEQ ID NO: 97422 - protein, 338 aa, Yarrowia lipolytica; identical to SEQ ID NO: 40104

SEQ ID NO: 97423 - DNA, 942 bp, Rhizobium sp; identical to SEQ ID NO: 40105
  CDS (1)..(942): transl_table=11

SEQ ID NO: 97424 - protein, 313 aa, Rhizobium sp; identical to SEQ ID NO: 40106

SEQ ID NO: 97425 - DNA, 1002 bp, Phytophthora infestans; identical to SEQ ID NO: 40107
  CDS (1)..(1002)

SEQ ID NO: 97426 - protein, 333 aa, Phytophthora infestans; identical to SEQ ID NO: 40108

SEQ ID NO: 97427 - DNA, 1146 bp, Toxoplasma gondii; identical to SEQ ID NO: 40109
  CDS (1)..(1146)

SEQ ID NO: 97428 - protein, 381 aa, Toxoplasma gondii; identical to SEQ ID NO: 40110

SEQ ID NO: 97429 - DNA, 1026 bp, Pisum sativum; identical to SEQ ID NO: 40111
  CDS (1)..(1026)

SEQ ID NO: 97430 - protein, 341 aa, Pisum sativum; identical to SEQ ID NO: 40112

SEQ ID NO: 97431 - DNA, 1020 bp, Mus musculus; identical to SEQ ID NO: 40113
  CDS (1)..(1020)

SEQ ID NO: 97432 - protein, 339 aa, Mus musculus; identical to SEQ ID NO: 40114

SEQ ID NO: 97433 - DNA, 1053 bp, Trypanosoma brucei; identical to SEQ ID NO: 40115
  CDS (1)..(1053)

SEQ ID NO: 97434 - protein, 350 aa, Trypanosoma brucei; identical to SEQ ID NO: 40116

SEQ ID NO: 97435 - DNA, 1023 bp, Hansenula anomala; identical to SEQ ID NO: 40117
  CDS (1)..(1023)

SEQ ID NO: 97436 - protein, 340 aa, Hansenula anomala; identical to SEQ ID NO: 40118

SEQ ID NO: 97437 - DNA, 1026 bp, Beta vulgaris subsp; identical to SEQ ID NO: 40119
  CDS (1)..(1026)

SEQ ID NO: 97438 - protein, 341 aa, Beta vulgaris subsp; identical to SEQ ID NO: 40120

SEQ ID NO: 97439 - DNA, 1068 bp, Aspergillus oryzae; identical to SEQ ID NO: 40121
  CDS (1)..(1068)

SEQ ID NO: 97440 - protein, 355 aa, Aspergillus oryzae; identical to SEQ ID NO: 40122

SEQ ID NO: 97441 - DNA, 1023 bp, Zaocys dhumnades; identical to SEQ ID NO: 40123
  CDS (1)..(1023)

SEQ ID NO: 97442 - protein, 340 aa, Zaocys dhumnades; identical to SEQ ID NO: 40124

SEQ ID NO: 97443 - DNA, 1080 bp, Pseudomonas hydrogenothermophila; identical to SEQ ID NO: 40125
  CDS (1)..(1080): transl_table=11

SEQ ID NO: 97444 - protein, 359 aa, Pseudomonas hydrogenothermophila; identical to SEQ ID NO: 40126

SEQ ID NO: 97445 - DNA, 1020 bp, Oryctolagus cuniculus; identical to SEQ ID NO: 40127
  CDS (1)..(1020)

SEQ ID NO: 97446 - protein, 339 aa, Oryctolagus cuniculus; identical to SEQ ID NO: 40128

SEQ ID NO: 97447 - DNA, 963 bp, Candida albicans; identical to SEQ ID NO: 40129
  CDS (1)..(963): transl_table=12

SEQ ID NO: 97448 - protein, 320 aa, Candida albicans; identical to SEQ ID NO: 40130

SEQ ID NO: 97449 - DNA, 1035 bp, Porteresia coarctata; identical to SEQ ID NO: 40131
  CDS (1)..(1035)

SEQ ID NO: 97450 - protein, 344 aa, Porteresia coarctata; identical to SEQ ID NO: 40132

SEQ ID NO: 97451 - DNA, 1074 bp, Pisum sativum; identical to SEQ ID NO: 40133
  CDS (1)..(1074): transl_table=11

SEQ ID NO: 97452 - protein, 357 aa, Pisum sativum; identical to SEQ ID NO: 40134

SEQ ID NO: 97453 - DNA, 996 bp, Candida albicans; identical to SEQ ID NO: 40135
  CDS (1)..(996): transl_table=12

SEQ ID NO: 97454 - protein, 331 aa, Candida albicans; identical to SEQ ID NO: 40136

SEQ ID NO: 97455 - DNA, 1026 bp, Musa acuminata; identical to SEQ ID NO: 40137
  CDS (1)..(1026)

SEQ ID NO: 97456 - protein, 341 aa, Musa acuminata; identical to SEQ ID NO: 40138

SEQ ID NO: 97457 - DNA, 1227 bp, Solanum tuberosum; identical to SEQ ID NO: 40139
  CDS (1)..(1227)

SEQ ID NO: 97458 - protein, 408 aa, Solanum tuberosum; identical to SEQ ID NO: 40140

SEQ ID NO: 97459 - DNA, 990 bp, Pisum sativum; identical to SEQ ID NO: 40141
  CDS (1)..(990)

SEQ ID NO: 97460 - protein, 329 aa, Pisum sativum; identical to SEQ ID NO: 40142

SEQ ID NO: 97461 - DNA, 1254 bp, Brassica napus; identical to SEQ ID NO: 40143
  CDS (1)..(1254)

SEQ ID NO: 97462 - protein, 417 aa, Brassica napus; identical to SEQ ID NO: 40144

SEQ ID NO: 97463 - DNA, 1050 bp, Rhizobium meliloti; identical to SEQ ID NO: 40145
  CDS (1)..(1050): transl_table=11

SEQ ID NO: 97464 - protein, 349 aa, Rhizobium meliloti; identical to SEQ ID NO: 40146

SEQ ID NO: 97465 - DNA, 1095 bp, Alcaligenes eutrophus; identical to SEQ ID NO: 40147
  CDS (1)..(1095): transl_table=11

SEQ ID NO: 97466 - protein, 364 aa, Alcaligenes eutrophus; identical to SEQ ID NO: 40148

SEQ ID NO: 97467 - DNA, 1050 bp, Anabaena sp; identical to SEQ ID NO: 40149
  CDS (1)..(1050): transl_table=11

SEQ ID NO: 97468 - protein, 349 aa, Anabaena sp; identical to SEQ ID NO: 40150

SEQ ID NO: 97469 - DNA, 1254 bp, Arabidopsis thaliana; identical to SEQ ID NO: 40151
  CDS (1)..(1254)

SEQ ID NO: 97470 - protein, 417 aa, Arabidopsis thaliana; identical to SEQ ID NO: 40152

SEQ ID NO: 97471 - DNA, 1236 bp, Brassica napus; identical to SEQ ID NO: 40153
  CDS (1)..(1236)

SEQ ID NO: 97472 - protein, 411 aa, Brassica napus; identical to SEQ ID NO: 40154

SEQ ID NO: 97473 - DNA, 1035 bp, Nitrobacter vulgaris; identical to SEQ ID NO: 40155
  CDS (1)..(1035): transl_table=11

SEQ ID NO: 97474 - protein, 344 aa, Nitrobacter vulgaris; identical to SEQ ID NO: 40156

SEQ ID NO: 97475 - DNA, 1050 bp, Nostoc punctiforme; identical to SEQ ID NO: 40157
  CDS (1)..(1050): transl_table=11

SEQ ID NO: 97476 - protein, 349 aa, Nostoc punctiforme; identical to SEQ ID NO: 40158

SEQ ID NO: 97477 - DNA, 1221 bp, Oryza sativa; identical to SEQ ID NO: 40159
  CDS (1)..(1221)

SEQ ID NO: 97478 - protein, 406 aa, Oryza sativa; identical to SEQ ID NO: 40160

SEQ ID NO: 97479 - DNA, 1224 bp, Pisum sativum; identical to SEQ ID NO: 40161
  CDS (1)..(1224)

SEQ ID NO: 97480 - protein, 407 aa, Pisum sativum; identical to SEQ ID NO: 40162

SEQ ID NO: 97481 - DNA, 1002 bp, Rhodobacter sphaeroides; identical to SEQ ID NO: 40163
  CDS (1)..(1002): transl_table=11

SEQ ID NO: 97482 - protein, 333 aa, Rhodobacter sphaeroides; identical to SEQ ID NO: 40164

SEQ ID NO: 97483 - DNA, 1209 bp, Glycine max; identical to SEQ ID NO: 40165
  CDS (1)..(1209)

SEQ ID NO: 97484 - protein, 402 aa, Glycine max; identical to SEQ ID NO: 40166

SEQ ID NO: 97485 - DNA, 1248 bp, Spinacia oleracea; identical to SEQ ID NO: 40167
  CDS (1)..(1248)

SEQ ID NO: 97486 - protein, 415 aa, Spinacia oleracea; identical to SEQ ID NO: 40168

SEQ ID NO: 97487 - DNA, 1044 bp, Synechocystis sp; identical to SEQ ID NO: 40169
  CDS (1)..(1044)

SEQ ID NO: 97488 - protein, 347 aa, Synechocystis sp; identical to SEQ ID NO: 40170

SEQ ID NO: 97489 - DNA, 1230 bp, Triticum aestivum; identical to SEQ ID NO: 40171
  CDS (1)..(1230)

SEQ ID NO: 97490 - protein, 409 aa, Triticum aestivum; identical to SEQ ID NO: 40172

SEQ ID NO: 97491 - DNA, 1095 bp, Xanthobacter flavus; identical to SEQ ID NO: 40173
  CDS (1)..(1095): transl_table=11

SEQ ID NO: 97492 - protein, 364 aa, Xanthobacter flavus; identical to SEQ ID NO: 40174

SEQ ID NO: 97493 - DNA, 990 bp, Beta vulgaris; identical to SEQ ID NO: 40175
  CDS (1)..(990)

SEQ ID NO: 97494 - protein, 329 aa, Beta vulgaris; identical to SEQ ID NO: 40176

SEQ ID NO: 97495 - DNA, 1020 bp, Brassica napus; identical to SEQ ID NO: 40177
  CDS (1)..(1020)

SEQ ID NO: 97496 - protein, 339 aa, Brassica napus; identical to SEQ ID NO: 40178

SEQ ID NO: 97497 - DNA, 1020 bp, Oryza sativa; identical to SEQ ID NO: 40179
  CDS (1)..(1020)

SEQ ID NO: 97498 - protein, 339 aa, Oryza sativa; identical to SEQ ID NO: 40180

SEQ ID NO: 97499 - DNA, 996 bp, Rhodobacter capsulatus; identical to SEQ ID NO: 40181
  CDS (1)..(996): transl_table=11

SEQ ID NO: 97500 - protein, 331 aa, Rhodobacter capsulatus; identical to SEQ ID NO: 40182

SEQ ID NO: 97501 - DNA, 996 bp, Saccharum hybrid; identical to SEQ ID NO: 40183
  CDS (1)..(996)

SEQ ID NO: 97502 - protein, 331 aa, Saccharum hybrid; identical to SEQ ID NO: 40184

SEQ ID NO: 97503 - DNA, 1023 bp, Solanum tuberosum; identical to SEQ ID NO: 40185
  CDS (1)..(1023)

SEQ ID NO: 97504 - protein, 340 aa, Solanum tuberosum; identical to SEQ ID NO: 40186

SEQ ID NO: 97505 - DNA, 1026 bp, Spinacia oleracea; identical to SEQ ID NO: 40187
  CDS (1)..(1026)

SEQ ID NO: 97506 - protein, 341 aa, Spinacia oleracea; identical to SEQ ID NO: 40188

SEQ ID NO: 97507 - DNA, 1095 bp, Alcaligenes eutrophus; identical to SEQ ID NO: 40189
  CDS (1)..(1095): transl_table=11

SEQ ID NO: 97508 - protein, 364 aa, Alcaligenes eutrophus; identical to SEQ ID NO: 40190

SEQ ID NO: 97509 - DNA, 996 bp, Rhodobacter sphaeroides; identical to SEQ ID NO: 40191
  CDS (1)..(996): transl_table=11

SEQ ID NO: 97510 - protein, 331 aa, Rhodobacter sphaeroides; identical to SEQ ID NO: 40192

SEQ ID NO: 97511 - DNA, 27 bp, Primer
atgaaaacgttaggtgaatttattgtc

SEQ ID NO: 97512 - DNA, 21 bp, Primer
ttacgcgtccgggaactcacg

SEQ ID NO: 97513 - protein, 334 aa, consensus; identical to SEQ ID NO: 40195
  MISC_FEATURE (1)..(334): consensus for the disclosure of xaa see table XV

SEQ ID NO: 97514 - protein, 80 aa, consensus; identical to SEQ ID NO: 40196
  MISC_FEATURE (1)..(80): consensus for the disclosure of xaa see table XV

SEQ ID NO: 97515 - protein, 78 aa, consensus; identical to SEQ ID NO: 40197
  MISC_FEATURE (1)..(78): consensus for the disclosure of xaa see table XV

SEQ ID NO: 97516 - protein, 90 aa, consensus; identical to SEQ ID NO: 40198
  MISC_FEATURE (1)..(90): consensus for the disclosure of xaa see table XV

SEQ ID NO: 97517 - DNA, 195 bp, Saccharomyces cerevisiae
  CDS (19)..(195)
caaatccttttgaacaagatgcatttgatgtacactttgggcccagacggcaagagaatctatacattgaaaaaggtcaccgaaagtggtgaaatcacgaagtctgctcacccagctagattttctccagacgacaaatattcaagacaaagagtaactttgaagaagagatttggtttggtaccaggccaatag

SEQ ID NO: 97518 - protein, 58 aa, Saccharomyces cerevisiae
MHLMYTLGPDGKRIYTLKKVTESGEITKSAHPARFSPDDKYSRQRVTLKKRFGLVPGQ

SEQ ID NO: 97519 - DNA, 195 bp, Arabidopsis thaliana
  CDS (1)..(195)
atgtatcttcagtgctatatcaacgagaagggtgagaaggtttacacaactaagaaggaatcaccgctagggctagccactgaatctgcccatccagcccggttctcccctgacgataaatactcaaagcagagagtattgttgaagaagcgatttggtctcttaccgacccaaaacgcacctctccagtactga

SEQ ID NO: 97520 - protein, 64 aa, Arabidopsis thaliana
MYLQCYINEKGEKVYTTKKESPLGLATESAHPARFSPDDKYSKQRVLLKKRFGLLPTQNAPLQY

SEQ ID NO: 97521 - DNA, 210 bp, Eremothecium gossypii
  CDS (1)..(210)
atgcgcaggccatctcctccgccaccaccacgcgccatgcatttgatgtacacactgggcccggacggcaagagagtctacaccctcgagaaggtcacgccttccggcgagatcaccaagtccgcgcaccctgcgcgcttctcgcccgacgacaagtactcccgccagcgtgtcactctcaagcgccgcttcgacatgttgccccgctaa

SEQ ID NO: 97522 - protein, 69 aa, Eremothecium gossypii
MRRPSPPPPPRAMHLMYTLGPDGKRVYTLEKVTPSGEITKSAHPARFSPDDKYSRQRVTLKRRFDMLPR

SEQ ID NO: 97523 - DNA, 195 bp, Anopheles gambiae str. PEST
  CDS (1)..(195)
atgtatctaatgtacgatttaaatgaaaatggcgaaagggtttacaccctgaagaaaaacaacgcagaaggcaagccgacccaatcagcacatccggcgagattttctccagaggacaagtactctcgctaccgtatcatcatcaagaaacgttttggattgctgctgacgcagaagcccgagcccgtgtactga

SEQ ID NO: 97524 - protein, 64 aa, Anopheles gambiae str. PEST
MYLMYDLNENGERVYTLKKNNAEGKPTQSAHPARFSPEDKYSRYRIIIKKRFGLLLTQKPEPVY

SEQ ID NO: 97525 - DNA, 204 bp, Magnaporthe grisea 70-15
  CDS (1)..(204)
atgcatctcatgtgcaacgtcgacgcctcgggcaagcgtgcctacaccctcaagaaggtgctcgagggcaaggtcaccaagtctgcgcacccggcgcgcttctcgcccgacgacaagtggtcgcgccaccgcataaccctcaagaagaggtttgggctgctgcagacggagaagaaggacctcaaggcgctccagtcatcatga

SEQ ID NO: 97526 - protein, 67 aa, Magnaporthe grisea 70-15
MHLMCNVDASGKRAYTLKKVLEGKVTKSAHPARFSPDDKWSRHRITLKKRFGLLQTEKKDLKALQSS

SEQ ID NO: 97527 - DNA, 204 bp, Gibberella zeae PH-1
  CDS (1)..(204)
atgcatctgatgtacaccctcgacgcccaaggcaaccgcctttacaccttgaagaaggtcgctcagggccaggtcaccaagtctgctcaccctgcccgtttctctcccgacgacaagtggtcgcgccagcgcgttactctcaagcgcagattcgagcttctcttgactcagcagaaaactaatgcttttccagaggaggaataa

SEQ ID NO: 97528 - protein, 67 aa, Gibberella zeae PH-1
MHLMYTLDAQGNRLYTLKKVAQGQVTKSAHPARFSPDDKWSRQRVTLKRRFELLLTQQKTNAFPEEE

SEQ ID NO: 97529 - DNA, 195 bp, Ustilago maydis 521
  CDS (1)..(195)
atgcatctcatgttcacagaagataaggatggcaagcgaatctacacgctcaagaaaaagactgtcgaaggcgtgatcaccaagtcggcccatcctgctcgcttctcgcctgacgacaaattttcacgacaccgcgttacgatcaagaagcgctttggtatcctgcctacgcagctgcccgctaagccactgtaa

SEQ ID NO: 97530 - protein, 64 aa, Ustilago maydis 521
MHLMFTEDKDGKRIYTLKKKTVEGVITKSAHPARFSPDDKFSRHRVTIKKRFGILPTQLPAKPL

SEQ ID NO: 97531 - DNA, 204 bp, Aspergillus nidulans FGSC A4
  CDS (1)..(204)
atgcatcttatgtatactttggaccaggatggaaagcgggtttataccctgaagaaggtcactcccaccggggaggtcacaaagagcgctcaccccgctcgcttttctccggacgacaagtattctcgtcaccgtgttacgctgaagaagagatatggccttctgcttacccagcaggctggtatgttgattagtcccttttaa

SEQ ID NO: 97532 - protein, 67 aa, Aspergillus nidulans FGSC A4
MHLMYTLDQDGKRVYTLKKVTPTGEVTKSAHPARFSPDDKYSRHRVTLKKRYGLLLTQQAGMLISPF

SEQ ID NO: 97533 - DNA, 777 bp, Oryza sativa (japonica cultivar-group)
  CDS (1)..(777)
atggccgtctcccccgtgcgcggcgtgcgctctctcccctcccactcgacggcgtcacggcgacagcgctcccgcgacgcgagccggcaggccggccgccggcgcgactccggcgctcctgcccccgccactcctcccggctggccggctcctgcggtcccgccaggtgcacgcgcccagccgtggcggcggcgccgcgccggcgcccgcacggacacgtcctctctccgtcccgccgcgccttccggccatcgcctggtggcctcccgcaggccacagtcctgctcccgtcgtcccggcgtcccgctcccggctcccgccccgcccgagcccgacggtcgacgctgccagcggctagcacagcagcgcccagtcggcagccgcccaggccggccggcggccggcgccactccatctccggctcttcgcctctccggactccggccgaacactggtttcaagcccatcaacaccgcctccacgccgacgcccgcaaccagcccaacccagccaaaccgccaacttagaaaaacggagcaaagccggctaacttacctcttctttaggctgcgtcgatcgaagatgtatctccagtactacatcaacgagaagggggacaaggtgtacaccaccaagaaggaatctcctctcggtgttcccacgcagtctgctcacccagctcgcttctctccagatgacaagtactcacgccagagatacctgttgaagaagagattcgggttgctgccaacccaaaagccagcaccaaagtactga

SEQ ID NO: 97534 - protein, 258 aa, Oryza sativa (japonica cultivar-group)
MAVSPVRGVRSLPSHSTASRRQRSRDASRQAGRRRDSGAPAPATPPGWPAPAVPPGARAQPWRRRRAGARTDTSSLRPAAPSGHRLVASRRPQSCSRRPGVPLPAPAPPEPDGRRCQRLAQQRPVGSRPGRPAAGATPSPALRLSGLRPNTGFKPINTASTPTPATSPTQPNRQLRKTEQSRLTYLFFRLRRSKMYLQYYINEKGDKVYTTKKESPLGVPTQSAHPARFSPDDKYSRQRYLLKKRFGLLPTQKPAPKY

SEQ ID NO: 97535 - DNA, 189 bp, Yarrowia lipolytica CLIB99
  CDS (1)..(189)
atgcatcttatgtacactactggaagcgacggcaagcgggtctatactctcaagaagaccaccgagtctggcgagattaccaagagcgcccaccccgcccgattctctcccgacgacaagtactctcgacagcgagtcactctcaagaagcgattcaacctgttgcctactcagcagggtgagtattaa

SEQ ID NO: 97536 - protein, 62 aa, Yarrowia lipolytica CLIB99
MHLMYTTGSDGKRVYTLKKTTESGEITKSAHPARFSPDDKYSRQRVTLKKRFNLLPTQQGEY

SEQ ID NO: 97537 - DNA, 195 bp, Cryptococcus neoformans var. neoformans JEC21
  CDS (1)..(195)
atgcaccttatgtatactttggatgagaggggaaaccgagtttacactctcaaaaaagtgactgctgctggcaagcccacgaagtccgcccatcctgctcgattttctcccgatgacaagttttccagacaccgagtcaccatcaagaagcgatttgggatcctccccacccagcttccttgcaagcccttataa

SEQ ID NO: 97538 - protein, 64 aa, Cryptococcus neoformans var. neoformans JEC21
MHLMYTLDERGNRVYTLKKVTAAGKPTKSAHPARFSPDDKFSRHRVTIKKRFGILPTQLPCKPL

SEQ ID NO: 97539 - DNA, 195 bp, Arabidopsis thaliana
  CDS (1)..(195)
atgtatcttcagtgctatatcaacgagaagggtgagaaggtttacacaactaagaaggaatcaccgctagggctagccactgaatctgcccatccagcccggttcccccctgacgataaatactcaaagcagagagtattgttgaagaagcgatttggtctcttaccgacccaaaacgcacctctccagtactga

SEQ ID NO: 97540 - protein, 64 aa, Arabidopsis thaliana
MYLQCYINEKGEKVYTTKKESPLGLATESAHPARFPPDDKYSKQRVLLKKRFGLLPTQNAPLQY

SEQ ID NO: 97541 - DNA, 174 bp, Ashbya gossypii
  CDS (1)..(174)
atgcatttgatgtacacactgggcccggacggcaagagagtctacaccctcgagaaggtcacgccttccggcgagatcaccaagtccgcgcaccctgcgcgcttctcgcccgacgacaagtactcccgccagcgtgtcactctcaagcgccgcttcgacatgttgccccgctaa

SEQ ID NO: 97542 - protein, 57 aa, Ashbya gossypii
MHLMYTLGPDGKRVYTLEKVTPSGEITKSAHPARFSPDDKYSRQRVTLKRRFDMLPR

SEQ ID NO: 97543 - DNA, 195 bp, Brachydanio rerio
  CDS (1)..(195)
atgttcctgcagttttacctcaatgagaatggcgagagggtttacactctgaagaaagtggaccccagtggtcagcccaccagctcggctcatccggcccgattctcacccgacgacaagttctccaggcaccgagtgaccatcaagaagagattcggactcctgctgacgcaacaaccccggcctgtgctctaa

SEQ ID NO: 97544 - protein, 64 aa, Brachydanio rerio
MFLQFYLNENGERVYTLKKVDPSGQPTSSAHPARFSPDDKFSRHRVTIKKRFGLLLTQQPRPVL

SEQ ID NO: 97545 - DNA, 195 bp, Caenorhabditis elegans
  CDS (1)..(195)
atgttcttgagatacttcttggacgagaaccaacaaagagtgtacactttgaagagaactgctccatctggagagcaaactcttaccgctcatccagctcgcttttcgccggaagacaagaactccaaatatcgcatcatcatcaagaagcgcttcggactcttgccaacccagaaggcaaagaccgtttgctaa

SEQ ID NO: 97546 - protein, 64 aa, Caenorhabditis elegans
MFLRYFLDENQQRVYTLKRTAPSGEQTLTAHPARFSPEDKNSKYRIIIKKRFGLLPTQKAKTVC

SEQ ID NO: 97547 - DNA, 174 bp, Candida glabrata
  CDS (1)..(174)
atgcatttgatgtacactttggacaacgagggtaagagagtttacaccctgaagaagatgaccgaggaaggtgagattaccaagtctgctcatccagctagattttccccagatgacaagtactctagacaaagagttactctgaagaagagatataacttgcttccacaataa

SEQ ID NO: 97548 - protein, 57 aa, Candida glabrata
MHLMYTLDNEGKRVYTLKKMTEEGEITKSAHPARFSPDDKYSRQRVTLKKRYNLLPQ

SEQ ID NO: 97549 - DNA, 177 bp, Debaryomyces hansenii
  CDS (1)..(177)
atgcatttaatgtacacattagggccagacggcaagagagtctacactttaaacaaaaccacttcagatggtgaaattaccaagtctgctcatccagccagattttcaccagatgacaaatattccagacaaagagttaccttgaagaagagatttggtttattaccaacccaatag

SEQ ID NO: 97550 - protein, 58 aa, Debaryomyces hansenii
MHLMYTLGPDGKRVYTLNKTTSDGEITKSAHPARFSPDDKYSRQRVTLKKRFGLLPTQ

SEQ ID NO: 97551 - DNA, 195 bp, Drosophila melanogaster
  CDS (1)..(195)
atgtatctgatgtacacaattaacgaaaacggcgatcgcgtttacaccctgaagaaacgcaccgaggatggtcgtcccacactatctgctcatccagcacgtttttcaccggaggataagtactcccgccagaggctgaccatcaagaagcgctttggactgctgctcacccagaagccggagcccatttactaa

SEQ ID NO: 97552 - protein, 64 aa, Drosophila melanogaster
MYLMYTINENGDRVYTLKKRTEDGRPTLSAHPARFSPEDKYSRQRLTIKKRFGLLLTQKPEPIY

SEQ ID NO: 97553 - DNA, 195 bp, Homo sapiens
  CDS (1)..(195)
atgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctga

SEQ ID NO: 97554 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 97555 - DNA, 174 bp, Kluyveromyces lactis
  CDS (1)..(174)
atgcatttgatgtacactttggatgcccaaggcaagagaatctatactttgaagaagatgactgaggataatgaaattacaaagtctgctcaccctgctagattctctccagatgacaaatactccagacaaagagttactttgaagaagagatacaaccttttgccaaactaa

SEQ ID NO: 97556 - protein, 57 aa, Kluyveromyces lactis
MHLMYTLDAQGKRIYTLKKMTEDNEITKSAHPARFSPDDKYSRQRVTLKKRYNLLPN

SEQ ID NO: 97557 - DNA, 195 bp, Schizosaccharomyces pombe
  CDS (1)..(195)
atgcatttgatgtattatttaaatgatgagggaaagcgtgtttatactttaaaaaaggtatctccagatggaagagtcacaaaatcttcgcatcctgctcgtttctctcctgacgataaatattctcgacaacgttatactctgaaaaaacggtttcatgtactacttactcaattgcctgcaaaaccttactga

SEQ ID NO: 97558 - protein, 64 aa, Schizosaccharomyces pombe
MHLMYYLNDEGKRVYTLKKVSPDGRVTKSSHPARFSPDDKYSRQRYTLKKRFHVLLTQLPAKPY

SEQ ID NO: 97559 - DNA, 192 bp, Trypanosoma cruzi
  CDS (1)..(192)
atgcacctgcaagtgtacatcgtgaatggcaagcggcaatatacgctgaagaagatggatccagagggcaaaccgacgctcagcgcccatcccgctcgctttagccccgacgacaaatacagtcggcatcgcatcactattaaacgccgcttcaaggcacttaaatcggagaagcgccccaagccgctgtag

SEQ ID NO: 97560 - protein, 63 aa, Trypanosoma cruzi
MHLQVYIVNGKRQYTLKKMDPEGKPTLSAHPARFSPDDKYSRHRITIKRRFKALKSEKRPKPL

SEQ ID NO: 97561 - DNA, 25 bp, Primer
atgcatttgatgtacactttgggcc

SEQ ID NO: 97562 - DNA, 25 bp, Primer
ctattggcctggtaccaaaccaaat

SEQ ID NO: 97563 - protein, 55 aa, consensus
  MISC_FEATURE (1)..(55): consensus for the disclosure of xaa see table XV
MXLXXXXXXXGXRXYTLKKXXXXGXXTXSAHPARFSPDDKXSRXRXXXKKRFXXL

SEQ ID NO: 97564 - protein, 45 aa, consensus
  MISC_FEATURE (1)..(45): consensus for the disclosure of xaa see table XV
XXXXYTXXXXXXXXXXTXXXHPARFXPXDKXSXXRXXXKXRXXXX

SEQ ID NO: 97565 - DNA, 405 bp, Escherichia coli; identical to SEQ ID NO: 44449
  CDS (1)..(405)

SEQ ID NO: 97566 - protein, 134 aa, Escherichia coli; identical to SEQ ID NO: 44450

SEQ ID NO: 97567 - DNA, 303 bp, Shigella flexneri; identical to SEQ ID NO: 44451
  CDS (1)..(303): transl_table=11

SEQ ID NO: 97568 - protein, 100 aa, Shigella flexneri; identical to SEQ ID NO: 44452

SEQ ID NO: 97569 - DNA, 303 bp, Shigella flexneri; identical to SEQ ID NO: 44453
  CDS (1)..(303): transl_table=11

SEQ ID NO: 97570 - protein, 100 aa, Shigella flexneri; identical to SEQ ID NO: 44454

SEQ ID NO: 97571 - DNA, 303 bp, Shigella flexneri; identical to SEQ ID NO: 44455
  CDS (1)..(303): transl_table=11

SEQ ID NO: 97572 - protein, 100 aa, Shigella flexneri; identical to SEQ ID NO: 44456

SEQ ID NO: 97573 - DNA, 339 bp, Shigella flexneri; identical to SEQ ID NO: 44457
  CDS (1)..(339): transl_table=11

SEQ ID NO: 97574 - protein, 112 aa, Shigella flexneri; identical to SEQ ID NO: 44458

SEQ ID NO: 97575 - DNA, 297 bp, Mesorhizobium loti MAFF303099; identical to SEQ ID NO: 44459
  CDS (1)..(297): transl_table=11

SEQ ID NO: 97576 - protein, 98 aa, Mesorhizobium loti MAFF303099; identical to SEQ ID NO: 44460

SEQ ID NO: 97577 - DNA, 297 bp, Mesorhizobium loti MAFF303099; identical to SEQ ID NO: 44461
  CDS (1)..(297): transl_table=11

SEQ ID NO: 97578 - protein, 98 aa, Mesorhizobium loti MAFF303099; identical to SEQ ID NO: 44462

SEQ ID NO: 97579 - DNA, 345 bp, Vibrio cholerae O1 biovar eltor str. N16961; identical to SEQ ID NO: 44463
  CDS (1)..(345): transl_table=11

SEQ ID NO: 97580 - protein, 114 aa, Vibrio cholerae O1 biovar eltor str. N16961; identical to SEQ ID NO: 44464

SEQ ID NO: 97581 - DNA, 285 bp, Bacillus halodurans C-125; identical to SEQ ID NO: 44465
  CDS (1)..(285): transl_table=11

SEQ ID NO: 97582 - protein, 94 aa, Bacillus halodurans C-125; identical to SEQ ID NO: 44466

SEQ ID NO: 97583 - DNA, 309 bp, Pseudomonas aeruginosa PAO1; identical to SEQ ID NO: 44467
  CDS (1)..(309): transl_table=11

SEQ ID NO: 97584 - protein, 102 aa, Pseudomonas aeruginosa PAO1; identical to SEQ ID NO: 44468

SEQ ID NO: 97585 - DNA, 288 bp, Pseudomonas aeruginosa PAO1; identical to SEQ ID NO: 44469
  CDS (1)..(288): transl_table=11

SEQ ID NO: 97586 - protein, 95 aa, Pseudomonas aeruginosa PAO1; identical to SEQ ID NO: 44470

SEQ ID NO: 97587 - DNA, 309 bp, Pseudomonas aeruginosa PAO1; identical to SEQ ID NO: 44471
  CDS (1)..(309): transl_table=11

SEQ ID NO: 97588 - protein, 102 aa, Pseudomonas aeruginosa PAO1; identical to SEQ ID NO: 44472

SEQ ID NO: 97589 - DNA, 291 bp, Lactococcus lactis subsp. lactis Il1403; identical to SEQ ID NO: 44473
  CDS (1)..(291): transl_table=11

SEQ ID NO: 97590 - protein, 96 aa, Lactococcus lactis subsp. lactis Il1403; identical to SEQ ID NO: 44474

SEQ ID NO: 97591 - DNA, 291 bp, Lactococcus lactis subsp. lactis Il1403; identical to SEQ ID NO: 44475
  CDS (1)..(291): transl_table=11

SEQ ID NO: 97592 - protein, 96 aa, Lactococcus lactis subsp. lactis Il1403; identical to SEQ ID NO: 44476

SEQ ID NO: 97593 - DNA, 345 bp, Deinococcus radiodurans R1; identical to SEQ ID NO: 44477
  CDS (1)..(345): transl_table=11

SEQ ID NO: 97594 - protein, 114 aa, Deinococcus radiodurans R1; identical to SEQ ID NO: 44478

SEQ ID NO: 97595 - DNA, 342 bp, Escherichia coli O157:H7; identical to SEQ ID NO: 44479
  CDS (1)..(342): transl_table=11

SEQ ID NO: 97596 - protein, 113 aa, Escherichia coli O157:H7; identical to SEQ ID NO: 44480

SEQ ID NO: 97597 - DNA, 345 bp, Escherichia coli O157:H7; identical to SEQ ID NO: 44481
  CDS (1)..(345): transl_table=11

SEQ ID NO: 97598 - protein, 114 aa, Escherichia coli O157:H7; identical to SEQ ID NO: 44482

SEQ ID NO: 97599 - DNA, 351 bp, Escherichia coli O157:H7; identical to SEQ ID NO: 44483
  CDS (1)..(351): transl_table=11

SEQ ID NO: 97600 - protein, 116 aa, Escherichia coli O157:H7; identical to SEQ ID NO: 44484

SEQ ID NO: 97601 - DNA, 309 bp, Ralstonia solanacearum GMI1000; identical to SEQ ID NO: 44485
  CDS (1)..(309): transl_table=11

SEQ ID NO: 97602 - protein, 102 aa, Ralstonia solanacearum GMI1000; identical to SEQ ID NO: 44486

SEQ ID NO: 97603 - DNA, 294 bp, Ralstonia solanacearum GMI1000; identical to SEQ ID NO: 44487
  CDS (1)..(294): transl_table=11

SEQ ID NO: 97604 - protein, 97 aa, Ralstonia solanacearum GMI1000; identical to SEQ ID NO: 44488

SEQ ID NO: 97605 - DNA, 291 bp, Agrobacterium tumefaciens str. C58; identical to SEQ ID NO: 44489
  CDS (1)..(291): transl_table=11

SEQ ID NO: 97606 - protein, 96 aa, Agrobacterium tumefaciens str. C58; identical to SEQ ID NO: 44490

SEQ ID NO: 97607 - DNA, 294 bp, Xanthomonas campestris pv. campestris str. ATCC 33913; identical to SEQ ID NO: 44491
  CDS (1)..(294): transl_table=11

SEQ ID NO: 97608 - protein, 97 aa, Xanthomonas campestris pv. campestris str. ATCC 33913; identical to SEQ ID NO: 44492

SEQ ID NO: 97609 - DNA, 294 bp, Xanthomonas campestris pv. campestris str. ATCC 33913; identical to SEQ ID NO: 44493
  CDS (1)..(294): transl_table=11

SEQ ID NO: 97610 - protein, 97 aa, Xanthomonas campestris pv. campestris str. ATCC 33913; identical to SEQ ID NO: 44494

SEQ ID NO: 97611 - DNA, 288 bp, Proteus vulgaris; identical to SEQ ID NO: 44495
  CDS (1)..(288): transl_table=11

SEQ ID NO: 97612 - protein, 95 aa, Proteus vulgaris; identical to SEQ ID NO: 44496

SEQ ID NO: 97613 - DNA, 312 bp, Proteus vulgaris; identical to SEQ ID NO: 44497
  CDS (1)..(312): transl_table=11

SEQ ID NO: 97614 - protein, 103 aa, Proteus vulgaris; identical to SEQ ID NO: 44498

SEQ ID NO: 97615 - DNA, 273 bp, Xanthomonas axonopodis pv. citri str. 306; identical to SEQ ID NO: 44499
  CDS (1)..(273): transl_table=11

SEQ ID NO: 97616 - protein, 90 aa, Xanthomonas axonopodis pv. citri str. 306; identical to SEQ ID NO: 44500

SEQ ID NO: 97617 - DNA, 282 bp, Brucella suis 1330; identical to SEQ ID NO: 44501
  CDS (1)..(282): transl_table=11

SEQ ID NO: 97618 - protein, 93 aa, Brucella suis 1330; identical to SEQ ID NO: 44502

SEQ ID NO: 97619 - DNA, 294 bp, Corynebacterium efficiens; identical to SEQ ID NO: 44503
  CDS (1)..(294): transl_table=11

SEQ ID NO: 97620 - protein, 97 aa, Corynebacterium efficiens; identical to SEQ ID NO: 44504

SEQ ID NO: 97621 - DNA, 303 bp, Shigella flexneri 2a str. 301; identical to SEQ ID NO: 44505
  CDS (1)..(303): transl_table=11

SEQ ID NO: 97622 - protein, 100 aa, Shigella flexneri 2a str. 301; identical to SEQ ID NO: 44506

SEQ ID NO: 97623 - DNA, 363 bp, Shigella flexneri 2a str. 301; identical to SEQ ID NO: 44507
  CDS (1)..(363): transl_table=11

SEQ ID NO: 97624 - protein, 120 aa, Shigella flexneri 2a str. 301; identical to SEQ ID NO: 44508

SEQ ID NO: 97625 - DNA, 285 bp, Shigella flexneri 2a str. 301; identical to SEQ ID NO: 44509
  CDS (1)..(285): transl_table=11

SEQ ID NO: 97626 - protein, 94 aa, Shigella flexneri 2a str. 301; identical to SEQ ID NO: 44510

SEQ ID NO: 97627 - DNA, 306 bp, Leptospira interrogans serovar Lai str. 56601; identical to SEQ ID NO: 44511
  CDS (1)..(306): transl_table=11

SEQ ID NO: 97628 - protein, 101 aa, Leptospira interrogans serovar Lai str. 56601; identical to SEQ ID NO: 44512

SEQ ID NO: 97629 - DNA, 291 bp, Shewanella oneidensis MR-1; identical to SEQ ID NO: 44513
  CDS (1)..(291): transl_table=11

SEQ ID NO: 97630 - protein, 96 aa, Shewanella oneidensis MR-1; identical to SEQ ID NO: 44514

SEQ ID NO: 97631 - DNA, 297 bp, Vibrio vulnificus CMCP6; identical to SEQ ID NO: 44515
  CDS (1)..(297): transl_table=11

SEQ ID NO: 97632 - protein, 98 aa, Vibrio vulnificus CMCP6; identical to SEQ ID NO: 44516

SEQ ID NO: 97633 - DNA, 300 bp, Bradyrhizobium japonicum USDA 110; identical to SEQ ID NO: 44517
  CDS (1)..(300)

SEQ ID NO: 97634 - protein, 99 aa, Bradyrhizobium japonicum USDA 110; identical to SEQ ID NO: 44518

SEQ ID NO: 97635 - DNA, 303 bp, Shigella flexneri 2a str. 2457T; identical to SEQ ID NO: 44519
  CDS (1)..(303): transl_table=11

SEQ ID NO: 97636 - protein, 100 aa, Shigella flexneri 2a str. 2457T; identical to SEQ ID NO: 44520

SEQ ID NO: 97637 - DNA, 303 bp, Nitrosomonas europaea ATCC 19718; identical to SEQ ID NO: 44521
  CDS (1)..(303): transl_table=11

SEQ ID NO: 97638 - protein, 100 aa, Nitrosomonas europaea ATCC 19718; identical to SEQ ID NO: 44522

SEQ ID NO: 97639 - DNA, 285 bp, Escherichia coli; identical to SEQ ID NO: 44523
  CDS (1)..(285): transl_table=11

SEQ ID NO: 97640 - protein, 94 aa, Escherichia coli; identical to SEQ ID NO: 44524

SEQ ID NO: 97641 - DNA, 276 bp, Salmonella typhimurium; identical to SEQ ID NO: 44525
  CDS (1)..(276): transl_table=11

SEQ ID NO: 97642 - protein, 91 aa, Salmonella typhimurium; identical to SEQ ID NO: 44526

SEQ ID NO: 97643 - DNA, 291 bp, Rhodopirellula baltica SH 1; identical to SEQ ID NO: 44527
  CDS (1)..(291): transl_table=11

SEQ ID NO: 97644 - protein, 96 aa, Rhodopirellula baltica SH 1; identical to SEQ ID NO: 44528

SEQ ID NO: 97645 - DNA, 303 bp, Photorhabdus luminescens subsp. laumondii TTO1; identical to SEQ ID NO: 44529
  CDS (1)..(303): transl_table=11

SEQ ID NO: 97646 - protein, 100 aa, Photorhabdus luminescens subsp. laumondii TTO1; identical to SEQ ID NO: 44530

SEQ ID NO: 97647 - DNA, 309 bp, Corynebacterium diphtheriae NCTC 13129; identical to SEQ ID NO: 44531
  CDS (1)..(309): transl_table=11

SEQ ID NO: 97648 - protein, 102 aa, Corynebacterium diphtheriae NCTC 13129; identical to SEQ ID NO: 44532

SEQ ID NO: 97649 - DNA, 297 bp, Cupriavidus necator; identical to SEQ ID NO: 44533
  CDS (1)..(297): transl_table=11

SEQ ID NO: 97650 - protein, 98 aa, Cupriavidus necator; identical to SEQ ID NO: 44534

SEQ ID NO: 97651 - DNA, 333 bp, Pseudomonas sp. ND6; identical to SEQ ID NO: 44535
  CDS (1)..(333): transl_table=11

SEQ ID NO: 97652 - protein, 110 aa, Pseudomonas sp. ND6; identical to SEQ ID NO: 44536

SEQ ID NO: 97653 - DNA, 303 bp, Enterobacteria phage Sf6; identical to SEQ ID NO: 44537
  CDS (1)..(303): transl_table=11

SEQ ID NO: 97654 - protein, 100 aa, Enterobacteria phage Sf6; identical to SEQ ID NO: 44538

SEQ ID NO: 97655 - DNA, 306 bp, Leptospira interrogans serovar Copenhageni str. Fiocruz L1-130; identical to SEQ ID NO: 44539
  CDS (1)..(306): transl_table=11

SEQ ID NO: 97656 - protein, 101 aa, Leptospira interrogans serovar Copenhageni str. Fiocruz L1-130; identical to SEQ ID NO: 44540

SEQ ID NO: 97657 - DNA, 390 bp, Mycobacterium ulcerans; identical to SEQ ID NO: 44541
  CDS (1)..(390): transl_table=11

SEQ ID NO: 97658 - protein, 129 aa, Mycobacterium ulcerans; identical to SEQ ID NO: 44542

SEQ ID NO: 97659 - DNA, 309 bp, Pseudomonas syringae pv. maculicola; identical to SEQ ID NO: 44543
  CDS (1)..(309): transl_table=11

SEQ ID NO: 97660 - protein, 102 aa, Pseudomonas syringae pv. maculicola; identical to SEQ ID NO: 44544

SEQ ID NO: 97661 - DNA, 309 bp, Acinetobacter sp. ADP1; identical to SEQ ID NO: 44545
  CDS (1)..(309): transl_table=11

SEQ ID NO: 97662 - protein, 102 aa, Acinetobacter sp. ADP1; identical to SEQ ID NO: 44546

SEQ ID NO: 97663 - DNA, 303 bp, Desulfotalea psychrophila LSv54; identical to SEQ ID NO: 44547
  CDS (1)..(303): transl_table=11

SEQ ID NO: 97664 - protein, 100 aa, Desulfotalea psychrophila LSv54; identical to SEQ ID NO: 44548

SEQ ID NO: 97665 - DNA, 318 bp, Yersinia pseudotuberculosis IP 32953; identical to SEQ ID NO: 44549
  CDS (1)..(318): transl_table=11

SEQ ID NO: 97666 - protein, 105 aa, Yersinia pseudotuberculosis IP 32953; identical to SEQ ID NO: 44550

SEQ ID NO: 97667 - DNA, 315 bp, Mannheimia succiniciproducens MBEL55E; identical to SEQ ID NO: 44551
  CDS (1)..(315): transl_table=11

SEQ ID NO: 97668 - protein, 104 aa, Mannheimia succiniciproducens MBEL55E; identical to SEQ ID NO: 44552

SEQ ID NO: 97669 - DNA, 315 bp, Mannheimia succiniciproducens MBEL55E; identical to SEQ ID NO: 44553
  CDS (1)..(315): transl_table=11

SEQ ID NO: 97670 - protein, 104 aa, Mannheimia succiniciproducens MBEL55E; identical to SEQ ID NO: 44554

SEQ ID NO: 97671 - DNA, 294 bp, Legionella pneumophila subsp. pneumophila str. Philadelphia 1; identical to SEQ ID NO: 44555
  CDS (1)..(294): transl_table=11

SEQ ID NO: 97672 - protein, 97 aa, Legionella pneumophila subsp. pneumophila str. Philadelphia 1; identical to SEQ ID NO: 44556

SEQ ID NO: 97673 - DNA, 303 bp, Burkholderia pseudomallei K96243; identical to SEQ ID NO: 44557
  CDS (1)..(303): transl_table=11

SEQ ID NO: 97674 - protein, 100 aa, Burkholderia pseudomallei K96243; identical to SEQ ID NO: 44558

SEQ ID NO: 97675 - DNA, 294 bp, Legionella pneumophila str. Lens; identical to SEQ ID NO: 44559
  CDS (1)..(294): transl_table=11

SEQ ID NO: 97676 - protein, 97 aa, Legionella pneumophila str. Lens; identical to SEQ ID NO: 44560

SEQ ID NO: 97677 - DNA, 279 bp, Idiomarina loihiensis L2TR; identical to SEQ ID NO: 44561
  CDS (1)..(279): transl_table=11

SEQ ID NO: 97678 - protein, 92 aa, Idiomarina loihiensis L2TR; identical to SEQ ID NO: 44562

SEQ ID NO: 97679 - DNA, 300 bp, Desulfitobacterium hafniense DCB-2; identical to SEQ ID NO: 44563
  CDS (1)..(300)

SEQ ID NO: 97680 - protein, 99 aa, Desulfitobacterium hafniense DCB-2; identical to SEQ ID NO: 44564

SEQ ID NO: 97681 - DNA, 300 bp, Pseudomonas syringae pv. syringae B728a; identical to SEQ ID NO: 44565
  CDS (1)..(300)

SEQ ID NO: 97682 - protein, 99 aa, Pseudomonas syringae pv. syringae B728a; identical to SEQ ID NO: 44566

SEQ ID NO: 97683 - DNA, 300 bp, Psychrobacter sp. 273-4; identical to SEQ ID NO: 44567
  CDS (1)..(300)

SEQ ID NO: 97684 - protein, 99 aa, Psychrobacter sp. 273-4; identical to SEQ ID NO: 44568

SEQ ID NO: 97685 - DNA, 297 bp, Psychrobacter sp. 273-4; identical to SEQ ID NO: 44569
  CDS (1)..(297)

SEQ ID NO: 97686 - protein, 98 aa, Psychrobacter sp. 273-4; identical to SEQ ID NO: 44570

SEQ ID NO: 97687 - DNA, 312 bp, Psychrobacter sp. 273-4; identical to SEQ ID NO: 44571
  CDS (1)..(312)

SEQ ID NO: 97688 - protein, 103 aa, Psychrobacter sp. 273-4; identical to SEQ ID NO: 44572

SEQ ID NO: 97689 - DNA, 303 bp, Burkholderia fungorum LB400; identical to SEQ ID NO: 44573
  CDS (1)..(303)

SEQ ID NO: 97690 - protein, 100 aa, Burkholderia fungorum LB400; identical to SEQ ID NO: 44574

SEQ ID NO: 97691 - DNA, 297 bp, Burkholderia fungorum LB400; identical to SEQ ID NO: 44575
  CDS (1)..(297)

SEQ ID NO: 97692 - protein, 98 aa, Burkholderia fungorum LB400; identical to SEQ ID NO: 44576

SEQ ID NO: 97693 - DNA, 291 bp, Enterococcus faecium; identical to SEQ ID NO: 44577
  CDS (1)..(291)

SEQ ID NO: 97694 - protein, 96 aa, Enterococcus faecium; identical to SEQ ID NO: 44578

SEQ ID NO: 97695 - DNA, 330 bp, Enterococcus faecium; identical to SEQ ID NO: 44579
  CDS (1)..(330)

SEQ ID NO: 97696 - protein, 109 aa, Enterococcus faecium; identical to SEQ ID NO: 44580

SEQ ID NO: 97697 - DNA, 291 bp, Enterococcus faecium; identical to SEQ ID NO: 44581
  CDS (1)..(291)

SEQ ID NO: 97698 - protein, 96 aa, Enterococcus faecium; identical to SEQ ID NO: 44582

SEQ ID NO: 97699 - DNA, 291 bp, Enterococcus faecium; identical to SEQ ID NO: 44583
  CDS (1)..(291)

SEQ ID NO: 97700 - protein, 96 aa, Enterococcus faecium; identical to SEQ ID NO: 44584

SEQ ID NO: 97701 - DNA, 291 bp, Enterococcus faecium; identical to SEQ ID NO: 44585
  CDS (1)..(291)

SEQ ID NO: 97702 - protein, 96 aa, Enterococcus faecium; identical to SEQ ID NO: 44586

SEQ ID NO: 97703 - DNA, 291 bp, Enterococcus faecium; identical to SEQ ID NO: 44587
  CDS (1)..(291)

SEQ ID NO: 97704 - protein, 96 aa, Enterococcus faecium; identical to SEQ ID NO: 44588

SEQ ID NO: 97705 - DNA, 288 bp, Desulfovibrio desulfuricans G20; identical to SEQ ID NO: 44589
  CDS (1)..(288)

SEQ ID NO: 97706 - protein, 95 aa, Desulfovibrio desulfuricans G20; identical to SEQ ID NO: 44590

SEQ ID NO: 97707 - DNA, 306 bp, Polaromonas sp. JS666; identical to SEQ ID NO: 44591
  CDS (1)..(306)

SEQ ID NO: 97708 - protein, 101 aa, Polaromonas sp. JS666; identical to SEQ ID NO: 44592

SEQ ID NO: 97709 - DNA, 300 bp, Leptospira interrogans; identical to SEQ ID NO: 44593
  CDS (1)..(300): transl_table=11

SEQ ID NO: 97710 - protein, 99 aa, Leptospira interrogans; identical to SEQ ID NO: 44594

SEQ ID NO: 97711 - DNA, 300 bp, Leptospira interrogans; identical to SEQ ID NO: 44595
  CDS (1)..(300): transl_table=11

SEQ ID NO: 97712 - protein, 99 aa, Leptospira interrogans; identical to SEQ ID NO: 44596

SEQ ID NO: 97713 - DNA, 291 bp, Enterococcus faecium; identical to SEQ ID NO: 44597
  CDS (1)..(291): transl_table=11

SEQ ID NO: 97714 - protein, 96 aa, Enterococcus faecium; identical to SEQ ID NO: 44598

SEQ ID NO: 97715 - DNA, 369 bp, Escherichia coli; identical to SEQ ID NO: 44599
  CDS (1)..(369): transl_table=11

SEQ ID NO: 97716 - protein, 122 aa, Escherichia coli; identical to SEQ ID NO: 44600

SEQ ID NO: 97717 - DNA, 339 bp, Escherichia coli; identical to SEQ ID NO: 44601
  CDS (1)..(339): transl_table=11

SEQ ID NO: 97718 - protein, 112 aa, Escherichia coli; identical to SEQ ID NO: 44602

SEQ ID NO: 97719 - DNA, 348 bp, Escherichia coli; identical to SEQ ID NO: 44603
  CDS (1)..(348): transl_table=11

SEQ ID NO: 97720 - protein, 115 aa, Escherichia coli; identical to SEQ ID NO: 44604

SEQ ID NO: 97721 - DNA, 357 bp, Yersinia enterocolitica; identical to SEQ ID NO: 44605
  CDS (1)..(357): transl_table=11

SEQ ID NO: 97722 - protein, 118 aa, Yersinia enterocolitica; identical to SEQ ID NO: 44606

SEQ ID NO: 97723 - DNA, 273 bp, Escherichia coli; identical to SEQ ID NO: 44607
  CDS (1)..(273): transl_table=11

SEQ ID NO: 97724 - protein, 90 aa, Escherichia coli; identical to SEQ ID NO: 44608

SEQ ID NO: 97725 - DNA, 285 bp, Bacillus halodurans; identical to SEQ ID NO: 44609
  CDS (1)..(285): transl_table=11

SEQ ID NO: 97726 - protein, 94 aa, Bacillus halodurans; identical to SEQ ID NO: 44610

SEQ ID NO: 97727 - DNA, 291 bp, Lactococcus lactis; identical to SEQ ID NO: 44611
  CDS (1)..(291): transl_table=11

SEQ ID NO: 97728 - protein, 96 aa, Lactococcus lactis; identical to SEQ ID NO: 44612

SEQ ID NO: 97729 - DNA, 321 bp, Pseudomonas stutzeri; identical to SEQ ID NO: 44613
  CDS (1)..(321): transl_table=11

SEQ ID NO: 97730 - protein, 106 aa, Pseudomonas stutzeri; identical to SEQ ID NO: 44614

SEQ ID NO: 97731 - DNA, 321 bp, Escherichia coli; identical to SEQ ID NO: 44615
  CDS (1)..(321): transl_table=11

SEQ ID NO: 97732 - protein, 106 aa, Escherichia coli; identical to SEQ ID NO: 44616

SEQ ID NO: 97733 - DNA, 300 bp, Escherichia coli; identical to SEQ ID NO: 44617
  CDS (1)..(300): transl_table=11

SEQ ID NO: 97734 - protein, 99 aa, Escherichia coli; identical to SEQ ID NO: 44618

SEQ ID NO: 97735 - DNA, 318 bp, Escherichia coli; identical to SEQ ID NO: 44619
  CDS (1)..(318): transl_table=11

SEQ ID NO: 97736 - protein, 105 aa, Escherichia coli; identical to SEQ ID NO: 44620

SEQ ID NO: 97737 - DNA, 303 bp, Escherichia coli; identical to SEQ ID NO: 44621
  CDS (1)..(303): transl_table=11

SEQ ID NO: 97738 - protein, 100 aa, Escherichia coli; identical to SEQ ID NO: 44622

SEQ ID NO: 97739 - DNA, 273 bp, Escherichia coli; identical to SEQ ID NO: 44623
  CDS (1)..(273): transl_table=11

SEQ ID NO: 97740 - protein, 90 aa, Escherichia coli; identical to SEQ ID NO: 44624

SEQ ID NO: 97741 - DNA, 303 bp, Escherichia coli; identical to SEQ ID NO: 44625
  CDS (1)..(303): transl_table=11

SEQ ID NO: 97742 - protein, 100 aa, Escherichia coli; identical to SEQ ID NO: 44626

SEQ ID NO: 97743 - DNA, 1173 bp, Escherichia coli; identical to SEQ ID NO: 44627
  CDS (1)..(1173): transl_table=11

SEQ ID NO: 97744 - protein, 390 aa, Escherichia coli; identical to SEQ ID NO: 44628

SEQ ID NO: 97745 - DNA, 306 bp, Escherichia coli; identical to SEQ ID NO: 44629
  CDS (1)..(306): transl_table=11

SEQ ID NO: 97746 - protein, 101 aa, Escherichia coli; identical to SEQ ID NO: 44630

SEQ ID NO: 97747 - DNA, 318 bp, Pseudomonas aeruginosa; identical to SEQ ID NO: 44631
  CDS (1)..(318): transl_table=11

SEQ ID NO: 97748 - protein, 105 aa, Pseudomonas aeruginosa; identical to SEQ ID NO: 44632

SEQ ID NO: 97749 - DNA, 300 bp, Serratia marcescens; identical to SEQ ID NO: 44633
  CDS (1)..(300): transl_table=11

SEQ ID NO: 97750 - protein, 99 aa, Serratia marcescens; identical to SEQ ID NO: 44634

SEQ ID NO: 97751 - DNA, 381 bp, Escherichia coli; identical to SEQ ID NO: 44635
  CDS (1)..(381): transl_table=11

SEQ ID NO: 97752 - protein, 126 aa, Escherichia coli; identical to SEQ ID NO: 44636

SEQ ID NO: 97753 - DNA, 285 bp, Pantoea agglomerans; identical to SEQ ID NO: 44637
  CDS (1)..(285): transl_table=11

SEQ ID NO: 97754 - protein, 94 aa, Pantoea agglomerans; identical to SEQ ID NO: 44638

SEQ ID NO: 97755 - DNA, 285 bp, Erwinia amylovora; identical to SEQ ID NO: 44639
  CDS (1)..(285): transl_table=11

SEQ ID NO: 97756 - protein, 94 aa, Erwinia amylovora; identical to SEQ ID NO: 44640

SEQ ID NO: 97757 - DNA, 303 bp, Shigella dysenteriae; identical to SEQ ID NO: 44641
  CDS (1)..(303): transl_table=11

SEQ ID NO: 97758 - protein, 100 aa, Shigella dysenteriae; identical to SEQ ID NO: 44642

SEQ ID NO: 97759 - DNA, 333 bp, Yersinia enterocolitica; identical to SEQ ID NO: 44643
  CDS (1)..(333): transl_table=11

SEQ ID NO: 97760 - protein, 110 aa, Yersinia enterocolitica; identical to SEQ ID NO: 44644

SEQ ID NO: 97761 - DNA, 333 bp, Yersinia enterocolitica; identical to SEQ ID NO: 44645
  CDS (1)..(333): transl_table=11

SEQ ID NO: 97762 - protein, 110 aa, Yersinia enterocolitica; identical to SEQ ID NO: 44646

SEQ ID NO: 97763 - DNA, 303 bp, Escherichia coli; identical to SEQ ID NO: 44647
  CDS (1)..(303): transl_table=11

SEQ ID NO: 97764 - protein, 100 aa, Escherichia coli; identical to SEQ ID NO: 44648

SEQ ID NO: 97765 - DNA, 303 bp, Shigella sonnei; identical to SEQ ID NO: 44649
  CDS (1)..(303): transl_table=11

SEQ ID NO: 97766 - protein, 100 aa, Shigella sonnei; identical to SEQ ID NO: 44650

SEQ ID NO: 97767 - DNA, 25 bp, Primer
atgatatgctcacctcagaacaaca

SEQ ID NO: 97768 - DNA, 26 bp, Primer
ttaaaaacagaggctttttcctctgc

SEQ ID NO: 97769 - protein, 82 aa, consensus; identical to SEQ ID NO: 44653
  MISC_FEATURE (1)..(82): consensus for the disclosure of xaa see table XV

SEQ ID NO: 97770 - protein, 85 aa, consensus; identical to SEQ ID NO: 44654
  MISC_FEATURE (1)..(85): consensus for the disclosure of xaa see table XV

SEQ ID NO: 97771 - DNA, 1440 bp, Escherichia coli; identical to SEQ ID NO: 45264
  CDS (1)..(1440)

SEQ ID NO: 97772 - protein, 479 aa, Escherichia coli; identical to SEQ ID NO: 45265

SEQ ID NO: 97773 - DNA, 1230 bp, Thermococcus kodakaraensis; identical to SEQ ID NO: 45266
  CDS (1)..(1230)

SEQ ID NO: 97774 - protein, 409 aa, Thermococcus kodakaraensis; identical to SEQ ID NO: 45267

SEQ ID NO: 97775 - DNA, 1491 bp, Vibrio fischeri ES114; identical to SEQ ID NO: 45268
  CDS (1)..(1491)

SEQ ID NO: 97776 - protein, 496 aa, Vibrio fischeri ES114; identical to SEQ ID NO: 45269

SEQ ID NO: 97777 - DNA, 1011 bp, Archaeoglobus fulgidus DSM 4304; identical to SEQ ID NO: 45270
  CDS (1)..(1011): transl_table=11

SEQ ID NO: 97778 - protein, 336 aa, Archaeoglobus fulgidus DSM 4304; identical to SEQ ID NO: 45271

SEQ ID NO: 97779 - DNA, 1467 bp, Archaeoglobus fulgidus DSM 4304; identical to SEQ ID NO: 45272
  CDS (1)..(1467): transl_table=11

SEQ ID NO: 97780 - protein, 488 aa, Archaeoglobus fulgidus DSM 4304; identical to SEQ ID NO: 45273

SEQ ID NO: 97781 - DNA, 1230 bp, Pyrococcus abyssi GE5; identical to SEQ ID NO: 45274
  CDS (1)..(1230): transl_table=11

SEQ ID NO: 97782 - protein, 409 aa, Pyrococcus abyssi GE5; identical to SEQ ID NO: 45275

SEQ ID NO: 97783 - DNA, 1236 bp, Pyrococcus horikoshii OT3; identical to SEQ ID NO: 45276
  CDS (1)..(1236): transl_table=11

SEQ ID NO: 97784 - protein, 411 aa, Pyrococcus horikoshii OT3; identical to SEQ ID NO: 45277

SEQ ID NO: 97785 - DNA, 1197 bp, Thermotoga maritima MSB8; identical to SEQ ID NO: 45278
  CDS (1)..(1197): transl_table=11

SEQ ID NO: 97786 - protein, 398 aa, Thermotoga maritima MSB8; identical to SEQ ID NO: 45279

SEQ ID NO: 97787 - DNA, 1158 bp, Methanothermobacter thermautotrophicus str. Delta H; identical to SEQ ID NO: 45280
  CDS (1)..(1158): transl_table=11

SEQ ID NO: 97788 - protein, 385 aa, Methanothermobacter thermautotrophicus str. Delta H; identical to SEQ ID NO: 45281

SEQ ID NO: 97789 - DNA, 1233 bp, Methanothermobacter thermautotrophicus str. Delta H; identical to SEQ ID NO: 45282
  CDS (1)..(1233): transl_table=11

SEQ ID NO: 97790 - protein, 410 aa, Methanothermobacter thermautotrophicus str. Delta H; identical to SEQ ID NO: 45283

SEQ ID NO: 97791 - DNA, 1230 bp, Methanothermobacter thermautotrophicus str. Delta H; identical to SEQ ID NO: 45284
  CDS (1)..(1230): transl_table=11

SEQ ID NO: 97792 - protein, 409 aa, Methanothermobacter thermautotrophicus str. Delta H; identical to SEQ ID NO: 45285

SEQ ID NO: 97793 - DNA, 1179 bp, Clostridium acetobutylicum ATCC 824; identical to SEQ ID NO: 45286
  CDS (1)..(1179): transl_table=11

SEQ ID NO: 97794 - protein, 392 aa, Clostridium acetobutylicum ATCC 824; identical to SEQ ID NO: 45287

SEQ ID NO: 97795 - DNA, 1203 bp, Clostridium acetobutylicum ATCC 824; identical to SEQ ID NO: 45288
  CDS (1)..(1203): transl_table=11

SEQ ID NO: 97796 - protein, 400 aa, Clostridium acetobutylicum ATCC 824; identical to SEQ ID NO: 45289

SEQ ID NO: 97797 - DNA, 1122 bp, Clostridium perfringens str. 13; identical to SEQ ID NO: 45290
  CDS (1)..(1122): transl_table=11

SEQ ID NO: 97798 - protein, 373 aa, Clostridium perfringens str. 13; identical to SEQ ID NO: 45291

SEQ ID NO: 97799 - DNA, 1221 bp, Clostridium perfringens str. 13; identical to SEQ ID NO: 45292
  CDS (1)..(1221): transl_table=11

SEQ ID NO: 97800 - protein, 406 aa, Clostridium perfringens str. 13; identical to SEQ ID NO: 45293

SEQ ID NO: 97801 - DNA, 2637 bp, Clostridium perfringens str. 13; identical to SEQ ID NO: 45294
  CDS (1)..(2637): transl_table=11

SEQ ID NO: 97802 - protein, 878 aa, Clostridium perfringens str. 13; identical to SEQ ID NO: 45295

SEQ ID NO: 97803 - DNA, 1176 bp, Pyrococcus furiosus DSM 3638; identical to SEQ ID NO: 45296
  CDS (1)..(1176): transl_table=11

SEQ ID NO: 97804 - protein, 391 aa, Pyrococcus furiosus DSM 3638; identical to SEQ ID NO: 45297

SEQ ID NO: 97805 - DNA, 1245 bp, Pyrococcus furiosus DSM 3638; identical to SEQ ID NO: 45298
  CDS (1)..(1245): transl_table=11

SEQ ID NO: 97806 - protein, 414 aa, Pyrococcus furiosus DSM 3638; identical to SEQ ID NO: 45299

SEQ ID NO: 97807 - DNA, 1212 bp, Fusobacterium nucleatum subsp. nucleatum ATCC 25586; identical to SEQ ID NO: 45300
  CDS (1)..(1212): transl_table=11

SEQ ID NO: 97808 - protein, 403 aa, Fusobacterium nucleatum subsp. nucleatum ATCC 25586; identical to SEQ ID NO: 45301

SEQ ID NO: 97809 - DNA, 1218 bp, Fusobacterium nucleatum subsp. nucleatum ATCC 25586; identical to SEQ ID NO: 45302
  CDS (1)..(1218): transl_table=11

SEQ ID NO: 97810 - protein, 405 aa, Fusobacterium nucleatum subsp. nucleatum ATCC 25586; identical to SEQ ID NO: 45303

SEQ ID NO: 97811 - DNA, 1248 bp, Methanosarcina acetivorans C2A; identical to SEQ ID NO: 45304
  CDS (1)..(1248): transl_table=11

SEQ ID NO: 97812 - protein, 415 aa, Methanosarcina acetivorans C2A; identical to SEQ ID NO: 45305

SEQ ID NO: 97813 - DNA, 1218 bp, Methanosarcina acetivorans C2A; identical to SEQ ID NO: 45306
  CDS (1)..(1218): transl_table=11

SEQ ID NO: 97814 - protein, 405 aa, Methanosarcina acetivorans C2A; identical to SEQ ID NO: 45307

SEQ ID NO: 97815 - DNA, 1179 bp, Thermoanaerobacter tengcongensis MB4; identical to SEQ ID NO: 45308
  CDS (1)..(1179): transl_table=11

SEQ ID NO: 97816 - protein, 392 aa, Thermoanaerobacter tengcongensis MB4; identical to SEQ ID NO: 45309

SEQ ID NO: 97817 - DNA, 1197 bp, Methanosarcina mazei Go1; identical to SEQ ID NO: 45310
  CDS (1)..(1197): transl_table=11

SEQ ID NO: 97818 - protein, 398 aa, Methanosarcina mazei Go1; identical to SEQ ID NO: 45311

SEQ ID NO: 97819 - DNA, 1227 bp, Chlorobium tepidum TLS; identical to SEQ ID NO: 45312
  CDS (1)..(1227): transl_table=11

SEQ ID NO: 97820 - protein, 408 aa, Chlorobium tepidum TLS; identical to SEQ ID NO: 45313

SEQ ID NO: 97821 - DNA, 1200 bp, Clostridium tetani E88; identical to SEQ ID NO: 45314
  CDS (1)..(1200): transl_table=11

SEQ ID NO: 97822 - protein, 399 aa, Clostridium tetani E88; identical to SEQ ID NO: 45315

SEQ ID NO: 97823 - DNA, 1188 bp, Clostridium tetani E88; identical to SEQ ID NO: 45316
  CDS (1)..(1188): transl_table=11

SEQ ID NO: 97824 - protein, 395 aa, Clostridium tetani E88; identical to SEQ ID NO: 45317

SEQ ID NO: 97825 - DNA, 1248 bp, Clostridium tetani E88; identical to SEQ ID NO: 45318
  CDS (1)..(1248): transl_table=11

SEQ ID NO: 97826 - protein, 415 aa, Clostridium tetani E88; identical to SEQ ID NO: 45319

SEQ ID NO: 97827 - DNA, 1197 bp, Bacteroides thetaiotaomicron VPI-5482; identical to SEQ ID NO: 45320
  CDS (1)..(1197): transl_table=11

SEQ ID NO: 97828 - protein, 398 aa, Bacteroides thetaiotaomicron VPI-5482; identical to SEQ ID NO: 45321

SEQ ID NO: 97829 - DNA, 1845 bp, Prochlorococcus marinus subsp. marinus str. CCMP1375; identical to SEQ ID NO: 45322
  CDS (1)..(1845): transl_table=11

SEQ ID NO: 97830 - protein, 614 aa, Prochlorococcus marinus subsp. marinus str. CCMP1375; identical to SEQ ID NO: 45323

SEQ ID NO: 97831 - DNA, 1773 bp, Prochlorococcus marinus subsp. marinus str. CCMP1375; identical to SEQ ID NO: 45324
  CDS (1)..(1773): transl_table=11

SEQ ID NO: 97832 - protein, 590 aa, Prochlorococcus marinus subsp. marinus str. CCMP1375; identical to SEQ ID NO: 45325

SEQ ID NO: 97833 - DNA, 1776 bp, Prochlorococcus marinus subsp. pastoris str. CCMP1986; identical to SEQ ID NO: 45326
  CDS (1)..(1776): transl_table=11

SEQ ID NO: 97834 - protein, 591 aa, Prochlorococcus marinus subsp. pastoris str. CCMP1986; identical to SEQ ID NO: 45327

SEQ ID NO: 97835 - DNA, 1776 bp, Prochlorococcus marinus str. MIT 9313; identical to SEQ ID NO: 45328
  CDS (1)..(1776): transl_table=11

SEQ ID NO: 97836 - protein, 591 aa, Prochlorococcus marinus str. MIT 9313; identical to SEQ ID NO: 45329

SEQ ID NO: 97837 - DNA, 1848 bp, Prochlorococcus marinus str. MIT 9313; identical to SEQ ID NO: 45330
  CDS (1)..(1848): transl_table=11

SEQ ID NO: 97838 - protein, 615 aa, Prochlorococcus marinus str. MIT 9313; identical to SEQ ID NO: 45331

SEQ ID NO: 97839 - DNA, 1749 bp, Synechococcus sp. WH 8102; identical to SEQ ID NO: 45332
  CDS (1)..(1749): transl_table=11

SEQ ID NO: 97840 - protein, 582 aa, Synechococcus sp. WH 8102; identical to SEQ ID NO: 45333

SEQ ID NO: 97841 - DNA, 1803 bp, Synechococcus sp. WH 8102; identical to SEQ ID NO: 45334
  CDS (1)..(1803): transl_table=11

SEQ ID NO: 97842 - protein, 600 aa, Synechococcus sp. WH 8102; identical to SEQ ID NO: 45335

SEQ ID NO: 97843 - DNA, 1209 bp, Porphyromonas gingivalis W83; identical to SEQ ID NO: 45336
  CDS (1)..(1209): transl_table=11

SEQ ID NO: 97844 - protein, 402 aa, Porphyromonas gingivalis W83; identical to SEQ ID NO: 45337

SEQ ID NO: 97845 - DNA, 1212 bp, Wolinella succinogenes DSM 1740; identical to SEQ ID NO: 45338
  CDS (1)..(1212): transl_table=11

SEQ ID NO: 97846 - protein, 403 aa, Wolinella succinogenes DSM 1740; identical to SEQ ID NO: 45339

SEQ ID NO: 97847 - DNA, 1755 bp, Gloeobacter violaceus PCC 7421; identical to SEQ ID NO: 45340
  CDS (1)..(1755): transl_table=11

SEQ ID NO: 97848 - protein, 584 aa, Gloeobacter violaceus PCC 7421; identical to SEQ ID NO: 45341

SEQ ID NO: 97849 - DNA, 1740 bp, Gloeobacter violaceus PCC 7421; identical to SEQ ID NO: 45342
  CDS (1)..(1740): transl_table=11

SEQ ID NO: 97850 - protein, 579 aa, Gloeobacter violaceus PCC 7421; identical to SEQ ID NO: 45343

SEQ ID NO: 97851 - DNA, 1215 bp, Geobacter sulfurreducens PCA; identical to SEQ ID NO: 45344
  CDS (1)..(1215): transl_table=11

SEQ ID NO: 97852 - protein, 404 aa, Geobacter sulfurreducens PCA; identical to SEQ ID NO: 45345

SEQ ID NO: 97853 - DNA, 1227 bp, Treponema denticola ATCC 35405; identical to SEQ ID NO: 45346
  CDS (1)..(1227): transl_table=11

SEQ ID NO: 97854 - protein, 408 aa, Treponema denticola ATCC 35405; identical to SEQ ID NO: 45347

SEQ ID NO: 97855 - DNA, 1224 bp, Methanococcus maripaludis S2; identical to SEQ ID NO: 45348
  CDS (1)..(1224): transl_table=11

SEQ ID NO: 97856 - protein, 407 aa, Methanococcus maripaludis S2; identical to SEQ ID NO: 45349

SEQ ID NO: 97857 - DNA, 1221 bp, Methanococcus maripaludis S2; identical to SEQ ID NO: 45350
  CDS (1)..(1221): transl_table=11

SEQ ID NO: 97858 - protein, 406 aa, Methanococcus maripaludis S2; identical to SEQ ID NO: 45351

SEQ ID NO: 97859 - DNA, 1164 bp, Methanococcus maripaludis S2; identical to SEQ ID NO: 45352
  CDS (1)..(1164): transl_table=11

SEQ ID NO: 97860 - protein, 387 aa, Methanococcus maripaludis S2; identical to SEQ ID NO: 45353

SEQ ID NO: 97861 - DNA, 1155 bp, Anopheles gambiae str. PEST; identical to SEQ ID NO: 45354
  CDS (1)..(1155)

SEQ ID NO: 97862 - protein, 384 aa, Anopheles gambiae str. PEST; identical to SEQ ID NO: 45355

SEQ ID NO: 97863 - DNA, 1176 bp, Desulfovibrio vulgaris subsp. vulgaris str. Hildenborough; identical to SEQ ID NO: 45356
  CDS (1)..(1176): transl_table=11

SEQ ID NO: 97864 - protein, 391 aa, Desulfovibrio vulgaris subsp. vulgaris str. Hildenborough; identical to SEQ ID NO: 45357

SEQ ID NO: 97865 - DNA, 1209 bp, Desulfovibrio vulgaris subsp. vulgaris str. Hildenborough; identical to SEQ ID NO: 45358
  CDS (1)..(1209): transl_table=11

SEQ ID NO: 97866 - protein, 402 aa, Desulfovibrio vulgaris subsp. vulgaris str. Hildenborough; identical to SEQ ID NO: 45359

SEQ ID NO: 97867 - DNA, 1530 bp, Erwinia carotovora subsp. atroseptica SCRI1043; identical to SEQ ID NO: 45360
  CDS (1)..(1530)

SEQ ID NO: 97868 - protein, 509 aa, Erwinia carotovora subsp. atroseptica SCRI1043; identical to SEQ ID NO: 45361

SEQ ID NO: 97869 - DNA, 1203 bp, Desulfotalea psychrophila LSv54; identical to SEQ ID NO: 45362
  CDS (1)..(1203): transl_table=11

SEQ ID NO: 97870 - protein, 400 aa, Desulfotalea psychrophila LSv54; identical to SEQ ID NO: 45363

SEQ ID NO: 97871 - DNA, 1275 bp, Desulfotalea psychrophila LSv54; identical to SEQ ID NO: 45364
  CDS (1)..(1275): transl_table=11

SEQ ID NO: 97872 - protein, 424 aa, Desulfotalea psychrophila LSv54; identical to SEQ ID NO: 45365

SEQ ID NO: 97873 - DNA, 1200 bp, Bacteroides fragilis YCH46; identical to SEQ ID NO: 45366
  CDS (1)..(1200): transl_table=11

SEQ ID NO: 97874 - protein, 399 aa, Bacteroides fragilis YCH46; identical to SEQ ID NO: 45367

SEQ ID NO: 97875 - DNA, 1545 bp, Photobacterium profundum SS9; identical to SEQ ID NO: 45368
  CDS (1)..(1545): transl_table=11

SEQ ID NO: 97876 - protein, 514 aa, Photobacterium profundum SS9; identical to SEQ ID NO: 45369

SEQ ID NO: 97877 - DNA, 2664 bp, Azoarcus sp. EbN1; identical to SEQ ID NO: 45370
  CDS (1)..(2664): transl_table=11

SEQ ID NO: 97878 - protein, 887 aa, Azoarcus sp. EbN1; identical to SEQ ID NO: 45371

SEQ ID NO: 97879 - DNA, 1266 bp, Rhodobacter sphaeroides 2.4.1; identical to SEQ ID NO: 45372
  CDS (1)..(1266)

SEQ ID NO: 97880 - protein, 421 aa, Rhodobacter sphaeroides 2.4.1; identical to SEQ ID NO: 45373

SEQ ID NO: 97881 - DNA, 1725 bp, Nostoc punctiforme PCC 73102; identical to SEQ ID NO: 45374
  CDS (1)..(1725)

SEQ ID NO: 97882 - protein, 574 aa, Nostoc punctiforme PCC 73102; identical to SEQ ID NO: 45375

SEQ ID NO: 97883 - DNA, 1737 bp, Nostoc punctiforme PCC 73102; identical to SEQ ID NO: 45376
  CDS (1)..(1737)

SEQ ID NO: 97884 - protein, 578 aa, Nostoc punctiforme PCC 73102; identical to SEQ ID NO: 45377

SEQ ID NO: 97885 - DNA, 1488 bp, Nostoc punctiforme PCC 73102; identical to SEQ ID NO: 45378
  CDS (1)..(1488)

SEQ ID NO: 97886 - protein, 495 aa, Nostoc punctiforme PCC 73102; identical to SEQ ID NO: 45379

SEQ ID NO: 97887 - DNA, 1374 bp, Nostoc punctiforme PCC 73102; identical to SEQ ID NO: 45380
  CDS (1)..(1374): n means a or g or c or t/u

SEQ ID NO: 97888 - protein, 457 aa, Nostoc punctiforme PCC 73102; identical to SEQ ID NO: 45381
  misc_feature (11)..(11): Xaa can be Ile or Met
  misc_feature (13)..(13): Xaa can be Ala or Glu or Gly or Val

SEQ ID NO: 97889 - DNA, 1713 bp, Nostoc punctiforme PCC 73102; identical to SEQ ID NO: 45382
  CDS (1)..(1713)

SEQ ID NO: 97890 - protein, 570 aa, Nostoc punctiforme PCC 73102; identical to SEQ ID NO: 45383

SEQ ID NO: 97891 - DNA, 1719 bp, Nostoc punctiforme PCC 73102; identical to SEQ ID NO: 45384
  CDS (1)..(1719)

SEQ ID NO: 97892 - protein, 572 aa, Nostoc punctiforme PCC 73102; identical to SEQ ID NO: 45385

SEQ ID NO: 97893 - DNA, 1257 bp, Desulfovibrio desulfuricans G20; identical to SEQ ID NO: 45386
  CDS (1)..(1257)

SEQ ID NO: 97894 - protein, 418 aa, Desulfovibrio desulfuricans G20; identical to SEQ ID NO: 45387

SEQ ID NO: 97895 - DNA, 1218 bp, Fusobacterium nucleatum subsp. vincentii ATCC 49256; identical to SEQ ID NO: 45388
  CDS (1)..(1218): transl_table=11

SEQ ID NO: 97896 - protein, 405 aa, Fusobacterium nucleatum subsp. vincentii ATCC 49256; identical to SEQ ID NO: 45389

SEQ ID NO: 97897 - DNA, 1215 bp, Methanococcoides burtonii DSM 6242; identical to SEQ ID NO: 45390
  CDS (1)..(1215)

SEQ ID NO: 97898 - protein, 404 aa, Methanococcoides burtonii DSM 6242; identical to SEQ ID NO: 45391

SEQ ID NO: 97899 - DNA, 1272 bp, Dechloromonas aromatica RCB; identical to SEQ ID NO: 45392
  CDS (1)..(1272)

SEQ ID NO: 97900 - protein, 423 aa, Dechloromonas aromatica RCB; identical to SEQ ID NO: 45393

SEQ ID NO: 97901 - DNA, 1713 bp, Anabaena variabilis ATCC 29413; identical to SEQ ID NO: 45394
  CDS (1)..(1713)

SEQ ID NO: 97902 - protein, 570 aa, Anabaena variabilis ATCC 29413; identical to SEQ ID NO: 45395

SEQ ID NO: 97903 - DNA, 1725 bp, Anabaena variabilis ATCC 29413; identical to SEQ ID NO: 45396
  CDS (1)..(1725)

SEQ ID NO: 97904 - protein, 574 aa, Anabaena variabilis ATCC 29413; identical to SEQ ID NO: 45397

SEQ ID NO: 97905 - DNA, 1794 bp, Anabaena variabilis ATCC 29413; identical to SEQ ID NO: 45398
  CDS (1)..(1794)

SEQ ID NO: 97906 - protein, 597 aa, Anabaena variabilis ATCC 29413; identical to SEQ ID NO: 45399

SEQ ID NO: 97907 - DNA, 1740 bp, Anabaena variabilis ATCC 29413; identical to SEQ ID NO: 45400
  CDS (1)..(1740)

SEQ ID NO: 97908 - protein, 579 aa, Anabaena variabilis ATCC 29413; identical to SEQ ID NO: 45401

SEQ ID NO: 97909 - DNA, 1731 bp, Anabaena variabilis ATCC 29413; identical to SEQ ID NO: 45402
  CDS (1)..(1731)

SEQ ID NO: 97910 - protein, 576 aa, Anabaena variabilis ATCC 29413; identical to SEQ ID NO: 45403

SEQ ID NO: 97911 - DNA, 1716 bp, Synechococcus elongatus PCC 7942; identical to SEQ ID NO: 45404
  CDS (1)..(1716)

SEQ ID NO: 97912 - protein, 571 aa, Synechococcus elongatus PCC 7942; identical to SEQ ID NO: 45405

SEQ ID NO: 97913 - DNA, 1755 bp, Synechococcus elongatus PCC 7942; identical to SEQ ID NO: 45406
  CDS (1)..(1755)

SEQ ID NO: 97914 - protein, 584 aa, Synechococcus elongatus PCC 7942; identical to SEQ ID NO: 45407

SEQ ID NO: 97915 - DNA, 1728 bp, Crocosphaera watsonii WH 8501; identical to SEQ ID NO: 45408
  CDS (1)..(1728)

SEQ ID NO: 97916 - protein, 575 aa, Crocosphaera watsonii WH 8501; identical to SEQ ID NO: 45409

SEQ ID NO: 97917 - DNA, 1725 bp, Crocosphaera watsonii WH 8501; identical to SEQ ID NO: 45410
  CDS (1)..(1725)

SEQ ID NO: 97918 - protein, 574 aa, Crocosphaera watsonii WH 8501; identical to SEQ ID NO: 45411

SEQ ID NO: 97919 - DNA, 1182 bp, Methanosarcina barkeri str. fusaro; identical to SEQ ID NO: 45412
  CDS (1)..(1182)

SEQ ID NO: 97920 - protein, 393 aa, Methanosarcina barkeri str. fusaro; identical to SEQ ID NO: 45413

SEQ ID NO: 97921 - DNA, 1137 bp, Clostridium thermocellum ATCC 27405; identical to SEQ ID NO: 45414
  CDS (1)..(1137)

SEQ ID NO: 97922 - protein, 378 aa, Clostridium thermocellum ATCC 27405; identical to SEQ ID NO: 45415

SEQ ID NO: 97923 - DNA, 1254 bp, Clostridium thermocellum ATCC 27405; identical to SEQ ID NO: 45416
  CDS (1)..(1254)

SEQ ID NO: 97924 - protein, 417 aa, Clostridium thermocellum ATCC 27405; identical to SEQ ID NO: 45417

SEQ ID NO: 97925 - DNA, 1725 bp, Trichodesmium erythraeum IMS101; identical to SEQ ID NO: 45418
  CDS (1)..(1725)

SEQ ID NO: 97926 - protein, 574 aa, Trichodesmium erythraeum IMS101; identical to SEQ ID NO: 45419

SEQ ID NO: 97927 - DNA, 1728 bp, Trichodesmium erythraeum IMS101; identical to SEQ ID NO: 45420
  CDS (1)..(1728)

SEQ ID NO: 97928 - protein, 575 aa, Trichodesmium erythraeum IMS101; identical to SEQ ID NO: 45421

SEQ ID NO: 97929 - DNA, 1254 bp, Trichomonas vaginalis; identical to SEQ ID NO: 45422
  CDS (1)..(1254)

SEQ ID NO: 97930 - protein, 417 aa, Trichomonas vaginalis; identical to SEQ ID NO: 45423

SEQ ID NO: 97931 - DNA, 1394 bp, Giardia lamblia ATCC 50803; identical to SEQ ID NO: 45424
  CDS (81)..(1325)

SEQ ID NO: 97932 - protein, 414 aa, Giardia lamblia ATCC 50803; identical to SEQ ID NO: 45425

SEQ ID NO: 97933 - DNA, 1716 bp, Synechococcus elongatus; identical to SEQ ID NO: 45426
  CDS (1)..(1716)

SEQ ID NO: 97934 - protein, 571 aa, Synechococcus elongatus; identical to SEQ ID NO: 45427

SEQ ID NO: 97935 - DNA, 1722 bp, Synechocystis sp; identical to SEQ ID NO: 45428
  CDS (1)..(1722)

SEQ ID NO: 97936 - protein, 573 aa, Synechocystis sp; identical to SEQ ID NO: 45429

SEQ ID NO: 97937 - DNA, 1737 bp, Synechococcus elongatus; identical to SEQ ID NO: 45430
  CDS (1)..(1737)

SEQ ID NO: 97938 - protein, 578 aa, Synechococcus elongatus; identical to SEQ ID NO: 45431

SEQ ID NO: 97939 - DNA, 1737 bp, Synechocystis sp; identical to SEQ ID NO: 45432
  CDS (1)..(1737)

SEQ ID NO: 97940 - protein, 578 aa, Synechocystis sp; identical to SEQ ID NO: 45433

SEQ ID NO: 97941 - DNA, 1794 bp, Synechocystis sp; identical to SEQ ID NO: 45434
  CDS (1)..(1794)

SEQ ID NO: 97942 - protein, 597 aa, Synechocystis sp; identical to SEQ ID NO: 45435

SEQ ID NO: 97943 - DNA, 1785 bp, Synechocystis sp; identical to SEQ ID NO: 45436
  CDS (1)..(1785)

SEQ ID NO: 97944 - protein, 594 aa, Synechocystis sp; identical to SEQ ID NO: 45437

SEQ ID NO: 97945 - DNA, 1251 bp, Methanococcus jannaschii; identical to SEQ ID NO: 45438
  CDS (1)..(1251): transl_table=11

SEQ ID NO: 97946 - protein, 416 aa, Methanococcus jannaschii; identical to SEQ ID NO: 45439

SEQ ID NO: 97947 - DNA, 1215 bp, Methanobacterium thermoautotrophicum; identical to SEQ ID NO: 45440
  CDS (1)..(1215): transl_table=11

SEQ ID NO: 97948 - protein, 404 aa, Methanobacterium thermoautotrophicum; identical to SEQ ID NO: 45441

SEQ ID NO: 97949 - DNA, 1200 bp, Moorella thermoacetica; identical to SEQ ID NO: 45442
  CDS (1)..(1200): transl_table=11

SEQ ID NO: 97950 - protein, 399 aa, Moorella thermoacetica; identical to SEQ ID NO: 45443

SEQ ID NO: 97951 - DNA, 1308 bp, Rhodobacter capsulatus; identical to SEQ ID NO: 45444
  CDS (1)..(1308): transl_table=11

SEQ ID NO: 97952 - protein, 435 aa, Rhodobacter capsulatus; identical to SEQ ID NO: 45445

SEQ ID NO: 97953 - DNA, 1440 bp, Salmonella typhi; identical to SEQ ID NO: 45446
  CDS (1)..(1440): transl_table=11

SEQ ID NO: 97954 - protein, 479 aa, Salmonella typhi; identical to SEQ ID NO: 45447

SEQ ID NO: 97955 - DNA, 1209 bp, Desulfovibrio gigas; identical to SEQ ID NO: 45448
  CDS (1)..(1209): transl_table=11

SEQ ID NO: 97956 - protein, 402 aa, Desulfovibrio gigas; identical to SEQ ID NO: 45449

SEQ ID NO: 97957 - DNA, 1176 bp, Methanococcus jannaschii; identical to SEQ ID NO: 45450
  CDS (1)..(1176): transl_table=11

SEQ ID NO: 97958 - protein, 391 aa, Methanococcus jannaschii; identical to SEQ ID NO: 45451

SEQ ID NO: 97959 - DNA, 1182 bp, Methanococcus jannaschii; identical to SEQ ID NO: 45452
  CDS (1)..(1182): transl_table=11

SEQ ID NO: 97960 - protein, 393 aa, Methanococcus jannaschii; identical to SEQ ID NO: 45453

SEQ ID NO: 97961 - DNA, 27 bp, Primer
atgtctattgtggtgaaaaataacatt

SEQ ID NO: 97962 - DNA, 25 bp, Primer
ttattttgcctccgatgccagttct

SEQ ID NO: 97963 - protein, 428 aa, consensus; identical to SEQ ID NO: 45456
  MISC_FEATURE (1)..(428): consensus for the disclosure of xaa see table XV

SEQ ID NO: 97964 - protein, 9 aa, consensus
  MISC_FEATURE (1)..(9): consensus for the disclosure of xaa see table XV
GXXXNXXXX

SEQ ID NO: 97965 - protein, 16 aa, consensus
  MISC_FEATURE (1)..(16): consensus for the disclosure of xaa see table XV
XXXXXXXXXXXXXXXX

SEQ ID NO: 97966 - DNA, 2043 bp, Escherichia coli
  CDS (1)..(2043)
atgacgaatccgttactgactccctttgaattgcctccgttttctaaaattctcccggaacatgtcgttccagccgtgactaaggcattgaacgactgccgcgaaaacgtggagcgcgtagtagcgcaaggggcaccgtacacctgggaaaatctctgccagccgctggcggaagtggacgatgtgttggggcgtatcttctccccggtcagccacctgaactcggtgaaaaatagcccggaactgcgtgaagcctacgaacaaaccctgccgctgctgtcggaatacagcacctgggtagggcaacatgaagggctgtataaagcgtatcgcgacctgcgcgatggcgatcattacgccacgctgaacacggcgcagaagaaagcggttgataacgcactgcgcgactttgaactctctggcataggtctgccgaaagagaaacagcagcgttacggcgaaattgcgacccgtctttctgaactgggcaaccagtacagcaacaacgtcctcgatgcgacaatgggctggaccaaactcgttaccgacgaagcggagctggcggggatgccagaaagcgcgctggctgcggcaaaagcccaggccgaagcgaaagagctggaaggttatttgctgacgctggatatcccaagctacttgccggtaatgacctactgcgacaaccaggctctgcgtgaagagatgtatcgcgcttacagcacccgcgcctccgatcaaggcccaaacgccggtaaatgggataacagcaaggtgatggaagagatcctcgcgctgcgtcacgaactggcgcaactgctgggctttgaaaactacgcctttaaatcccttgccactaaaatggcagaaaacccgcagcaggtgctggatttcttaaccgatctggcaaaacgcgcgcgtccacaaggcgaaaaagagctggcgcaattgcgtgcctttgccaaagccgaatttggcgtcgatgagttgcagccgtgggatatcgcttactacagcgaaaaacaaaaacagcacctctacagcatcagtgacgaacagctgcgtccgtacttcccggaaaacaaagcggttaacggcctgtttgaagtggttaagcgtatttacggcatcaccgctaaagagcgtaaagatgttgatgtctggcatccggatgtacgtttcttcgaactgtatgacgaaaataacgaactgcgcggtagcttctacctcgatctgtatgcccgtgaaaacaagcgcggcggggcgtggatggatgactgcgtaggccagatgcgtaaagctgatggttctttgcaaaaaccggtcgcgtatttgacttgtaacttcaaccgcccggtaaatggtaaaccggcgctgttcactcacgacgaagtgatcaccctcttccacgagttcggtcacggcctgcaccatatgctgacccgcatcgaaaccgctggtgtttccggtatcagcggtgtgccgtgggatgcggtcgaactgccgagtcagtttatggaaaactggtgctgggagccggaggcgctggcgtttatctctggtcactatgaaaccggcgaaccgctgccgaaagagttgctggataaaatgctggcggcgaagaactaccaggcggcgctgtttattctgcgtcagctggagttcggcctgtttgatttccgccttcatgccgagttccgcccggatcagggggcaaaaatcctcgaaactctggcagaaatcaagaaactggttgccgtggtgccatctccgtcctggggccgtttcccgcacgctttcagccatattttcgccggtggttatgccgcaggttactacagctacctgtgggctgacgtactggcggcagatgctttctcgcgctttgaggaagagggcattttcaaccgtgaaaccgggcagtcgttcctcgacaacattctgagccgtggcggttcagaagagccgatggatctgttcaaacgcttccgtggtcgtgaaccgcagctggatgcgatgctggagcattacggcattaagggctga

SEQ ID NO: 97967 - protein, 680 aa, Escherichia coli
MTNPLLTPFELPPFSKILPEHVVPAVTKALNDCRENVERVVAQGAPYTWENLCQPLAEVDDVLGRIFSPVSHLNSVKNSPELREAYEQTLPLLSEYSTWVGQHEGLYKAYRDLRDGDHYATLNTAQKKAVDNALRDFELSGIGLPKEKQQRYGEIATRLSELGNQYSNNVLDATMGWTKLVTDEAELAGMPESALAAAKAQAEAKELEGYLLTLDIPSYLPVMTYCDNQALREEMYRAYSTRASDQGPNAGKWDNSKVMEEILALRHELAQLLGFENYAFKSLATKMAENPQQVLDFLTDLAKRARPQGEKELAQLRAFAKAEFGVDELQPWDIAYYSEKQKQHLYSISDEQLRPYFPENKAVNGLFEVVKRIYGITAKERKDVDVWHPDVRFFELYDENNELRGSFYLDLYARENKRGGAWMDDCVGQMRKADGSLQKPVAYLTCNFNRPVNGKPALFTHDEVITLFHEFGHGLHHMLTRIETAGVSGISGVPWDAVELPSQFMENWCWEPEALAFISGHYETGEPLPKELLDKMLAAKNYQAALFILRQLEFGLFDFRLHAEFRPDQGAKILETLAEIKKLVAVVPSPSWGRFPHAFSHIFAGGYAAGYYSYLWADVLAADAFSRFEEEGIFNRETGQSFLDNILSRGGSEEPMDLFKRFRGREPQLDAMLEHYGIKG

SEQ ID NO: 97968 - DNA, 2061 bp, Danio rerio
  CDS (1)..(2061)
atggcacctacaggtgaagttgtgtttggctctggggatcgagtttgtgacgacaaccgtttgcgctgggacctcaccccagagcagatcaaccaacttaccgaagagcttattgctaagactaaaaaggtgtatgacaccgttggtgctctggacttggacagtgtcaactatgagaacaccctaaaggccctcgctgatgtggaagtggagtacacagtccagcggaacatgttggattttcctcaacacgtgtcctccagtaaggacgtccgttcagcaagcaccgaggctgataagaagctgtcagagtttgatgtggagatgagcatgagagaagatgtttatcagcgaatcgtggctctagaggagaagctgccagaaggcagtttgtcgcctgaggccaagcgttacatggaaagacttataaagcttggcaagagaaacggcctccatcttcccaaagtgacacaggaggagatcaaaaagatcaagaagaaactgagcaccctgtgtatcgatttcaacaaacacctgaatgaagatacaacttgcctgcatttctctcgagaggagcttggggggctccctgaggatttccttaactctctggagaaggatgagtctggaaaactgaagctcactctgaagtatcctcattatttccccaccatgaaaaaatgctttgtccccgagacacggaagaaattagaggaggccttcaactcgcgctgcaaagaggagaactctgctatcctgaaggagcttgtgaatttgcgcgctcagaagagcagcctgctgggcttcagcacgcattctgactttgttcttgagatgaacatggccaagtcatccaagaaagtttccacttttctcgaggacctttcgcataagctaaagcccctgggtgagaaggaaagggccgtaatcctgaagctaaaggaacaggagtgccagaagaggaatctgcccttcactggagaactttacgcatgggacacgcgctactacatgacccaggtggaggagacccagtatgcagtggatcagaaccagctgaaggagtattttccaatggaggtggttaccaagggcctgctggacatctatcaggagctgctaaacctcacctttgagcaagtagagggcgctccagtctggcatgacgatgtgtcgctgtactgcgttaaagaccgttcatctggcctggtggtgggccagttttatctggatctattccccagggagggcaagtacggccatgccgcatgctttggcttgcagcctggctgcttgctcccaaatgggacccggcagatggccgtggctgccatggtggctaatttcagcaagcccaccgcagatgcaccatccctgctgcagcatgatgaagtggaaacgtacttccatgagtttggacatgtgatgcatcagctttgcgctcagtctgattttgcaatgttcagcgggactcacgtagaaagggattttgttgaagctccatctcagatgttggagaactgggtctgggagaaggagcccattcagcgcatgtccaagcactacaaaacaggaaacccaattccagaggagcttctggataagctcattaagtccagactcgctaacaccgggttgtttaacttgaggcagattgttctggctaaggtggaccaggcgttgcacacaaagactggacttgacccagctgaagaatatgccagactctgcttggacatcctgggaattccttcttcaccagggacaaacatgcctgccacatttggtcacctagctggagggtatgatgctcagtactatggctacttgtggagtgaggtgttctccatggacatgttctacgcccgcttcaaacaagaaggcgtaatggaccctaaggtgggtctggactacaggaattgcattctgaagccaggaggctctgaggatgctgctgacatgctgaagaagttcctgggaagagaacccaagcaggatgctttcctcctaagcaaagggctcacggctgatgtggagtctggcaccccctgcgcctgctga

SEQ ID NO: 97969 - protein, 686 aa, Danio rerio
MAPTGEVVFGSGDRVCDDNRLRWDLTPEQINQLTEELIAKTKKVYDTVGALDLDSVNYENTLKALADVEVEYTVQRNMLDFPQHVSSSKDVRSASTEADKKLSEFDVEMSMREDVYQRIVALEEKLPEGSLSPEAKRYMERLIKLGKRNGLHLPKVTQEEIKKIKKKLSTLCIDFNKHLNEDTTCLHFSREELGGLPEDFLNSLEKDESGKLKLTLKYPHYFPTMKKCFVPETRKKLEEAFNSRCKEENSAILKELVNLRAQKSSLLGFSTHSDFVLEMNMAKSSKKVSTFLEDLSHKLKPLGEKERAVILKLKEQECQKRNLPFTGELYAWDTRYYMTQVEETQYAVDQNQLKEYFPMEVVTKGLLDIYQELLNLTFEQVEGAPVWHDDVSLYCVKDRSSGLVVGQFYLDLFPREGKYGHAACFGLQPGCLLPNGTRQMAVAAMVANFSKPTADAPSLLQHDEVETYFHEFGHVMHQLCAQSDFAMFSGTHVERDFVEAPSQMLENWVWEKEPIQRMSKHYKTGNPIPEELLDKLIKSRLANTGLFNLRQIVLAKVDQALHTKTGLDPAEEYARLCLDILGIPSSPGTNMPATFGHLAGGYDAQYYGYLWSEVFSMDMFYARFKQEGVMDPKVGLDYRNCILKPGGSEDAADMLKKFLGREPKQDAFLLSKGLTADVESGTPCAC

SEQ ID NO: 97970 - DNA, 2313 bp, Saccharomyces cerevisiae
  CDS (1)..(2313)
atgcttcgcacgataatattgaaagccgggtccaatgcctccataccgtcaccttcccgccaaaataagttactcaggttcttcgccacagccggcgcagtctctaggaccagtccaggaagcattaagaagattttcgacgacaattcatattggagaaatattaatggtcaggatgctaataatagcaagatctcacaatatctttttaaaaaaaataaaaccggacttttcaagaacccttatttgacttctccagatggtttgcgtaagtttagccaggtttctttgcagcaagcacaagaacttctcgacaaaatgaggaatgattttagcgagagtggtaaattaacctatattatgaacctggacagattaagcgatacgctatgtcgagttattgatttgtgcgagtttattaggtcaacacatccagatgatgcatttgttagggcagcacaagattgccatgaacaaatgtttgaattcatgaatgtcttgaacactgatgtttccttatgtaacatactaaagtcggttttaaacaatccagaagtgtcttcgaagttaagcgcagaagaacttaaagttggtaaaatattattggatgattttgaaaagtcaggaatctatatgaatccagatgttagagaaaagtttatccagttatctcaggaaatcagtttagtaggtcaagaattcatcaaccatacagactatcctggttcaaattctgtgaagataccatgtaaagatctggataatagtaaagtgagtacatttctattgaagcaattaaataaagatgtaaaagggcaaaattataaagtacctacatttgggtatgcagcttatgcattattaaaaagttgtgaaaatgagatggtaagaaaaaagttgtggaccgctcttcacagttgttctgacaaacaggttaaaagattgagtcacttaatcaaactaagggcaatcttggctaatttaatgcacaaaacaagttacgcagagtatcaattggaaggtaaatggcaagatcgaagatgtcaagattttattttgacgttaatgaacaatactatagagaagacagcaaatgaattgaaatttatagctgaactcaaggccaaagatcttaagaagccgttgactacaaacacggacgaaatattgaagctcgtgagaccatgggatagggattactatactggcaaatatttccagctcaacccgtcaaactctcccaatgccaaagaaataagctattattttacattaggaaatgtcattcagggcttgtcagatttgtttcagcaaatatatggtattagattagagccagcaattactgatgagggagaaacatggtccccagacgtgagaagattgaatgtgatatctgaagaggaaggaatcatcggcataatttattgtgatttattcgaacgaaatggcaagacttcaaatccggctcatttcacagtttgttgctctaggcaaatatatcccagtgaaactgatttctcaaccatccaagtcggtgagaatccagacggtacctactttcaattacctgttatttctttggtgtgtaatttttctccaatactaatcgcttctaaaaaaagtctttgttttttgcagcttagtgaagttgaaacgctcttccatgaaatgggacatgcaatgcactcaatgttagggagaactcatatgcaaaacataagtggtacaagatgtgctactgattttgtagagttaccaagtatcctgatggagcacttcgctaaggatatacgaattctgacaaagattggcaaacattacgggactggagaaacaattcaggctgatatgttacagcgcttcatgaaaagcactaacttccttcaaaattgtgaaacatactctcaagcaaagatggctatgctggatcaatcatttcatgatgaaaaaatcatttctgatattgataactttgacgttgtggaaaactatcaagcactagaacgacgtttaaaggtcctagtggacgatcagagtaattggtgtggaagattcggccatttatttggatcggggcaacttattacagctacttattttgataggacgatagcttctaaaatctggtacgcccttttcgaggatgatccgtacagtcgaaaaaatggtgataaatttaaaaagcatttactaaaatggggagggctaaaagacccttggaaatgtatcgctgatgttttagaatgccccatgctagagaaaggcggtagcgatgcgatggaatttatagcacagtctcacaagtcttag

SEQ ID NO: 97971 - protein, 770 aa, Saccharomyces cerevisiae
MLRTIILKAGSNASIPSPSRQNKLLRFFATAGAVSRTSPGSIKKIFDDNSYWRNINGQDANNSKISQYLFKKNKTGLFKNPYLTSPDGLRKFSQVSLQQAQELLDKMRNDFSESGKLTYIMNLDRLSDTLCRVIDLCEFIRSTHPDDAFVRAAQDCHEQMFEFMNVLNTDVSLCNILKSVLNNPEVSSKLSAEELKVGKILLDDFEKSGIYMNPDVREKFIQLSQEISLVGQEFINHTDYPGSNSVKIPCKDLDNSKVSTFLLKQLNKDVKGQNYKVPTFGYAAYALLKSCENEMVRKKLWTALHSCSDKQVKRLSHLIKLRAILANLMHKTSYAEYQLEGKWQDRRCQDFILTLMNNTIEKTANELKFIAELKAKDLKKPLTTNTDEILKLVRPWDRDYYTGKYFQLNPSNSPNAKEISYYFTLGNVIQGLSDLFQQIYGIRLEPAITDEGETWSPDVRRLNVISEEEGIIGIIYCDLFERNGKTSNPAHFTVCCSRQIYPSETDFSTIQVGENPDGTYFQLPVISLVCNFSPILIASKKSLCFLQLSEVETLFHEMGHAMHSMLGRTHMQNISGTRCATDFVELPSILMEHFAKDIRILTKIGKHYGTGETIQADMLQRFMKSTNFLQNCETYSQAKMAMLDQSFHDEKIISDIDNFDVVENYQALERRLKVLVDDQSNWCGRFGHLFGSGQLITATYFDRTIASKIWYALFEDDPYSRKNGDKFKKHLLKWGGLKDPWKCIADVLECPMLEKGGSDAMEFIAQSHKS

SEQ ID NO: 97972 - DNA, 2037 bp, Leishmania major
  CDS (1)..(2037)
atgtccgccaacccgctgcttcagcagagccctctgcagtaccaacacccgccctttgaccagatcaccatggagcactacgcacccgctttcgagcagggcatggcggagcagatggcggagatcgaggcgatcaagtccaaccctgacgcgcccacccttgaaaacacagtggtggcactggagcggagcggggcgcagcttgagcgcgcacgtcttgtcttccaaaacctctgctctgcacacacgaacccggagatgcaaaatcccgagcaggcctgcgccccaaagttctccgtccacacagacaagatctacctcgacggtgccttgtacaaccgcatcaaggccgtgtgggacgagcgtgccagtctcgctggtgaagacttgcggctggtggaacactacgagagggagtttcgcaaggccggcgccggccttcacgacgcagacaaggagaagctgaaacaggtaaatgagcgcctcgctaccctcgagagtgattttgccaagaaggtgatgggcacgcgcaagaccgcctcgctcgccgtggataacgttgccgagctggagggcctcagcgaggacgagatcgcgacggctcagatggaggcggagagcctcggccaccccggaaagtacgcattgattatcgtgaacacgactcagcagccactgctagcgtctctgaggagccgcgagacacgccgccgcctgttcgaggcgagcgtgcagcgcgccgcacgcggtgacgagaatgacacgagcgccatcatcgcggagattgcgcagctgcggctgaagaaggcgaagctgctcggcaggaagtgctttgcggagtgccagctgcagaaccagatggccgacccggcgtccgcggaggccttgctgcacgatatgggcaatgcggcggcgtcgaaggcgaagaaggaagcggctgacatcaagcagatgattcgcgaggagggtggggactttgagctggcgccctgggactggaggtactacgcggagcgagtgcgcaagcagcggcacgacctcgacgagaacgaggcgaagccatactttgagctaaacaacgtgcttgagcggggcgtgttctacacggcggcgaaactgtacggcgtgacgatgcggcggcgcacggatctgccggtgtaccaccccgacgtgctgtcgtttgagatgtttgactgcacgggtgggtctcttgccattttccgccttgacccctacgcgcgcgcaagcaagcgcggtggtgcgtggatgaccttctatgtttgccagagccccctccttggccagaagccggtcgtgtacaatgtgctcaacattgtgaagccggctgaaggcaagccgaccttgctgagccgcagtgacgtgacgacgctcttccatgagttcggccacggactgcacggcatgctaagcaacctcaagtgctcgactctttccggtacaagtgtcgcccgcgacttcctcgagtttccatcgcagatcaacgagcactgggcaatgtacgacgccgtgttgaagaactacgcccctcactacgaaaccaaggagccgatcccgcaggcactggtggatcgcatgaaggcggccgagacaaacggcgccggcttccacaccattgaggtggtcaaggcggcgtacctcgatctctgctggcacctggttgcggaggaaacggcttttctaccaccggcacagatggaggaggcggcgatgaggtccttcggtgttgggatgaccgaagcgccgccgcgctaccacagcgggtgcttcatgcacactttctctggcggatatgcctcgaactactacgtgtaccagtgggcgcgtgtgctggactgcgacgggttcgagtggttcctggagaacggcgggctgacgcgcgagaacggtgaccacctgcgtgcgtgcgtgctctctgtgggcaactcagtggacgcgaacgttgcgtacgagaagtttgccggccgcaaggcaaacatgaaggcgttcctccgcatcaacggcctgctggacgaatag

SEQ ID NO: 97973 - protein, 678 aa, Leishmania major
MSANPLLQQSPLQYQHPPFDQITMEHYAPAFEQGMAEQMAEIEAIKSNPDAPTLENTVVALERSGAQLERARLVFQNLCSAHTNPEMQNPEQACAPKFSVHTDKIYLDGALYNRIKAVWDERASLAGEDLRLVEHYEREFRKAGAGLHDADKEKLKQVNERLATLESDFAKKVMGTRKTASLAVDNVAELEGLSEDEIATAQMEAESLGHPGKYALIIVNTTQQPLLASLRSRETRRRLFEASVQRAARGDENDTSAIIAEIAQLRLKKAKLLGRKCFAECQLQNQMADPASAEALLHDMGNAAASKAKKEAADIKQMIREEGGDFELAPWDWRYYAERVRKQRHDLDENEAKPYFELNNVLERGVFYTAAKLYGVTMRRRTDLPVYHPDVLSFEMFDCTGGSLAIFRLDPYARASKRGGAWMTFYVCQSPLLGQKPVVYNVLNIVKPAEGKPTLLSRSDVTTLFHEFGHGLHGMLSNLKCSTLSGTSVARDFLEFPSQINEHWAMYDAVLKNYAPHYETKEPIPQALVDRMKAAETNGAGFHTIEVVKAAYLDLCWHLVAEETAFLPPAQMEEAAMRSFGVGMTEAPPRYHSGCFMHTFSGGYASNYYVYQWARVLDCDGFEWFLENGGLTRENGDHLRACVLSVGNSVDANVAYEKFAGRKANMKAFLRINGLLDE

SEQ ID NO: 97974 - DNA, 2055 bp, Mesorhizobium loti MAFF303099
  CDS (1)..(2055): transl_table=11
atgccctccacgaaaaccgtcgacatcgccgcccatccgctgaccgcgtggcaagggccgctcggcctgcccgactttgcccatattggcgacagcgatttttcgccggtcttcgacgcggcgctaacggcgcatgaggcggagatcgatgcgattgccggcaacaaggacgcgccgacgatcgagaacacgcttgccgcgctggaactcggcggcgaggcgctcgatcatgtctcgtcgatcttctggtgccgcgccggcgcttacaccaacgagaccatccaggcgctggagcgcgacatctcgccgaagatgtccaggcatttttcggcgatatcgatgaacgagaagctgtttgcccgcatcgacgacctctaccagcgtcgcgagagccttgacctcgacgccgagaccctgcgggtgctggagaagacctggaagggtttcgtccgctccggcgccaagctcgatgccgagggcaagaagcggctggccaggatcaatgaagagctgtcttcgctcggtacggctttcggccagaacgtgctggccgatgagcgcgactgggcgctgttcctcgacgaggccgaccttgccggcctgccggatttcctgaaaagctcgatggcagaggcggccgagatgcgcggccagaagggccgctacgccgtcactttgtcgcgctcgatctacgagccgttcacgaccttctcggaacgccgcgacctgcgcgagatcgccttcaaagctttcaccatgcgcggccagaatggcggcgccagcgacaacaccgaagtcgtgcgcgacatgctgaaactgcgcgccgaaaaggccgagctgctcggctacgcctccttcgccgcgctgaagctcgacgacaccatggccaagacgccgaaggcggtgcacgacctgctcgatccggtctgggaaaaggcgctggaaaaggccgccgccgaccagaaggaattggagcgcctggcggcgcaagccggcagcaacgagaaattcgccgcctgggactggcgcttctaccaggagaagctgcgcgcggaaaaattcgccttcgatgaggcggagctgaaaccctatctgcagctcgaccgggtgatcgacgcctgcttcgacgtcgcgaccaaactgttcggcatcaccttcgaggagaaaaagggcatcgtcgcctggcacccggacgcgcgcgtcttcgtggtgaaaaatgccgatggcagcgagcgcgcactgttcctggccgattatttcgcgcggccctcgaagcgttccggcgcctggatgagcgcgctgaagtccggctacaaacttggcaacggctcgaagccggtgatctacaacatcatgaacttcgccaagccgccggcaggcgaaccggcattgctgtcggtcgacgaggcgaagactctgttccacgaattcggccacgcgctgcacggcatgctgaccgacgtcacctggccgtcggttgcgggcacctcggtcagccgcgattttgtcgaactgccctcgcagctctacgagcactggctgacggtgccggcggtgctggagaagcacgcgctgcacgtcaagaccggcaagccgatgccgaaggcgctgctcgacaagatgctggccacgcgcaccttcggcgccggcttcgccaccgtcgagtttacgtcttccgccttgatcgacatggcctatcacgctcggccagatgcaccggccgaaccgcttcgtttcgaagccgaaacgttggaaaaactcgacatgcccgacaccatcgcgatgcgccaccgcaccccgcatttcggccatgtcttctcgggcgacggctattcggccggctactattcctacatgtggtcggaagtgctggacgccgacgccttcgccgccttcgaggagaccggcgatcccttcaacccggcactggccgaacggctgcgcaagaacatctacgccgccggcggctcgaaggaccccgaagagctctacacggcctttcgcggcaagatgccgtcgccggaggcgatgatggtgaagcgcggattggtgtag

SEQ ID NO: 97975 - protein, 684 aa, Mesorhizobium loti MAFF303099
MPSTKTVDIAAHPLTAWQGPLGLPDFAHIGDSDFSPVFDAALTAHEAEIDAIAGNKDAPTIENTLAALELGGEALDHVSSIFWCRAGAYTNETIQALERDISPKMSRHFSAISMNEKLFARIDDLYQRRESLDLDAETLRVLEKTWKGFVRSGAKLDAEGKKRLARINEELSSLGTAFGQNVLADERDWALFLDEADLAGLPDFLKSSMAEAAEMRGQKGRYAVTLSRSIYEPFTTFSERRDLREIAFKAFTMRGQNGGASDNTEVVRDMLKLRAEKAELLGYASFAALKLDDTMAKTPKAVHDLLDPVWEKALEKAAADQKELERLAAQAGSNEKFAAWDWRFYQEKLRAEKFAFDEAELKPYLQLDRVIDACFDVATKLFGITFEEKKGIVAWHPDARVFVVKNADGSERALFLADYFARPSKRSGAWMSALKSGYKLGNGSKPVIYNIMNFAKPPAGEPALLSVDEAKTLFHEFGHALHGMLTDVTWPSVAGTSVSRDFVELPSQLYEHWLTVPAVLEKHALHVKTGKPMPKALLDKMLATRTFGAGFATVEFTSSALIDMAYHARPDAPAEPLRFEAETLEKLDMPDTIAMRHRTPHFGHVFSGDGYSAGYYSYMWSEVLDADAFAAFEETGDPFNPALAERLRKNIYAAGGSKDPEELYTAFRGKMPSPEAMMVKRGLV

SEQ ID NO: 97976 - DNA, 2583 bp, Arabidopsis thaliana
  CDS (1)..(2583)
atgtggaagctgacgcggcgactgcagccgcatatcaattcgacccgatggttagtccgaaatttccggaatggaggagctggagacgccaccggtctctatggcttcgatcatctaaaaacagctaaagggtttcagagattcgttgctgatgccattgaaaggtctggtgagttggtgagctacatatcaggaatgccttcgtctccagagattattaaagccatggatgagatttcagacactgtttgttgtgttgttgactctgctgaactctgtagacaaactcatcctgacagggaatttgttgaggaagcgaataaagcagcaattgaaatgaatgattatctacatcatcttaacacgaaccatactttgtatgctgcggtgaaaaaagcagagcaagattctaacttgcttaccaaagaagcaagtaggaccgcacatcaccttcgaatggactttgaacggggtggcattcatctagaccctgagaagctagataaagtgaataacttaacaaccaacatatttcagttatgcagggagttcagcgaaaatattgctgatgatccaggacatgttgatatatttccaggatcacgcatccctcgacatctgcatcatcttctcaaccctacctaccgatccacttcagggggctcaagagggtctacaagatcagcgcataagtcgaaacagaaagggtttcgaataaatactgatccacgaaccgtttcttccattttgcaatggacatcagacgaagaggttagaaaaatggtatacatccaagggaactctgttcctcatgcaaatcacggagttcttgagaagcttattgctgcacgccatgagctttcccagatgatggggtgtaattcttatgctgacattatggtcgagccaaacctagcaaaatccccaaaggttgtgacatccttcctacaagaactgagcaagacagtcaaaccgaaggcggacgaagaattcatagccattagagactttaaaagagagaaatgtggtaatccatctgcagagttagagccatgggatgaaacttactacacttcaatgatgaaatcctccatcaatgatgtggacactgctgttgtagcatcatattttcctctgccacagtgtattgaaggcctaaaagtgcttgttgaatcattatttggtgcaacatttcatactattcctctcgcgccaggtgaatcttggcacccaaatgtggttaaactgtctcttcatcacccggacgagggtgatctcgggtatctttaccttgacttatactcaagaaaaggcaagtaccctgggtgtgctagctttgcaatcagaggaggacgcaagatttctgagacagaataccaacttcctgttatagctcttgtttgcaatttttcgcgagcttgtgattcgtcaattgtgaagcttaatcactctgaagttgaagttttgttccacgaattcggacatgctcttcactctctgctctcacgaacggattaccaacatttttctggtacccgggtggctcttgacttggcagaaatgccttcaaatctatttgagtactatgcatgggactatcgcctcctgaagagatttgcccgtcattactcgaccggtgagacaatacccgagaagttggttaattcgttacaaggtgcgaggaacatgtttgcagcaacggaaatgcaacgccaggtcttttatgcgctgatcgaccaaatgttgttcggggaacaaccagagacagcaagagatgtgagtcacctcgtggctgaactgaaacggcagcacactagctggaaccatgttgaaggaacacattggtatatccgattcagtcacctacttaactatggagcagggtactatagctacttatacgctaaatgctttgcatcgacgatatggcaatcaatatgtgaagaagatccgctttcgttgaacacaggaacattgctgagagagaagttcttcaaacatggaggagccaaagatccagctgagctacttaccgatctagcagggaaagagatcattagtgttcatggtgaaggcatagttcctgcaaccacaaaccctagattcgcaatcaaatgtcaaaattcccaaatcgaatccgatacaacagaggatccatctcgttcaaagaattcaagctcttccggcgtaggattcggttcaccggcgtcttcttcttcgccggctaagaaattgagtgcggctacatcgggaaacaagaaagggaaaggtaagagagaggtgaatcggcgtgctcctgtggagaaacctgtgttcatgagcgaagaaggagcggccaaggcagaggagcagagacaaaacgaaaacgcgtttcttcttacttggcttgggcttggtatcgtcatcctcatcgaaggcattattctcgctgcttcaggattcctcccagaagagttggataagttgtttgtgaagtatgtgtatccagtgttcactccatcggttgtgttattcgtagctgggacaactgcatatggagttctgaagtacatacagaatgagaaaatgaagggtcaagagtga

SEQ ID NO: 97977 - protein, 860 aa, Arabidopsis thaliana
MWKLTRRLQPHINSTRWLVRNFRNGGAGDATGLYGFDHLKTAKGFQRFVADAIERSGELVSYISGMPSSPEIIKAMDEISDTVCCVVDSAELCRQTHPDREFVEEANKAAIEMNDYLHHLNTNHTLYAAVKKAEQDSNLLTKEASRTAHHLRMDFERGGIHLDPEKLDKVNNLTTNIFQLCREFSENIADDPGHVDIFPGSRIPRHLHHLLNPTYRSTSGGSRGSTRSAHKSKQKGFRINTDPRTVSSILQWTSDEEVRKMVYIQGNSVPHANHGVLEKLIAARHELSQMMGCNSYADIMVEPNLAKSPKVVTSFLQELSKTVKPKADEEFIAIRDFKREKCGNPSAELEPWDETYYTSMMKSSINDVDTAVVASYFPLPQCIEGLKVLVESLFGATFHTIPLAPGESWHPNVVKLSLHHPDEGDLGYLYLDLYSRKGKYPGCASFAIRGGRKISETEYQLPVIALVCNFSRACDSSIVKLNHSEVEVLFHEFGHALHSLLSRTDYQHFSGTRVALDLAEMPSNLFEYYAWDYRLLKRFARHYSTGETIPEKLVNSLQGARNMFAATEMQRQVFYALIDQMLFGEQPETARDVSHLVAELKRQHTSWNHVEGTHWYIRFSHLLNYGAGYYSYLYAKCFASTIWQSICEEDPLSLNTGTLLREKFFKHGGAKDPAELLTDLAGKEIISVHGEGIVPATTNPRFAIKCQNSQIESDTTEDPSRSKNSSSSGVGFGSPASSSSPAKKLSAATSGNKKGKGKREVNRRAPVEKPVFMSEEGAAKAEEQRQNENAFLLTWLGLGIVILIEGIILAASGFLPEELDKLFVKYVYPVFTPSVVLFVAGTTAYGVLKYIQNEKMKGQE

SEQ ID NO: 97978 - DNA, 2040 bp, Pasteurella multocida subsp. multocida str. Pm70
  CDS (1)..(2040): transl_table=11
atgtccaatcctttacttagctttgaagggctcccccctttttcacaaataaaaccagaacatgtgcaacctgccgtcgaaaatttgattcaagcttgccgtgacaatattgaacaattactcaaacaagagcaattcacatgggataattttattttacctttaactgaaatgggtgaccgtttcagtaaagcctggtctcctgtttcccatctcaatgccgtcaaaaacagtcctgaactccgtgcagcatatcaagcgtgtttgcctttgttgtcggaatacagtacttgggtaggtcaacataaagggttatatcaggcttatgaaaaacttaaaaacagtcctgagtttgcacattacgatttagcacagcaaaaaactattgataatgccctacgtgatttcaaattatctggtatttctttatcggcagagaaacaaaaacgttatggtgaaatctctgcacgcttatctgaattaagtgcgcaatttagtaataatgtccttgatgccacaatgggctgggataaagtgattgaaaatctcgaggaattaaaaggattacccgaatcagctttagcagcagccaaacaatctgctgagaataaagggctagaaggctatcgtttcacattagaaatcccaagttatttacctgtcatgacctattgtgaaaatcgagcattgcgtgaagaaatgtatcgtgcttttgttacacgcgcttccgaccaaggtccaaatgcaggaaaatgggataacagcgctattatgcaagaaattctcaacttacgtgtagagcttgcccaccttcttgattttaactgttataccgagctttcccttgcaaccaaaatggcggaaaaaccacaacaggtgttagatttcttagacagcctggcaaaacgttcaaaaacacaaggtgagaaagaattagccgagttacttgatttctgccaaacacaatttggcgtaaatgagcttgaagcttgggatattgctttttacagcgaaaagcaaaaacaatatctttattcaatcaatgatgaagaattacgcccttacttccctgaaaatcgtgtattagccggtttatttgagttaattcaacgcatttttaatattcgtaccgttgaacgctttggaattgatacttggcataacgatgtgcgtttttttgatcttattgatgaaaacgataacctacgtggcagtttctaccttgatttatatgcacgtgagaataaacgtggcggtgcctggatggatgattgtatcggacgtcgcaaaaaagcaaatggtgaaatccaaaaaccggttgcctatctcacctgtaattttaacgcccctgtaggagataaaccggctttatttactcatgatgaagtcaccacattattccatgagtttggtcatggtattcaccatatgctgactgaaattgatgttgctgatgttgcaggaatcagtggcgtaccttgggatgcggtggaattaccaagccagtttttagaaaattggtgctgggaagccgacgcgctcgactttatctctggtcactatgaaaccggtgaaccgctaccaaaagaaaaattagcacagctcttaaaagcgaaaaatttccaagctgcgatgtttgtcttgcgtcaattagaatttggtttatttgatttccgtttacaccatcattttgatccaaccaaagcaaatcaaatccttgataccttaaaagcggttaaagaggaagtggctgtgattaaaggcgtagaatgggcaagagccccgcacagttttagccatatttttgcaggtgggtatgccgcaggttattacagttatttatgggcagaagtgctttcagctgatgccttttcacgctttgaagaagaaggtatttttaatccagaaacggggaaatctttcttagctgaaatcttaagccgaggaggaagtgaagagcctatgaccttatttaagcgtttccgtggacgtgaaccacaattagatgcccttttaagacataaaggcattgcgaattaa

SEQ ID NO: 97979 - protein, 679 aa, Pasteurella multocida subsp. multocida str. Pm70
MSNPLLSFEGLPPFSQIKPEHVQPAVENLIQACRDNIEQLLKQEQFTWDNFILPLTEMGDRFSKAWSPVSHLNAVKNSPELRAAYQACLPLLSEYSTWVGQHKGLYQAYEKLKNSPEFAHYDLAQQKTIDNALRDFKLSGISLSAEKQKRYGEISARLSELSAQFSNNVLDATMGWDKVIENLEELKGLPESALAAAKQSAENKGLEGYRFTLEIPSYLPVMTYCENRALREEMYRAFVTRASDQGPNAGKWDNSAIMQEILNLRVELAHLLDFNCYTELSLATKMAEKPQQVLDFLDSLAKRSKTQGEKELAELLDFCQTQFGVNELEAWDIAFYSEKQKQYLYSINDEELRPYFPENRVLAGLFELIQRIFNIRTVERFGIDTWHNDVRFFDLIDENDNLRGSFYLDLYARENKRGGAWMDDCIGRRKKANGEIQKPVAYLTCNFNAPVGDKPALFTHDEVTTLFHEFGHGIHHMLTEIDVADVAGISGVPWDAVELPSQFLENWCWEADALDFISGHYETGEPLPKEKLAQLLKAKNFQAAMFVLRQLEFGLFDFRLHHHFDPTKANQILDTLKAVKEEVAVIKGVEWARAPHSFSHIFAGGYAAGYYSYLWAEVLSADAFSRFEEEGIFNPETGKSFLAEILSRGGSEEPMTLFKRFRGREPQLDALLRHKGIAN

SEQ ID NO: 97980 - DNA, 2037 bp, Neisseria meningitidis MC58
  CDS (1)..(2037): transl_table=11
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 97981 - protein, 678 aa, Neisseria meningitidis MC58
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 97982 - DNA, 2037 bp, Neisseria meningitidis Z2491
  CDS (1)..(2037): transl_table=11
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 97983 - protein, 678 aa, Neisseria meningitidis Z2491
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 97984 - DNA, 2058 bp, Deinococcus radiodurans R1
  CDS (1)..(2058): transl_table=11
atgacacaatccactgctcagagcagcaacccgctgctgaatatcggtttcaagattcctttcgaccagattcgccccgagcacgccgaacctgctgtagacgagttgctggcagcggcacgggagcgcgtggaaaacttggcccgttccggcgaacgcaacttcgagaacttcatggccgacctcgacaccctcaccgagcagctcggcaccgtgaacaccatcgtgcaccatctcgacagcgtggtcagcagcgacgagtggaaagccgctaccgaggccatcatccccaaaaccacgcagttttataccgaactcagcctgcatccggggctgtggggggcgctcaaggcgtttggagagacggacaccgccaaggggctcgacccggtgcgtgcccggcacctcaagctgaccaccgacgaattccgccggggcggggccgacctgcccgacgaccagaaggcgcggctgctggaagtgaacaccaagctcgcccagacgaccaaccagtttgccaagaacgtgctggacgccactgccgcctacgaactgtacgtgcccacggagcgcctggggggcgtgccgcagcgcgtgcaggacgcgacccgccaggacgcccagagcaaaggccaggaagaccaccgcctgacgctgcacgcgcccacgctgcaacccatcctgacctacgccgacgaccgcgaactgcgccgcgaactgtgggaagcgagcggaatgctggggcagcaggaaggccgcgacaaccgcccgctgatccgcgagattctgaagctgcggcgcgagcaggccgagattctgggcttcgccaactttgccgactacgtgctggaagaccgcatggcgaagtcgggccagggcgccctaaacttcgagcgcgacctcgacgccaagacccgccccgcctacgagcgcgaaaacgccgagctggaggcgtactaccgcgagaaggccggagccgacgcgcccgccctggcgccctgggacattgcatactgggccgagaagcagcgtcaggaaaagtacgacttcgacgaggaagccctgcggccctacttcgcgctcgacaacgtgctctcgggcctgttcgaaatctgccgccgcgtcttcggcatcacggtgaaagaagcccaggcccccggctggcaccccgaagttaagttctacgacatcttcgacgaggcgggcacccacatcgccagcttctacaccgactggttcccacgcgacactaagcgcggcggcgcgtggatgaacgcctttatcaccggcggcccgaaagaaggcggcgtagacccccacctcggcctgatgtgcggcaacatgactccgcccagttcaggagggcagggcgctgatgcccccgccctgctgagcatccgcgaggtggaaacggtgttccacgagttcggccacctgctgcaccacgccatgagccgcgtgccggtcaagtcgctcagcggcaccaacgtcgcctgggacttcgtggagttgccctcgcaaattatggagaactgggtgatggagcgcgaggccctcgacctctttgcccggcactaccagaccggcgagaaactgcccgacgacctgttccagaagctggtgaaggcccagaactaccgcgccgcgaacttcgccatgcgccagtactccttcggcctgaccgacctgacgctgcacgtcgagtacgaccccagcggcgaggaagacccggtggccgtggcccgcgacgtgatggcccgcttttaccccactgagctgccagggaactacgcgcaggtcgccagctttaaccacctgttcagctcgccggtcggctacggcgcgggctactactcctacaagtgggccgaagtgctggacgccgacgccttctcgcgcttcgccaaggaaggcatcttcaaccgcgaaacgggccgcgcctacgtggacagcattctcagccgggggggcagcgcagaccccgccgcgctctaccgcgagttcatgggccgtgaccccgacgccgacgccctgctgcgccgcagtggcctgctgtaa

SEQ ID NO: 97985 - protein, 685 aa, Deinococcus radiodurans R1
MTQSTAQSSNPLLNIGFKIPFDQIRPEHAEPAVDELLAAARERVENLARSGERNFENFMADLDTLTEQLGTVNTIVHHLDSVVSSDEWKAATEAIIPKTTQFYTELSLHPGLWGALKAFGETDTAKGLDPVRARHLKLTTDEFRRGGADLPDDQKARLLEVNTKLAQTTNQFAKNVLDATAAYELYVPTERLGGVPQRVQDATRQDAQSKGQEDHRLTLHAPTLQPILTYADDRELRRELWEASGMLGQQEGRDNRPLIREILKLRREQAEILGFANFADYVLEDRMAKSGQGALNFERDLDAKTRPAYERENAELEAYYREKAGADAPALAPWDIAYWAEKQRQEKYDFDEEALRPYFALDNVLSGLFEICRRVFGITVKEAQAPGWHPEVKFYDIFDEAGTHIASFYTDWFPRDTKRGGAWMNAFITGGPKEGGVDPHLGLMCGNMTPPSSGGQGADAPALLSIREVETVFHEFGHLLHHAMSRVPVKSLSGTNVAWDFVELPSQIMENWVMEREALDLFARHYQTGEKLPDDLFQKLVKAQNYRAANFAMRQYSFGLTDLTLHVEYDPSGEEDPVAVARDVMARFYPTELPGNYAQVASFNHLFSSPVGYGAGYYSYKWAEVLDADAFSRFAKEGIFNRETGRAYVDSILSRGGSADPAALYREFMGRDPDADALLRRSGLL

SEQ ID NO: 97986 - DNA, 2055 bp, Agrobacterium tumefaciens str. C58
  CDS (1)..(2055): transl_table=11
ttgaagaccgccctttatcccgcgctggttgactggaacggccataatggcctgccgaaattcgatgcggtcaaggatgaggattttgcgcccgctttcgatgccgcgcttttttcccatgagcaggaaatcgatgcgattgcgggaaatccagaggcgccgagtttcgaaaacacggtgaccgcactcgaaattgcaggtgacgagctctcgcgtatctcgtcgctgttctggaacaaagccggcgccaacaccaatggtgtgatccaggcgctcgagcgggaaatcgcgccaaagatgtcgcgacattattcgaagatcggcatgaacgaagcgctgttcaagcgcatcgacacgctgtgggaaaagcgcgaggcgcttgggctgacaggcgaagaaaaacgggttctcgaacgccattggaaaggttttgtccactcaggtgcgaaattgccgaaagagcggcaggagcggctggcggccatcaatgaagagcttgccggtctcggcgcgaaattcggccagaacgtgctggcggatgagaagagctggaagcttttgctttccacggatgaagagcttgcgggcatccccggcttcctgcgcgacgctatggcgggggcagccggcgagcacggggaggacggcaaatttgccgttaccctttcccgctcgatcatcgagcccttcctgactttttcagaacggcgcgacctgcgcgaacaggccttcaaggcctgggtggcgcggggcgagaacggtggcgagaccgacaatcgcgagatcgtccgccgcaccctcgaactgcgcgaggaaaaggcaaaacttcttggttatgcgaatttcgctgcctataagctggatgatacgatggcgaagacgccggatgcggtgaacggtcttctccgtcaggtctgggaaaaagccgttcaacgggccggtgaggaagaggctggacttgccgccatcatcgccgaggaaggcaagaaccacgaggtgctgccgtgggactggcggcattatgccgaaaagctccgggcacagaaattcaatttctccgaggcggaattgaagccctatctgcagctggaaaagatcatcgaagcctgtttcgatgtggcagagcggctgtttggaattcatgcggtcgaagtgaagggcgttgtgggctatcacccggatgtgcgaattttcgaaatccgcgataacaagggcgatctgaaggccatgttcctcggcgactatttcgcccgcccctccaaacgatcaggcgcctggatgagctccttccagtcgcagcacaagctgccgctgaaggacggcacggtcggtgaaatcccgatcatctacaatgtctgcaatttcgcgaaaccagccgaaggaaaaccggcgctgctttcgctcgacgatgcgcgcacgctgttccatgaattcggccacgccttgcatggcatgttgtccgatgtcacctatccctcggtatccggaacgggtgtctcgcgcgatttcgtcgaattgccgtcccagctttacgaacattggctgacggtgccggaaattctcgaaaaatacgcgctgcactatgagactggtgcgccgatgccgaaggcgctgctggacaaggttctggccgcgcagaccttcaatgccggtttcaacacggtggaattcacctcttcggcgatcgtcgatatggcgtttcacacccgtgacagcgttgccgatccgatggcggttcagggtgaggtactttctggcctcaatatgccaaaatccatcgtcatgcggcacgcgacgccgcatttccagcatgtgttttcgggcgacggttattccgccggttattattcctacatgtggtcggaagttctcgatgccgatgcctttgccgcctttgaggaaaccggcaacgcttttgatggcgagatggcgcgcaggctgaaggataatatctattccgtcgggggctcgatcgatcctgaagaggcttatctcgcgttccgcggcaagatgccgagcccggatgcgatgcttttgaagcgcggtctcgtataa

SEQ ID NO: 97987 - protein, 684 aa, Agrobacterium tumefaciens str. C58
MKTALYPALVDWNGHNGLPKFDAVKDEDFAPAFDAALFSHEQEIDAIAGNPEAPSFENTVTALEIAGDELSRISSLFWNKAGANTNGVIQALEREIAPKMSRHYSKIGMNEALFKRIDTLWEKREALGLTGEEKRVLERHWKGFVHSGAKLPKERQERLAAINEELAGLGAKFGQNVLADEKSWKLLLSTDEELAGIPGFLRDAMAGAAGEHGEDGKFAVTLSRSIIEPFLTFSERRDLREQAFKAWVARGENGGETDNREIVRRTLELREEKAKLLGYANFAAYKLDDTMAKTPDAVNGLLRQVWEKAVQRAGEEEAGLAAIIAEEGKNHEVLPWDWRHYAEKLRAQKFNFSEAELKPYLQLEKIIEACFDVAERLFGIHAVEVKGVVGYHPDVRIFEIRDNKGDLKAMFLGDYFARPSKRSGAWMSSFQSQHKLPLKDGTVGEIPIIYNVCNFAKPAEGKPALLSLDDARTLFHEFGHALHGMLSDVTYPSVSGTGVSRDFVELPSQLYEHWLTVPEILEKYALHYETGAPMPKALLDKVLAAQTFNAGFNTVEFTSSAIVDMAFHTRDSVADPMAVQGEVLSGLNMPKSIVMRHATPHFQHVFSGDGYSAGYYSYMWSEVLDADAFAAFEETGNAFDGEMARRLKDNIYSVGGSIDPEEAYLAFRGKMPSPDAMLLKRGLV

SEQ ID NO: 97988 - DNA, 2064 bp, Sinorhizobium meliloti 1021
  CDS (1)..(2064): transl_table=11
atgaccaccattgcttcgctcaaccccgccctcgtgcactggaccggacatgagggcctgccgcggttcgaagcgatcatggacgaggatttcgcgcccgccttcgatgcggccttggcgagccacgaggcggagatcgaggccattgccgacaatccggaggatcccaccttcgccaacaccgtcgtcgcgctggaaatcgccggcgatgaactttcgcgcgtctccgctctcttctggagcaaggcgggtgcccatacgaacgaggtgatccaggcgctggagcgcgagatcgcgcccaagatgtcgcgccattattcgaagatcggcaccaatccggcactcttcggccgcatcgacgcattgtgggagaaacgggaagagctcggcctcgatgtcgaggccatgcgcgttctggagcggcactggaagagcttcgtgaaggcaggcgccaagcttcacaagcccgagcaggagcgcctcgcggcgatcaacgagaagctcgccggcctcggcgcccggttcgggcagaacgttctcgcggacgagaaggactgggcgctgatcctgtcgggcgaagaggacctggcggggattccggatttcctgagagatgcgatggcggcggccgcgcgcgagcgcggcgaggaagataaatatgcggtcacgctgtcgcgctcgatcatcgagccgttcctgaccttctccgaaagacgggaactgcgcgaacaggctttcagggcctggacggcgcgcggcgaaaatggcggtgagaccgacaatcgcggcatcatcgccgaaacgctcgctctgcgggcggagaaggcgaaactgctcggctatgagaattatgcggcgctgaagctcgacaacaccatggcgaagacgcccgaagccgtgaacggcctgctgatgcaggtatgggaaaaggcggtggcgcgggctcgcgaagaggaggcggacctcgcaaccctcattgccgaagaaggccgcaaccacgaggtcatgccttgggactggcgccactatgcggaaaaattcagggcgcagaaattcagcttctcggaaagcgaactgaagccctatctgcagctggagaagatcatcgacgcctgcttcgccgttgcccggcgcctcttcggcatcacggcgaccgagaagaaaggcattcccgcctatcacccggacgtccgcgtcttcgagatccgcgacgcctccggccggcttacggcccttttcctcggcgaatatttcgcgcgctcctcgaaacgctccggcgcctggatgagctcctttcaatcgcagcacaggctgaagctcaagaatggcgagaccggcgaaatcccgatcgtgtacaatgtctgcaacttcgcgaaacccgccgagggcaagccggcgcttctgtcgatcgacgacgcccgcacgctcttccacgaattcggccatgcgctgcacggcatgctttccaatgtcacctatccctcggtttcgggtaccggtgtcgcgcgcgatttcgtggagctgccctcgcagctttacgagcattggctgacggtgcctgatattctgaggaaatatgcggtgcactacaggaccggcgagccgatgccgcaggcgctgctcgacaaggtgctggcggcgcggacgttcaattccggcttcgcgacggtcgagtttaccgcctcggctctcgtcgacatggcctatcacacggcggaagcggtcggcgatccgatggcgctcgaagcggcgacgctcgagaagatcggcctgccgcagtcgatcgtcatgcgccaccgcagcccgcatttccttcacgtcttctccggcgacggctattcggccggctactactcctacatgtggtcggaggtactcgacgccgacgcattcgcggccttcgaggagaccggcgatcccttcgatccggcgatggcggccagactgaaggacaatatctattcggtcggcgggtccctcgatccggaagatgcctacaaggccttccgcggcaagctgccgagcccggatgcgatgctggcgaagaaggggctggcggcctag

SEQ ID NO: 97989 - protein, 687 aa, Sinorhizobium meliloti 1021
MTTIASLNPALVHWTGHEGLPRFEAIMDEDFAPAFDAALASHEAEIEAIADNPEDPTFANTVVALEIAGDELSRVSALFWSKAGAHTNEVIQALEREIAPKMSRHYSKIGTNPALFGRIDALWEKREELGLDVEAMRVLERHWKSFVKAGAKLHKPEQERLAAINEKLAGLGARFGQNVLADEKDWALILSGEEDLAGIPDFLRDAMAAAARERGEEDKYAVTLSRSIIEPFLTFSERRELREQAFRAWTARGENGGETDNRGIIAETLALRAEKAKLLGYENYAALKLDNTMAKTPEAVNGLLMQVWEKAVARAREEEADLATLIAEEGRNHEVMPWDWRHYAEKFRAQKFSFSESELKPYLQLEKIIDACFAVARRLFGITATEKKGIPAYHPDVRVFEIRDASGRLTALFLGEYFARSSKRSGAWMSSFQSQHRLKLKNGETGEIPIVYNVCNFAKPAEGKPALLSIDDARTLFHEFGHALHGMLSNVTYPSVSGTGVARDFVELPSQLYEHWLTVPDILRKYAVHYRTGEPMPQALLDKVLAARTFNSGFATVEFTASALVDMAYHTAEAVGDPMALEAATLEKIGLPQSIVMRHRSPHFLHVFSGDGYSAGYYSYMWSEVLDADAFAAFEETGDPFDPAMAARLKDNIYSVGGSLDPEDAYKAFRGKLPSPDAMLAKKGLAA

SEQ ID NO: 97990 - DNA, 2046 bp, Escherichia coli K12
  CDS (1)..(2046): transl_table=11
atgacaacaatgaatcctttccttgtgcaaagcacactgccgtatctggctccccattttgatcaaattgccaatcatcactatcgcccggcattcgatgagggaatgcagcaaaagcgggcagaaattgctgccatcgcgcttaacccgcaaatgcctgatttcaacaatactattctggcactggaacaaagcggagaattacttacccgcgttaccagcgtcttttttgcgatgactgcggcgcataccaatgatgaattacagcgtcttgacgagcagttttccgctgaactggcggaactggctaatgatatctatctgaacggtgaattattcgcgcgggtagatgctgtctggcagcgccgtgaatccctggggcttgatagtgaatccatccgcctggtggaggtgattcatcaacgttttgtccttgccggagccaaacttgcgcaagctgataaagcaaaattaaaagtactgaatacagaagctgcgaccctgaccagccagtttaaccagcgattactggcagcaaataaatccggcggtctggttgtgaacgatatcgcgcagctggcaggaatgagtgagcaagagattgcgctggcggcagaggcggctcgcgagaaaggtctggataacaaatggctgattccgctgctgaataccacccaacaaccggcgcttgccgaaatgcgcgatcgtgcgacgcgtgaaaaactgtttattgcgggctggacgcgagcggaaaaaaatgatgccaatgatacccgcgctatcattcaacgtctggtggagatccgtgcacaacaggcaacactacttggttttcctcattatgccgcatggaaaatcgccgatcagatggcaaaaacacctgaagcagcacttaactttatgcgggaaattgttccagcggcgcgtcaacgtgcgagcgatgaattagcctccatacaggcggttatcgataagcagcagggcgggtttagcgcgcagccgtgggactgggcattttatgcggaacaggtacggcgggagaaatttgatcttgatgaggcgcagctcaagccatattttgaattaaacacggtgttaaatgaaggtgtattctggaccgcgaatcagctcttcggtattaagtttgtcgaacgttttgatattcctgtctaccatcctgacgttcgtgtgtgggaaatttttgatcataatggcgtggggctggcgttattttacggtgatttcttcgcccgtgattcaaaaagcggcggtgcatggatgggcaattttgttgagcaatcaacgcttaataaaacacatccggtaatttataacgtctgcaattatcagaaacccgctgccggtgagcctgcgttgttactctgggatgatgtcataaccttattccatgaatttggtcatacgctgcacggcctttttgcccgccagcgttatgccacgctttccggcaccaacacgccgcgtgattttgtcgaatttccgtcgcaaatcaacgaacactgggcaacgcatccgcaggtattcgctcgctacgcccggcattatcagagcggggcagcaatgcctgacgaactgcaacagaaaatgcgtaatgccagcctgttcaacaaagggtatgagatgagcgaactgcttagcgccgcacttctcgatatgcgctggcattgcctggaagaaaacgaagcaatgcaggatgtcgatgattttgaattgcgggcgctggtggcggaaaatatggatcttcctgctataccgccacgctatcgcagcagttatttcgcccatatttttggtggcggatatgctgcaggttattacgcttatctgtggacgcaaatgttggccgatgatggttatcagtggtttgttgagcagggcggattaacgcgtgaaaatgggctgcgttttcgcgaggcgatcctttccagaggtaacagcgaagatctggaacgcctgtatcgacaatggcgcggtaaggcacctaagattatgccgatgctgcaacatcgtggcttgaacatataa

SEQ ID NO: 97991 - protein, 681 aa, Escherichia coli K12
MTTMNPFLVQSTLPYLAPHFDQIANHHYRPAFDEGMQQKRAEIAAIALNPQMPDFNNTILALEQSGELLTRVTSVFFAMTAAHTNDELQRLDEQFSAELAELANDIYLNGELFARVDAVWQRRESLGLDSESIRLVEVIHQRFVLAGAKLAQADKAKLKVLNTEAATLTSQFNQRLLAANKSGGLVVNDIAQLAGMSEQEIALAAEAAREKGLDNKWLIPLLNTTQQPALAEMRDRATREKLFIAGWTRAEKNDANDTRAIIQRLVEIRAQQATLLGFPHYAAWKIADQMAKTPEAALNFMREIVPAARQRASDELASIQAVIDKQQGGFSAQPWDWAFYAEQVRREKFDLDEAQLKPYFELNTVLNEGVFWTANQLFGIKFVERFDIPVYHPDVRVWEIFDHNGVGLALFYGDFFARDSKSGGAWMGNFVEQSTLNKTHPVIYNVCNYQKPAAGEPALLLWDDVITLFHEFGHTLHGLFARQRYATLSGTNTPRDFVEFPSQINEHWATHPQVFARYARHYQSGAAMPDELQQKMRNASLFNKGYEMSELLSAALLDMRWHCLEENEAMQDVDDFELRALVAENMDLPAIPPRYRSSYFAHIFGGGYAAGYYAYLWTQMLADDGYQWFVEQGGLTRENGLRFREAILSRGNSEDLERLYRQWRGKAPKIMPMLQHRGLNI

SEQ ID NO: 97992 - DNA, 2034 bp, Caulobacter crescentus CB15
  CDS (1)..(2034): transl_table=11
atgacccagaaatgggtcggacccttcggcggcgtgcccgccttcgacaaggtcaaggtcgctgacttcaagtcggccctggaagcggccatggccaagaacctggccgagatcgacgccatcaccgccggcaaggccgcgccgaccttcgagaacacgatcgcggcgctggaagacgcgggccgcatgctcaatgacgtccagacctactattacatctggggctcgaacatgagcacgccggagttccagaaggtcgaggcggagatggatcccaagctctcggcccactacgataagatcaaccagaacgccgcgctcttcgcccgtatcgaggccgtctacaattcgcccgacaaggccaagctgacgcccgagcagcagcgggtgctgtggatctactacaccaacttcgtgcggtcaggcgccaagctcagccccgaggccaaggcccgggtcggcgcgatcaacaccgagctggccggcctctacaccaagttcagccagaaccagctggccgacgagaacacctggatcgaactgtccgacgccgatctggccggcctgcctgagggcctcaaggccgccgccgcctcgaacgccacggcgcgcaagcttccgggcaagcatgtgatcgtcaacacccgctccagcgtcgatccgttcctgaccgagtcgccggtgcgcgcggcgcgcgagaaggtctggcgcgccttcgtcaatcgcggcgacaacggcggggcgaccgacaacaacgccatcatcagcaagatcctgaagctgcgcgtcgagcgggccaagctcttgggctacaagacccacgcccactggcgcctcgagaacgccatggccaagacgcctgaaaacgccatggcgctgatggaggccgtctggaagccggccatcgcccaggtggccatcgacgtcgccgacatgcaggcgatcatcgacaaggagggcggcgttttcacgctggagccctgggactatcgcttctatgccgagaaggtgcgcaaggcgaagtacgacctcgatatgaacgaggtgaagccgtacctgcagctggacaagctgcgcgagggcatgttctgggcctcgggccagctctacggctttgagttcaagaagctggaaggcatccctgtcttccacgaggacgtcacggtttacgaggtgacgcgcggcggcaagcatgtgggcctgtggtacttcgacccctatgcccgtcccggcaagcgctcgggcgcgtggatgaacgcctaccgcacccaggagcggttcaagcgcgagaccaccacgatcgtctcgaacaactccaacttcatcaagggcaagcccggcgagccggtgctgatctcgtgggatgacgcggtcacgctgttccacgagttcggccacgccatccatggcctgaacgccaatgcgacctatccgtcggtgtcgggcacggccgtggcgcgtgactatgtcgagttccctagccagctgaacgagcactggctgtcgaccccgcaggtgctgaaccagtttgctctgcactatcagaccggcaagccgatcccggccgagctggtcaagaagatcgaggccgccggcaagttcggtcagggcttcggcacgaccgagtatctggccagcgccctcatcgacatgaagctgcacctggccggcgatgtggacatcgatccggacaagttcgagcgcgaggaactggccaagctgaacatgcccaaggagatcgtgatgcggcaccgcacgccgcagttcggccacgtgttctcgggcgatggctattcggccggctactacagctatctgtggtccgacaccctgaccgccgacgctgccgaggccttcgccgaggcgccgggcggcttctacgacaaggccgtcgccaagcggctctacgaggacatcatgtcggcgggcaacacgatcgatccggtcgagcagttccgcgccttccggggccgtgacgtcaagatcggcgccctgatgcgcaagcgcggcttcccggttccgccgggggcctga

SEQ ID NO: 97993 - protein, 677 aa, Caulobacter crescentus CB15
MTQKWVGPFGGVPAFDKVKVADFKSALEAAMAKNLAEIDAITAGKAAPTFENTIAALEDAGRMLNDVQTYYYIWGSNMSTPEFQKVEAEMDPKLSAHYDKINQNAALFARIEAVYNSPDKAKLTPEQQRVLWIYYTNFVRSGAKLSPEAKARVGAINTELAGLYTKFSQNQLADENTWIELSDADLAGLPEGLKAAAASNATARKLPGKHVIVNTRSSVDPFLTESPVRAAREKVWRAFVNRGDNGGATDNNAIISKILKLRVERAKLLGYKTHAHWRLENAMAKTPENAMALMEAVWKPAIAQVAIDVADMQAIIDKEGGVFTLEPWDYRFYAEKVRKAKYDLDMNEVKPYLQLDKLREGMFWASGQLYGFEFKKLEGIPVFHEDVTVYEVTRGGKHVGLWYFDPYARPGKRSGAWMNAYRTQERFKRETTTIVSNNSNFIKGKPGEPVLISWDDAVTLFHEFGHAIHGLNANATYPSVSGTAVARDYVEFPSQLNEHWLSTPQVLNQFALHYQTGKPIPAELVKKIEAAGKFGQGFGTTEYLASALIDMKLHLAGDVDIDPDKFEREELAKLNMPKEIVMRHRTPQFGHVFSGDGYSAGYYSYLWSDTLTADAAEAFAEAPGGFYDKAVAKRLYEDIMSAGNTIDPVEQFRAFRGRDVKIGALMRKRGFPVPPGA

SEQ ID NO: 97994 - DNA, 2142 bp, Synechocystis sp. PCC 6803
  CDS (1)..(2142): transl_table=11
gtggtttatccacaaacctttttcctgcgacttaaacctttccgtttttccatcaccatgacccacaccgccgttgccaatccgctccttcaaggccgggacttgcctgcctttgacaaaattcaacccaccgatgtggagcccgcagtgactaccctggtgcaggaattagaagcccaattaactgagttagaaaaatctgtgcagcccacctgggaaggattggtggaacctctgacggccctggaagaaaaactgagttggacctggggcaccgtttcccatttgatgggggtgaaaaatagccccgaattgcgccatggctttgaacaagtgcaaccgttagtggtaggtttcattagtcggttggggcagagtcgtcccctttatgaagcctttgtggccctgcgggatagcgctgaatggggaaatctagaaccagcccagcaacggattgtggaaagtaatatccgggaagcggaactagggggcgtaggtttaacgggggaaaaacgggacaggtttaacgccattcaattggaattagcggaactggccaccaaattttccaataacgtgttggatgccagccaagcgtttgagttgaaactgaccaccaaggaagaaattgccggcttgccaccgagtttattggctttagccgcccaaactgcccaacagaaaggggaagacaatgctactcccgaggagggcccctggctaattaccttggactatcctagctatcttccttttatgaaatatagccaacgggaggatctgcgggaaaaggtttaccgggcgtttattcgtcgggcagcggatgggcagtgggataaccatcccttaattgagagaattttggcgctacggttggaaaaagcccagttgctaggttttgaaacctatgcagagttaagtttgtcccgcaaaatggcccccaatgtggccgcagtggaaaaactgttggaggagttacgggttcccagttataaggcggcggagcaggaatttgccgatctacagaaatttgctggggtggaagagctacaccattgggatacggcctattggtcagaacggcaacgggaacaggaatttgattttgatgcggaggctctgcggccctatttccccctaccccaggtactggaaggattatttgccttggctaagcgactatttggggtcaccattcaagccagtgaagaagaggttcctgtttggcacccggatgtgcaatttttccgagtgttggatgaatcgggcacggcgatcgccagtttttatttagatgcctacagtcggccggcggaaaaacggggcggtgcctggatggcggattgcttaaaccggggtcaggaattaatcaatgggcaaaaatccctacgtttgccagtagcttatctaatttgtaaccaaacgccgccggtgggggatcagcccagcctgatgactttttacgaagtgactaccctgttccatgaatttggccatgggttgcagcatttactaaccaccgttaattacagcggtgcggcgggcatcaataatgtggaatgggatgcggtggaactgcccagtcagtttatggaaaattggtgctatgaccccaccaccctgtttagtttggccaagcattaccaaaccggggagactttgccccaggcggaatacgaaaaaatcctcgccacccgcaactttatgaccggctctgccatgctccggcagattaacttcagcctgctggatttagaactacaccaccgttaccgtcccgacggcccggaaaccattgagcaaattggcgatcgcctggcgaaaatcaccaccattttgcctcccctgccggaaaatgctttcctctgctcctttggccacatctttgccgggggctatgccgccggttactacagctataaatgggcggaagtactcagtgccgatgcctttgccgcctttgaggaggtgggcttagacaatgaagctgcggtgcaaactacgggtaaacgttttcgagaaacggtgttggccttggggggaagcttagcgcccgcagtggtctttgaaaaattccgggggcgacaaccgcaaactgctccgctgttgcgtcataacggtttgttacccagtgcaacctga

SEQ ID NO: 97995 - protein, 713 aa, Synechocystis sp. PCC 6803
MVYPQTFFLRLKPFRFSITMTHTAVANPLLQGRDLPAFDKIQPTDVEPAVTTLVQELEAQLTELEKSVQPTWEGLVEPLTALEEKLSWTWGTVSHLMGVKNSPELRHGFEQVQPLVVGFISRLGQSRPLYEAFVALRDSAEWGNLEPAQQRIVESNIREAELGGVGLTGEKRDRFNAIQLELAELATKFSNNVLDASQAFELKLTTKEEIAGLPPSLLALAAQTAQQKGEDNATPEEGPWLITLDYPSYLPFMKYSQREDLREKVYRAFIRRAADGQWDNHPLIERILALRLEKAQLLGFETYAELSLSRKMAPNVAAVEKLLEELRVPSYKAAEQEFADLQKFAGVEELHHWDTAYWSERQREQEFDFDAEALRPYFPLPQVLEGLFALAKRLFGVTIQASEEEVPVWHPDVQFFRVLDESGTAIASFYLDAYSRPAEKRGGAWMADCLNRGQELINGQKSLRLPVAYLICNQTPPVGDQPSLMTFYEVTTLFHEFGHGLQHLLTTVNYSGAAGINNVEWDAVELPSQFMENWCYDPTTLFSLAKHYQTGETLPQAEYEKILATRNFMTGSAMLRQINFSLLDLELHHRYRPDGPETIEQIGDRLAKITTILPPLPENAFLCSFGHIFAGGYAAGYYSYKWAEVLSADAFAAFEEVGLDNEAAVQTTGKRFRETVLALGGSLAPAVVFEKFRGRQPQTAPLLRHNGLLPSAT

SEQ ID NO: 97996 - DNA, 2109 bp, Nostoc sp. PCC 7120
  CDS (1)..(2109): transl_table=11
atgagtgcgaatactaccatcactgataatcccttacttaaaggttctggcttgcctccatttacggaaattcaaccagaacaagtacaaccagcctttcaacaactattggcggaactggaacaagaactgactaccttagaggcaaatgtacagcctacttgggatggcttggtcgaacctttagaaaagttaagcgatcgcctgacctggagttggggtatagtaaatcatctagtgggtgtgaaaaatagcccaaaactacgtgtagcccatgaagctgtacaaccacaagtagtacaatttatcaacaagttgggacaaagccaacccatctacaacgcttttaaagaactccgcgccagcgatagttggaaaacgctcgactcagcccaacaaagaattgtggaagcagctattcgggatgctgaactatccggtgtgggcttgcaaggagaagcgcgggaacgtttcaatgccattcaaatggaattagcagaactggctaccaagttctctaaccacgtcctcgatgcaactacagcctttagtctcaccctcaccactaaagcggaagttgacggtttaccccaaagtttacttagtttagcagcacaagcagcacgggcagctggtgcagaaaacgccacaccagaaaatggcccttggcgcattactttagatattcccagttatagccccttcatgcagcacagcaccagacgtgatttgcgcgaaaagctttacaaaacttatattacccgcgcctcatctgatgaattagataacaaccccatcattgaacggactttagagttacgccaagaactggcaaacttattgggtttccaaaattatgccgagttgagcctagccagtaaaatggctcccaacgtggaagcggttgaagcactattagaagaattacgcagcgctagttacgatgcagccgttaaagacttagaagccttgaaagcctttgcagcctccaagggagcgccagaagccgcagacttacgacactgggatattagtttttgggctgaacgccaacgagaagaaaaatttgccttcaccgccgaagaactacgtccttactttcccctaccccaagtcctcgatggcttatttgcactggtgcatcggttgtttggcatcactgttaccccggcagatggccaagccccagtttggcacaaagatatccgttatttccaaatagctgatgaaacgggtagccccatcgcctatttctacctagacccctacagtcgtcccgccgaaaagcgtggcggtgcatggatggatacctgcatcaatcgcgccatcatcacagaaaatggtgtaacaactgtgcgtttacctgtggcttatttggtatgtaaccaaactccgccagtggacggtaaacctagtttgatgacattctatgaagtagaaaccctgttccatgaatttggtcatgggctacatcatatgctcaccaaggttaactacactggagccgcaggcatcaacaatgtagagtgggatgcggtagaactaccaagtcaatttatggaaaactggtgttatgaacgcaccacgttatttagcttggctaaacattaccaaactggggaaactctaccagaacattattatcaaaaactcctagccgcccgcaattatatgagtggtagcggtatcttgcgccaactccactttagcagcgttgatttggaattacactcccgctatcgcccaggtggtcaggaaaccgccgccgatgtgcgtcatcgagttgcccaaaagactactgtcttaccaccactaccagaagacgcttttctctgcgcttttggacatatctttgcaggtggttatgctgctggctattacagttacaagtgggcagaggtactaagtgctgatgctttcgcagcttttgaagatgctgggctggaagatgaagccgccattaaagctacaggtaggcgttatcgggatacggtgttagctcttggtggtagcaagcatccgatggaggtatttgcagcgttccgaggacgggaaccgagtacaacttctttgctcaagcataatggattgctgccaaatgctgcttaa

SEQ ID NO: 97997 - protein, 702 aa, Nostoc sp. PCC 7120
MSANTTITDNPLLKGSGLPPFTEIQPEQVQPAFQQLLAELEQELTTLEANVQPTWDGLVEPLEKLSDRLTWSWGIVNHLVGVKNSPKLRVAHEAVQPQVVQFINKLGQSQPIYNAFKELRASDSWKTLDSAQQRIVEAAIRDAELSGVGLQGEARERFNAIQMELAELATKFSNHVLDATTAFSLTLTTKAEVDGLPQSLLSLAAQAARAAGAENATPENGPWRITLDIPSYSPFMQHSTRRDLREKLYKTYITRASSDELDNNPIIERTLELRQELANLLGFQNYAELSLASKMAPNVEAVEALLEELRSASYDAAVKDLEALKAFAASKGAPEAADLRHWDISFWAERQREEKFAFTAEELRPYFPLPQVLDGLFALVHRLFGITVTPADGQAPVWHKDIRYFQIADETGSPIAYFYLDPYSRPAEKRGGAWMDTCINRAIITENGVTTVRLPVAYLVCNQTPPVDGKPSLMTFYEVETLFHEFGHGLHHMLTKVNYTGAAGINNVEWDAVELPSQFMENWCYERTTLFSLAKHYQTGETLPEHYYQKLLAARNYMSGSGILRQLHFSSVDLELHSRYRPGGQETAADVRHRVAQKTTVLPPLPEDAFLCAFGHIFAGGYAAGYYSYKWAEVLSADAFAAFEDAGLEDEAAIKATGRRYRDTVLALGGSKHPMEVFAAFRGREPSTTSLLKHNGLLPNAA

SEQ ID NO: 97998 - DNA, 2079 bp, Caenorhabditis elegans
  CDS (1)..(2079)
atgcttcgaagtgtgatattacggcatagtcgaacgataagccggaatagctgggtggctagagcatttcgaagcgagaaggtcgacaaagaaacgggattatttggaaataaaaacttgaaaaccgcagaaagtttcaatgaattaccggcggcagttaaaaaatcaactgatgctcttattcaggagcttctaaccccatcgcagaatcccagaacttctattcaaattgtcgatgatatttcgaatgagatttgcaaatcggcggatcttgctgaatgtgttcgtcaactgcacagtgagcccgagttcagaaatgcggccgaagatgtttccagaaatttctgtgagctcgttgaaagcctgaacacaaatacagcactatatcagaagcttaaatcatcagaaatcactgaatcttcaagactggatgatgttgataaacgaactctcaccctgttgcttgatgattttgaacaaagtggagtacatttgaaagataatcaaaaagagcaatttgtgcaactttcctcggagattttcgacgctggcgctagatttcaacagaattgtgatcggattgtgtctgttggaaaattcgatcaagcaaaatacggacttccatcacaaatctacacgccagtctccaactcacttgatagatcaaaacgaaaaatggtgtacaacacgttttatagacatgatgacattcaagaatcatatcttcaacatttaatatcatccaggcatcaactttcacagctcacaggattcgaatcatttgctcatcgagctcaacgaaattctcttctcgagaattatgatacagttcgaagttttttatggggagttgtggagaaatgtcgtggagcattcgaaaaagagctggcagtgttgattgatgtttcagctcaatgcagtcaacaggataataataatggaaataatgaaatttcgacgattgctgaacatgatttgggattccttatgcacttgtatagggaaagcgcctacgatattgcacaagtttcacagcaatcatctccattttttacttttaattccatttggaatggattttccacgttgacacaaagattatatggtgttcgattgattgaggaaccattgattagtggagaaatgtggaattcttcaggagtcatgaaattgcaagcagtcgacgagcagaacaacgagctcggtgtgatctacgtggatgtttcaattcgaccggaaaaagctgtcggagactgtcattatactgttcgttgctccaaacagctttctgatggcacgtggcaaatgccaattttggtactttctctcggattggtggatggtcatagcagccaatggagaaattctagggtgagcttccactctgcagaaaccatgttccacgagctcggacacgcaatgcacagtattctcggcaggaccaagtaccaacacgtagctggaacaagatgccctcaggacttttcggagattccatcgaatcttatggagtacttcttcagtgacttgggagtcatgacagatattatcagaagaactgatcgacctgaagagcaactttcgattgaatcagctgcaactctactagcttccagacactcgttcacagctatcgagacagttcagcaggctgcatatgggctttacgatttggaagttcacggtccgattgctgcaccacagattgcttcgggaagaatgacaactacagaactattccatgatattatgaacaaaacaatgccacacattcaaagatccccggattcggcattccagcatcggttccatcacactgttcaatatggtgcaaagtactactcatatcttgtggcccgtgcttctgcttgtctcatctggcaacagagattcctgaatgacccattctcacggaaatggggagattgttgggccgaagttcaatcacatggaggtggacatcatcctgctgttctattggagaagattcttggcttcaggccaacggaaaatgatttaacgcaggcactctcgaaggaatctcaacatttggcgaatctcgatgcggttactgtataa

SEQ ID NO: 97999 - protein, 692 aa, Caenorhabditis elegans
MLRSVILRHSRTISRNSWVARAFRSEKVDKETGLFGNKNLKTAESFNELPAAVKKSTDALIQELLTPSQNPRTSIQIVDDISNEICKSADLAECVRQLHSEPEFRNAAEDVSRNFCELVESLNTNTALYQKLKSSEITESSRLDDVDKRTLTLLLDDFEQSGVHLKDNQKEQFVQLSSEIFDAGARFQQNCDRIVSVGKFDQAKYGLPSQIYTPVSNSLDRSKRKMVYNTFYRHDDIQESYLQHLISSRHQLSQLTGFESFAHRAQRNSLLENYDTVRSFLWGVVEKCRGAFEKELAVLIDVSAQCSQQDNNNGNNEISTIAEHDLGFLMHLYRESAYDIAQVSQQSSPFFTFNSIWNGFSTLTQRLYGVRLIEEPLISGEMWNSSGVMKLQAVDEQNNELGVIYVDVSIRPEKAVGDCHYTVRCSKQLSDGTWQMPILVLSLGLVDGHSSQWRNSRVSFHSAETMFHELGHAMHSILGRTKYQHVAGTRCPQDFSEIPSNLMEYFFSDLGVMTDIIRRTDRPEEQLSIESAATLLASRHSFTAIETVQQAAYGLYDLEVHGPIAAPQIASGRMTTTELFHDIMNKTMPHIQRSPDSAFQHRFHHTVQYGAKYYSYLVARASACLIWQQRFLNDPFSRKWGDCWAEVQSHGGGHHPAVLLEKILGFRPTENDLTQALSKESQHLANLDAVTV

SEQ ID NO: 98000 - DNA, 2202 bp, Brucella melitensis 16M
  CDS (1)..(2202): transl_table=11
atgtgcgctcggtcgccgccaaagtcaagccctgcgggaaaatgtaaacgttttttcatgaaaacaggcatgcttgactcgaaatccttgcccgcctgccatgcaatgcctaggttcaggctatatcgaaatcatttggtctggagtttcatcatgtccgacaagcccccttacaatcacgcgctgagcgaatggaacggaccgctgggcctgccggattttaccgccttcaaggacgaggattttgcccccgccttcgatgtggcgctggcgcaagacctggcggaagtggaagccattgccggacaagcaggcgaaccgaccatcgacaatacgctcaaagccctgcaactgacaggcaaggcgctggagcgcgtttcctccattttctggctgcgcgcaggcgcgcataccaacaacacgatccaggcgctggagcgcgaaatcgcaccgaaaatgtcgcgtcattattcgcgcatcatgatggatcccgcgcttttcgcccgcatcgacgcgcttgatgaaaatcgcgacatgctggacctcgacagcgaaacgaggcgcgttctggaaaagacgtggaaaggtttcgtccgttccggcgcaaagctcgatgcggcaggcaagacagagcttgcagacatcaatgagaagcttgcggggcttggtgcgcgcttcggccagaacgtgctgaaggatgaatccggctgggcgctgtttatcaccgacgaggccgatcttgccggtctgccggatttcctgaaaaacgccatgcagagtgctgctgccgagcgcggcaagccggatgcatgggccgtcacgctatcgcgctcgatcgttgaaccattcctttctttctcgcagaaccggagcttgcgcgaacaggcgttcaacgcctgggcaaagcgtggtgaaaatggcggcgaaaccgacaatcgcgagatcgtgcgcgagatggtggacttgcgcgaacgcaaggcccatttgctcggttacgccaattttgccgcctacaagcttgacgataccatggccaaaacgccgaaggccgtgatggacctgctggagccggtctggaacaaggcgcgcgccaaagcggcggaagaggaagcggaactggagcgcctgatcgcagccgatggcggtaaccacaaggtcgcgccatgggactggcgcttctatgccgaaaagctgcgcgccgaacgcttcgccttcgatgaggcagaactgaagccctatcttcagctagacaagattatcgaagccgctttcgacgtggcaggccgcctgttcggcatccgctttgaggaaaagaagggcattgcgacatggcacccggatgtgcgggtgtttcaggttttcaatgccgatggcagcgaacgcggcctgttcctcggcgattatttcgcccgcacctcgaagcgctctggcgcatggatgagctcgctgcaatcgagccacaagcttggcaacgggcagaagccgatcatctacaatgtgatgaatttcgccaagcccaaggcgggcgaaccggccctgctctcgcttgatgatgcgcgcacgctgttccacgagttcggccatgcgctgcatgggctcttatcggatgtgacatggcctgccgtttccggcaccgccgtctcgcgcgatttcgtggaactgccatcgcagctttacgaacactggctgaccgttccagccgttctcgaaaaatacgccgtgcactatcgcaccggcgaagccatgccgaaggcgcttctcgacaaggtgcttgccgcacgcaccttcaatgcgggcttcaacacagtggagtttacctcatccgccttggtggacatggccttccacaccggcaaggaaaagattgccgacccactggcttttgaaaagcagacgctggcaaagctttccatgccggatgcaatcatcatgcggcaccgcacgccgcattttacccacgtcttctccggcgacggctattcggcaggctactattcctacatgtggtcggaagtgctggatgcggacgctttctcggcctttgaggagaccggcgacgccttcaacccggaactggcggcaaagctgaaacagcatatctatgccgctggcggcagccgcgacccggaagagctttacaaagccttccgcggcaagatgccgaccccggacgcgatgattgaaaagcgtggtttgaattaa

SEQ ID NO: 98001 - protein, 733 aa, Brucella melitensis 16M
MCARSPPKSSPAGKCKRFFMKTGMLDSKSLPACHAMPRFRLYRNHLVWSFIMSDKPPYNHALSEWNGPLGLPDFTAFKDEDFAPAFDVALAQDLAEVEAIAGQAGEPTIDNTLKALQLTGKALERVSSIFWLRAGAHTNNTIQALEREIAPKMSRHYSRIMMDPALFARIDALDENRDMLDLDSETRRVLEKTWKGFVRSGAKLDAAGKTELADINEKLAGLGARFGQNVLKDESGWALFITDEADLAGLPDFLKNAMQSAAAERGKPDAWAVTLSRSIVEPFLSFSQNRSLREQAFNAWAKRGENGGETDNREIVREMVDLRERKAHLLGYANFAAYKLDDTMAKTPKAVMDLLEPVWNKARAKAAEEEAELERLIAADGGNHKVAPWDWRFYAEKLRAERFAFDEAELKPYLQLDKIIEAAFDVAGRLFGIRFEEKKGIATWHPDVRVFQVFNADGSERGLFLGDYFARTSKRSGAWMSSLQSSHKLGNGQKPIIYNVMNFAKPKAGEPALLSLDDARTLFHEFGHALHGLLSDVTWPAVSGTAVSRDFVELPSQLYEHWLTVPAVLEKYAVHYRTGEAMPKALLDKVLAARTFNAGFNTVEFTSSALVDMAFHTGKEKIADPLAFEKQTLAKLSMPDAIIMRHRTPHFTHVFSGDGYSAGYYSYMWSEVLDADAFSAFEETGDAFNPELAAKLKQHIYAAGGSRDPEELYKAFRGKMPTPDAMIEKRGLN

SEQ ID NO: 98002 - DNA, 2019 bp, Arabidopsis thaliana
  CDS (1)..(2019)
atgacggaaaacgaaggaaacgacaagaaaatcgaaggatctaatcctaagaagaagctcaacgttgtaaccttcaccggagcggcgggtcttcctggttgtgatactgtttgtgtgaacctatctgcgaaggagattctcgatttagctgaagaaattattcacaagtctacacgagttcatgatgctgttgctttggtttctctagataagctctcttatgagaatgttgtattgccgttggctgaattggaagctagacaactctcgcttatacaatgttgtgtgtttcctaagatgttatcgcctcacgataatgttcgtaaagctagtacagaagcggagcagaaaatcgacgctcatatactttcctgcagaaaacgtgaagatgtttaccggattatcaaaatttatgctgcaaagggagaatcgatttctccggaagctaaatgttacctacagtgtctggttagagactttgaggacaatggtctgaaccttactgcaataaaaagagaggaagttgagagactaaaatatgaaattgatgagcttagcttgcgatacattcagaatttaaatgaagatagttcttgtctcttttttactgaggatgagcttgctggtttgcctctagaatttcttcagaatttagaaaaaactcaaaataaagaatttaagctcaccttggaaagtcgtcacgtcgcagctattctagagttgtgcaagatagccaagacaaggaagacggtggctatggcatatggaaagagatgtggagataccaatattcctgtgttacaaagattggttcagtcacgccatagattagcatgcgtatgtggttatgcacacttcgcagattatgctcttgatcgtaggatgtcaaagacatcaatgagggtgatcaggttcctggaggacatttcttccagtttaactgacttggctattagagagttttccattttggaagacttgaagaggaaagaagaaggggagattccatttggcgtagaagatcttttatactacataaagagggtagaggagttgcagtttgatcttgattttggagatatccggcaatattttcctgtcaacttggtcctttccgggatctttaaaatatgtcaggacctttttggaataaaatttgaggaggttacagaagttgatgtctggtatcatgatattcgagcttttgccgtctttgactcaggatctggaaagcttttgggatatttctatcttgacatgtttacaagggaaggaaaatgtaatcacagctgtgtggtggctcttcagaataacgcactgttctccaatggtgcatgtcagattcctgtggcgttgcttattgcacagtttgcaaaggatggtagtggtgaagctgtgccattgggattttctgacgtggttaatctttttcatgagtttggccatgtggtccaacatatctgcaatcgtgcttcatttgctagattctcgggcctacgtgttgaccccgactttcgggagattccttctcagttattggaaaactggcaagatatcaccaagccacttgtggatgaagtctgcaaaacactcaaacgttggcgatattctttctctgcactaaagtcgcttcaggagatattatactgtctatttgatcaaataatatattcggacgatgatgctgacttactccagctaatcaggagtcttcatccaaaggtaatgatagggctaccagtggtggaaggaaccaaccctgcttcatgtttcccacgtgctgtaattggctctgaagcaacatgttacagtcgtttatggagtgaggtgtatgctgctgatatatttgcttcaaaatttggagatgggcatccgaatctatatgccggcttgcagttcagagacaaagtgttggccccaggaggaggcaaagaaccaatggaacttctcaccaattttcttggaagggaaccatcaacacaagctttcatcgctagccggacaaactatagtttgtag

SEQ ID NO: 98003 - protein, 672 aa, Arabidopsis thaliana
MTENEGNDKKIEGSNPKKKLNVVTFTGAAGLPGCDTVCVNLSAKEILDLAEEIIHKSTRVHDAVALVSLDKLSYENVVLPLAELEARQLSLIQCCVFPKMLSPHDNVRKASTEAEQKIDAHILSCRKREDVYRIIKIYAAKGESISPEAKCYLQCLVRDFEDNGLNLTAIKREEVERLKYEIDELSLRYIQNLNEDSSCLFFTEDELAGLPLEFLQNLEKTQNKEFKLTLESRHVAAILELCKIAKTRKTVAMAYGKRCGDTNIPVLQRLVQSRHRLACVCGYAHFADYALDRRMSKTSMRVIRFLEDISSSLTDLAIREFSILEDLKRKEEGEIPFGVEDLLYYIKRVEELQFDLDFGDIRQYFPVNLVLSGIFKICQDLFGIKFEEVTEVDVWYHDIRAFAVFDSGSGKLLGYFYLDMFTREGKCNHSCVVALQNNALFSNGACQIPVALLIAQFAKDGSGEAVPLGFSDVVNLFHEFGHVVQHICNRASFARFSGLRVDPDFREIPSQLLENWQDITKPLVDEVCKTLKRWRYSFSALKSLQEILYCLFDQIIYSDDDADLLQLIRSLHPKVMIGLPVVEGTNPASCFPRAVIGSEATCYSRLWSEVYAADIFASKFGDGHPNLYAGLQFRDKVLAPGGGKEPMELLTNFLGREPSTQAFIASRTNYSL

SEQ ID NO: 98004 - DNA, 2037 bp, Corynebacterium glutamicum ATCC 13032
  CDS (1)..(2037): transl_table=11
atgactgttgaacacctgctcaagcccagcaccttgccctaccagctgcccgatttcgcagcgatcaaggtggctgatttcccgcccgccttcgaactcgcattagctgaacacgatgctgaaattacagcgatcgctaccaatgaggacgctcctacctgggagaacaccattgaggccctggaacgcgcaggcctgtccctcaaccgcgtcgccgccgtattcttcaacttgcagggcaccgattcctcccctgaaatggatgaaatcgcagccactatcgcgccgaaactctccgcgcattcggatgcgattttccacaatgctgcgcttttcgcgcgcattgaggccgtagaagcaccggccgacgaggaatcgcaacgcctgttgtcccacaccaagcgcgcttttcgacgtcgcggtgcagcactcaacgccgacggcaaggcccgactgagcaccatcaaccagcgcctatcggcactgtccgaacagttcggccgcaacctgcttcaggacacccgcgatctggcggtcaactttgaagaatctgaacttgccggttttagcgaagcccgcatatccgccgccgctgactacgcagcagcagttggcaccgaaggctacgtggttccactggaactgcccaccgtgcagtcagagcaggcagtattaaccgaatccgcctcgcgtgcaaagctttatgaagcctcccagaagcgtggcgccagcctgaacaaggacgtgctgctcgaaaccgtgcgtctgcgtgctgaacgcgccacacttttaggctacgacacccacgccgattacgtcatcgaagaagaaaccgccgatgacgtcgcagccgtgcgcgccttgctttatgatctcgccccagccgcctctgccaatgcgaaagccgaatacaaactctccgcagaagaagcagaagaacacggccaaaaagtcggcgcagctgactggagcttctgggaagccaaagtccgcgcccgcgactacgccctggacgaaaccgaactgcgcaactacttcccattgaaccaagtactccgtgacggcgtcttcttcgctgctaaccgcctctacggaatcaccgtggaaccacgccctgacctgcgcggttacgccgagggcgtggacgtctgggaagtcctcgattctgacggctccggcatcggcctgatccttaccgactactacggccgaccatccaagcggggcggcgcttggatgtccagctttgtcgaccaatccgagctgctaggcaccaagccagtcgtggtcaacgttatgggtattaccaaaccaaccaccggcgaagcactactcagcctcgatgaagtaaccaccatcttccacgaattcggccacggcctgcacggcttgctgtccaaggtgcgctacccaagcttctccggaacctccgtgccccgcgactacgtagaattcccctcccagatcaacgaaaactgggcattcgaccctgcagtagtccgcaactacgcccgccacgtggacaccggcgacatcattccagactccctgcttgaggcagtggaagcatcccgccaattcggacaaggttttgccacctccgaatacttggcagcatcgattatcgacctggcctggcactccctgtccacagcggaagccgcagcagtcaatgacattgaccaattcgaagccgacgcactagccgcagcaggcctcgacgtggacaacattgcaccgcgctaccgatccacctacttcaaccacatctttgctggcggctactcagccggctactactcctacctgtgggcggaagcactcgacgccgacggcttcgactggtttcgcgaagaaggcgcagccggatccgtggcttccctcgacgcagcccgcaccgccggccagaaattccgtgacctggtcttatcccgcggcgcagcctccgactacagcaacgccttcgaagaactccgtggccgttccaaagacctcggcccacttctgcgccgccgaggtctggctggggcaatctaa

SEQ ID NO: 98005 - protein, 678 aa, Corynebacterium glutamicum ATCC 13032
MTVEHLLKPSTLPYQLPDFAAIKVADFPPAFELALAEHDAEITAIATNEDAPTWENTIEALERAGLSLNRVAAVFFNLQGTDSSPEMDEIAATIAPKLSAHSDAIFHNAALFARIEAVEAPADEESQRLLSHTKRAFRRRGAALNADGKARLSTINQRLSALSEQFGRNLLQDTRDLAVNFEESELAGFSEARISAAADYAAAVGTEGYVVPLELPTVQSEQAVLTESASRAKLYEASQKRGASLNKDVLLETVRLRAERATLLGYDTHADYVIEEETADDVAAVRALLYDLAPAASANAKAEYKLSAEEAEEHGQKVGAADWSFWEAKVRARDYALDETELRNYFPLNQVLRDGVFFAANRLYGITVEPRPDLRGYAEGVDVWEVLDSDGSGIGLILTDYYGRPSKRGGAWMSSFVDQSELLGTKPVVVNVMGITKPTTGEALLSLDEVTTIFHEFGHGLHGLLSKVRYPSFSGTSVPRDYVEFPSQINENWAFDPAVVRNYARHVDTGDIIPDSLLEAVEASRQFGQGFATSEYLAASIIDLAWHSLSTAEAAAVNDIDQFEADALAAAGLDVDNIAPRYRSTYFNHIFAGGYSAGYYSYLWAEALDADGFDWFREEGAAGSVASLDAARTAGQKFRDLVLSRGAASDYSNAFEELRGRSKDLGPLLRRRGLAGAI

SEQ ID NO: 98006 - DNA, 2025 bp, Xanthomonas campestris pv. campestris str. ATCC 33913
  CDS (1)..(2025): transl_table=11
atgaccaacccgctgctcgatttttccggactgccgtccttcgatgcgatccgccccgaccatgtgggcccggcgatcgatcagctgctggccgatgccgaggcagcggtgaaggcggccgaacaggtcagcccggtcagctgggacagcttcgtggtgccgctggatgacgccaccgagcgcctgtggcgcgcctggggccaggtcggccacctgcaggcagtgatgaatacccccgagctgcgcgaggcctacaacagcaatctgcccaaggtcagccgcttcggcagtgcactggcgcagaacctggccctgtacgcgcaatacaaggcgttggccgcctcgccggaagctgcgcattacgacgaagcccggcgcaaggtactcgacaacgcgctgcgcgatttccgcctgggcggcgccgaactggacgacgcctccaaggcgcgctttgcacagatccaggaagagttgtccggcctggccgccaggttttcgcagaacgtgctcgacgccaccgacgcgtgggcacacgtgacgcaggacgagacccagttgtcgggcttgccgtccgaagtggttgccgccgcacgcgcggcagcggaaaaggatggggctgccggctggaaattcaccttgcagatgccgtgctacctgccggtgcagagcgatgccgacagccgcgaactgcgcgcgcggttgtaccgcgccaatgccgagcgcgcctccgaattcggcgatgtcgcgctggacaacagcgccaccatccagcgcatcctggcgctgcgcgccgagctggcacagctgctgggctttgccagctacgcggactattccatcgccaccaagatggcgcaaagcccggatgaagtgatgggatttctgcgcgatctggccgtgcgtgccaagccgtatgcacaacaggatcgtgccgaactggaagcctttgcgcgcgacgaactcggcctggaacagctggaagcctgggacctggcgtatgccggcgaaaagctcaagcaggcgcgctacagcttctccgagcaggaagtgaagcagtacttcaccgagcccaaggtgctggctggcctgttcgatgtgatccatagcctgtacggcctgactgtcaaacccgatagcgcgccggtctggcacccggacgtgcgcttctatcggctggaagatgcgcagggcgcactggtggggcagttttatctggatctgtacgcgcgcgaaggcaagcgcggcggcgcatggatggacgactgccgcaatcgccgcgagaccagtcagggtgtgcagacgccgctggtgtatctggtgtgcaatttcggccgtggcagtggcgatgcgccggccacgttccggcacggcgaagtcaccacgctgttccatgaaatgggccacggcctgcatcaattgctcacccgtatcggcgagctcggcgtggccggcatcaatggcgtggagtgggatgcagtggagctgcccagccagttcatggagaacttctgctgggaatgggagcgtgtgcaggcgatgaccgcgcacgtgcaaaccggcgagccgctgccgcgcaatctgttcgaccggctgctggccgcgcgcaatttccagagcggcatgttcaccgtgcgtcagctggaattcgcgttgttcgacatgcaattgcacagcagtttcgatccggcccaggacagcgtgctggagttgatcgagcgcgtgcgcgacgaagtggcggtgaatcgcccgccgacgtggaatcgcttcccgcatcagttcagccacatttttgcgggcggctacgcggccgggtattacagctacaagtgggccgaggtcctcagcgccgatgcctacgcggcgttcgaagaagcgcccgagcaggtggccgacaccggcgcgcggttccggcatgaagtgctggcgcgtggtggcagccgcagcgcagcggacaacttccgcgccttccgtggacgcgcgcccaagatcgacgcgctgctgcggcacaacggcatggcgggctga

SEQ ID NO: 98007 - protein, 674 aa, Xanthomonas campestris pv. campestris str. ATCC 33913
MTNPLLDFSGLPSFDAIRPDHVGPAIDQLLADAEAAVKAAEQVSPVSWDSFVVPLDDATERLWRAWGQVGHLQAVMNTPELREAYNSNLPKVSRFGSALAQNLALYAQYKALAASPEAAHYDEARRKVLDNALRDFRLGGAELDDASKARFAQIQEELSGLAARFSQNVLDATDAWAHVTQDETQLSGLPSEVVAAARAAAEKDGAAGWKFTLQMPCYLPVQSDADSRELRARLYRANAERASEFGDVALDNSATIQRILALRAELAQLLGFASYADYSIATKMAQSPDEVMGFLRDLAVRAKPYAQQDRAELEAFARDELGLEQLEAWDLAYAGEKLKQARYSFSEQEVKQYFTEPKVLAGLFDVIHSLYGLTVKPDSAPVWHPDVRFYRLEDAQGALVGQFYLDLYAREGKRGGAWMDDCRNRRETSQGVQTPLVYLVCNFGRGSGDAPATFRHGEVTTLFHEMGHGLHQLLTRIGELGVAGINGVEWDAVELPSQFMENFCWEWERVQAMTAHVQTGEPLPRNLFDRLLAARNFQSGMFTVRQLEFALFDMQLHSSFDPAQDSVLELIERVRDEVAVNRPPTWNRFPHQFSHIFAGGYAAGYYSYKWAEVLSADAYAAFEEAPEQVADTGARFRHEVLARGGSRSAADNFRAFRGRAPKIDALLRHNGMAG

SEQ ID NO: 98008 - DNA, 2079 bp, Xanthomonas axonopodis pv. citri str. 306
  CDS (1)..(2079): transl_table=11
gtgcccgagaaaaccgccccggctccggccgcggatgctgcatccaaccccttgctgaccgccagcacgctgccgttccaggcgccgccgttcgacaagatccaggacgccgattatctgccggcgttcgaagaaggcatgcgccagcatctggccgacatccgcaagatcgccgataacccagaagcgccgaccttcgacaacaccatcgaagcgatggagcgcggcggcgaaacgctcacgcgcgtgtcgcgcatcttcttcgggctggtgcaggccgataccagcgacgcacgccagaaaatccaggaagagatcgcgcccaagctggccgcgcatcaggacgagatcaatctcgaccccaaactcttcgcccgcgtcaagaccatctacgaccagcgcgacacgctgaatctggatccggagcagaagcgtctggtcgagcgcgactacgaagagctggtacgcgccggcgcgcagttgtccgatgccgacaaggacagcctgcgcaagctcaacgtggaagaaaccaccctctccacgcagttccatacccgcctggtcgccgcctcggctgccggcgcggtggtggtggacgacaaggccaagctcgatggcctgagcgaaggcgatatcgccgccgcggccgatgccgccaaggcccgcaagctcgatggcaagtatctgctcactctgcagaacaccacccagcagccggtgctggcgtcgctgaaaaatcgcgagctgcgtgccgaggtattgaaggcctctgagacgcgcgcggaaaagggcgatgccaacgacacccgccagaccatccagcggctggcgcagctgcgcgcgcagaaggccaagttgctcggcttcgacaactacgccgcctacagcctgggcgaccagatggccaagacgccggatgccgcgctcaagctgctgaccgacaccgtgccggctgccactgccaaggcacgccgcgaagcggccgagatgcagaaggtcatcgacgcgcagaaaggcggcttcaaactcgccgcctccgattgggacgtctacgccgagcaggtgcgcaaggccaagtacgacctggacgaatcccagatcaagccgtacttcgaactggacaacgtgctcaacaacggcgtgttctacgccgccacgcagctgtacggcatcacgttcaagcagcgcaccgacatcccgacctatcacgcggatatgaaggtgtatgaggtgttcgatgccgacggcacctcgatggcgttgttctacaccgactacttcaagcgcgacagcaagtccggtggcgcgtggatggacgtgttcgtcgagcaagacggcctgaccggtgccaagccggtggtctacaacgtgtgcaacttcaccaagccggccgccggccagccggcgctgctcagcttcgacgacgtcaccaccttgttccatgagttcggccatgcgctgcatggcatgttctccaaggtgaagtacccctcgattgccggcaccagcacctcgcgcgacttcgtggaattcccctcgcagttcaacgagcactgggcgtccgatccgaaggtcttcgccaactacgccaagcactaccagaccggcgcagcgatgccggccgagctggtggaaaagatcaagaaggccaagaccttcaacagcggctacgccaccaccgaatacctgtcggcggcgctgctggatctggcctggcatacccagccggccgatgcgccgctgcaggacgtgagcaagttcgaagccgatgccttgaagcgcttcaaggtggatctggccgaagtgccgccgcgctaccgcagcagttatttcgatcacatctggggcggcgggtattcggccgggtactacgcgtacttctggtcggaagtgctcgacgacgatgcgttcgaatggttcaaggaaaacggtggcctgacccgcaagaacggcgataccttccgcgccaagatcctctcgcgcggcaatactgtcgatctggccacgttgtaccgcgatttccgcggcaaggaccccagcgtcaaggcgctgctggaaaaccgcgggttgaccgagtga

SEQ ID NO: 98009 - protein, 692 aa, Xanthomonas axonopodis pv. citri str. 306
MPEKTAPAPAADAASNPLLTASTLPFQAPPFDKIQDADYLPAFEEGMRQHLADIRKIADNPEAPTFDNTIEAMERGGETLTRVSRIFFGLVQADTSDARQKIQEEIAPKLAAHQDEINLDPKLFARVKTIYDQRDTLNLDPEQKRLVERDYEELVRAGAQLSDADKDSLRKLNVEETTLSTQFHTRLVAASAAGAVVVDDKAKLDGLSEGDIAAAADAAKARKLDGKYLLTLQNTTQQPVLASLKNRELRAEVLKASETRAEKGDANDTRQTIQRLAQLRAQKAKLLGFDNYAAYSLGDQMAKTPDAALKLLTDTVPAATAKARREAAEMQKVIDAQKGGFKLAASDWDVYAEQVRKAKYDLDESQIKPYFELDNVLNNGVFYAATQLYGITFKQRTDIPTYHADMKVYEVFDADGTSMALFYTDYFKRDSKSGGAWMDVFVEQDGLTGAKPVVYNVCNFTKPAAGQPALLSFDDVTTLFHEFGHALHGMFSKVKYPSIAGTSTSRDFVEFPSQFNEHWASDPKVFANYAKHYQTGAAMPAELVEKIKKAKTFNSGYATTEYLSAALLDLAWHTQPADAPLQDVSKFEADALKRFKVDLAEVPPRYRSSYFDHIWGGGYSAGYYAYFWSEVLDDDAFEWFKENGGLTRKNGDTFRAKILSRGNTVDLATLYRDFRGKDPSVKALLENRGLTE

SEQ ID NO: 98010 - DNA, 2193 bp, Drosophila melanogaster
  CDS (1)..(2193)
atgctaaatctcctacgaaggcgcccaacgtcggtgcccctcatccgggccgcgcttagcgctccgctgcactcaacggaaaaccggccgggttacatagtgctggtaccggagatcggtgaggagggaccgctaggcgagggcgtgctcaagccggacggacttcccgccttcagtgacatcaccatcgagatgtgcttgggcgccattggtcagcaggcatcggcggtggagaactcggtgaaggcgctggagagcgacctgcacagtggcaagcagctaaatgccgccagcatctttcgggagctggacaccgtgacgggtccactggagacgacatggggtgtggccaaggctctgtacctgggcaattctaccctgatacccaccaaatcctacatgaacatccacgaacgagcgcgtaacgctcgggcagcgaagttctgcaatcaaacggtgtataaggcactcaaggatgcttcgtccgattcgggtccagatgagcagaggatgcgacagaagttcctgctcgagggcaagctgaacgggctcacgctggacaaagataagcaggatggactgaaagagctgcttacccatttgggtcgagagagagccaacttcaagaacaaggtcaacatggcagtgcactcgtttggacagattattacggacttcaatcttgtaagagatttcccgccttcgcttcttgaggcaacagcccgcgatcccggacaacctatgacgggtccttggaagataaccctacagcctcaagtggtcgatggttttctaaagcactgcccagagcgaatgcagcgttggaacgtctggagggccagtgtgctgaaggcatcctcgcagcaggaaaaatccctggagaacagcacacacatcgaaaaaatacgcggtttgcgcaagcgacaggcaaatctgttgggctatgaaagctttgcagacatgtccatgcagaccaaaatggtgggcagtgtggacaaccttaagcagatctttgccaagcttctcaagttcgccggccctgctcaaagtgtggagctggagaaactacagggcttcgctcaggacagtggctgtgaatacaagctggaagcctacgacgttgcctactggcggcgcaagcaactggcggcggagcacggtctccaagatcagaagctccgcgagtttttcccactgccccgcgttctttccggcttgtttgcgctgagtgaaaagctcttcggcatcaaaatagttgagcagcccaatgcggaggtgtggcatccggcagttaagttctacgatgtgttcgatgctgattccgtcaatagctccaccccggtgggtggcttttatgtggactgctattccaaggagcacaagttcggcagaaacaatggttggatggtgggcatacggaacagcaataagtctgccgggctgacgcctctctgtgcgctgatatttaacttttcggagccacaaagtccggatgccaagcccccgcttcttggatacgatgatctgcagatgctcttcaagacttttggaagcggactccaacacctgctcacccaagcggggtacagcgatttggcgggactctcaaacatcgagtgggatgcctctcaagtgtccggtcatgtgatgagcaacttcctcgacgatcccacagtgattcgaagcctatccggacactttagcagcggtgagcccttggaggctgagctttcacagaagatgcgattgctgaagactcagttggctggctataatctgtgccaggacctctacctggcggatctcgacgtggagctgcaccgctcgaatgccttctggctggaggtggttcgcaagctgtggccggtttatcaatgcatgccgctggacaagaaggacgcacatccgtgctccctgaccgacatttttgccggagattgggcggccgcccagttcagtcacttgtattcccgcctcatagccgccgacatttcgagcagctttgctgagcagcgaagcgaagagaactacgcggtcgttggccggcgctacaagcagaccttcctcagctgcggcggatctgtgcccacggcggaagtgttccgtcgcttccagggtcgcgacccgtcggccgaggcacttctaaagtcgctggacatatttgaaccctcccagaccacagataacaactga

SEQ ID NO: 98011 - protein, 730 aa, Drosophila melanogaster
MLNLLRRRPTSVPLIRAALSAPLHSTENRPGYIVLVPEIGEEGPLGEGVLKPDGLPAFSDITIEMCLGAIGQQASAVENSVKALESDLHSGKQLNAASIFRELDTVTGPLETTWGVAKALYLGNSTLIPTKSYMNIHERARNARAAKFCNQTVYKALKDASSDSGPDEQRMRQKFLLEGKLNGLTLDKDKQDGLKELLTHLGRERANFKNKVNMAVHSFGQIITDFNLVRDFPPSLLEATARDPGQPMTGPWKITLQPQVVDGFLKHCPERMQRWNVWRASVLKASSQQEKSLENSTHIEKIRGLRKRQANLLGYESFADMSMQTKMVGSVDNLKQIFAKLLKFAGPAQSVELEKLQGFAQDSGCEYKLEAYDVAYWRRKQLAAEHGLQDQKLREFFPLPRVLSGLFALSEKLFGIKIVEQPNAEVWHPAVKFYDVFDADSVNSSTPVGGFYVDCYSKEHKFGRNNGWMVGIRNSNKSAGLTPLCALIFNFSEPQSPDAKPPLLGYDDLQMLFKTFGSGLQHLLTQAGYSDLAGLSNIEWDASQVSGHVMSNFLDDPTVIRSLSGHFSSGEPLEAELSQKMRLLKTQLAGYNLCQDLYLADLDVELHRSNAFWLEVVRKLWPVYQCMPLDKKDAHPCSLTDIFAGDWAAAQFSHLYSRLIAADISSSFAEQRSEENYAVVGRRYKQTFLSCGGSVPTAEVFRRFQGRDPSAEALLKSLDIFEPSQTTDNN

SEQ ID NO: 98012 - DNA, 2043 bp, Yersinia pestis KIM
  CDS (1)..(2043): transl_table=11
atgacaaacccgctgttgactccgttctccctgccaccgttttctgctattcggcctgaagatatcgtgcctgcggtgaaatccgcgctggatgaatgccgtcaagcggtagagcgtgtggttgcccaatcagggccgttcacctgggataatctgtgtcagccactggccgaatccgatgaccgcttatcgcgcatttggtcacccgtaggccacttgaactcagtaaaaaatagccctgagctgcgtaccgcttatgaacaaagcttgccattgctgtcggaatacggcacttgggtggggcagcataaaggtttgtatcaggcgtatgtcagcctgaaagaggggccgggttttgccgccttgaccgcaccgcagcgcaaagcggtagaaaatgctctgcgtgacttccagctatccggtattggtctggcgcctgaacaacaaaagcgttacggcgaaatcgtggctcgcttgtcggagcttggctcgacttacagcaataacgtgcttgatgccaccatggggtggagcaaactgattaccgatgttgagcaactgaaaggtttgccagaaagcgcgctcgcagcggccaaagccatggcagaagccaaagagcaggacggctggttgctgacactggatatgccaagctatctgccggtactgacttatgccgataacgtggaattgcgcgaagagatgtaccgtgcatttgccacccgtgcttctgatcaggggccaaacgcggggaaatgggataacagcgagatcatggcggaaattctgacactgcgtcatgaattagcgcagttgctcggttttaacagttatgccgataaatcgctggccaccaaaatggcagaaaacccacagcaggtattgggcttcctgaacgatctggcgaagcgcgcccgcccgcaagcagaagaagagctggctcagttacgtgcttttgctaaagagcattatggtgtcagtgaactccaggcttgggatatcacctattattccgagaaacagaaacagcatctgtttgctatcagtgatgaacaacttcgtccttatttcccggaacagcgggtggtggaaggtttattcgaagtggtgaaacgcatttatggcattacagccaaagagcgccatgatgtcgatacctggcatccggatgtccgcttcttcgatttgtttgatgccgatggtgaactgcgcggtagcttctaccttgatttgtatgcgcgcgaaaacaagcgtggcggagcctggatggatgactgcgtaggtagcctgcgtttggctaatggccaactgcaaaaaccagtcgcttatctgacttgcaattttaacgggcccgttggcggcaaaccggcgctgtttactcacaatgaagtgaccaccttgttccatgagttcggccatggtttacatcatatgctgaccaaaattgataccgcaggcgtttctggtatcaatggcgtgccttgggatgcagtcgagctgccaagtcagtttatggaaaactggtgctgggagccggaggcgctggcctttatttctggtcattaccaaactcatgagcctttgccgcaagagatgctggataaactactggcggcgaaaaactatcaggcggcgttgtttattctgcgccaactggagtttggtctgttcgatttccggatgcattatgagttcgacccgctgaccggtgcgcagatcctgcctattttgtatgaagtgaaaaaacaggttgctgtggtgccatcaccggaatggggccgcttccctcatgccttcagccatatttttgctggcggttatgcggccggttattacagctatttatgggctgaagtgctctcggcggatgcgttctcacgctttgaagaagaagggatttttaatgccgctaccggtcagtccttcctcgacaacattctgtctcaaggtggctcagaggagccaatgacactgttcaaacgcttccgtggccgtgaaccgcagttagatgccatgttgcgtcattacggtattaagggctaa

SEQ ID NO: 98013 - protein, 680 aa, Yersinia pestis KIM
MTNPLLTPFSLPPFSAIRPEDIVPAVKSALDECRQAVERVVAQSGPFTWDNLCQPLAESDDRLSRIWSPVGHLNSVKNSPELRTAYEQSLPLLSEYGTWVGQHKGLYQAYVSLKEGPGFAALTAPQRKAVENALRDFQLSGIGLAPEQQKRYGEIVARLSELGSTYSNNVLDATMGWSKLITDVEQLKGLPESALAAAKAMAEAKEQDGWLLTLDMPSYLPVLTYADNVELREEMYRAFATRASDQGPNAGKWDNSEIMAEILTLRHELAQLLGFNSYADKSLATKMAENPQQVLGFLNDLAKRARPQAEEELAQLRAFAKEHYGVSELQAWDITYYSEKQKQHLFAISDEQLRPYFPEQRVVEGLFEVVKRIYGITAKERHDVDTWHPDVRFFDLFDADGELRGSFYLDLYARENKRGGAWMDDCVGSLRLANGQLQKPVAYLTCNFNGPVGGKPALFTHNEVTTLFHEFGHGLHHMLTKIDTAGVSGINGVPWDAVELPSQFMENWCWEPEALAFISGHYQTHEPLPQEMLDKLLAAKNYQAALFILRQLEFGLFDFRMHYEFDPLTGAQILPILYEVKKQVAVVPSPEWGRFPHAFSHIFAGGYAAGYYSYLWAEVLSADAFSRFEEEGIFNAATGQSFLDNILSQGGSEEPMTLFKRFRGREPQLDAMLRHYGIKG

SEQ ID NO: 98014 - DNA, 2109 bp, Thermosynechococcus elongatus BP-1
  CDS (1)..(2109): transl_table=11
atggttgttgcgacttcccctcacaccgataatcccctattgcggggcgatggttttcccccctttgatcagattcaggtgagccatgttgagccagcggtgcgccaactgttgcaggaactcacccaagaattagaagcccttgagcaatcctttacccccacatgggaagggttagtggagcccctagaacgcctcagcgatcgcttggattggacctggggtattgtgagccatcttacaggggtcaaaaacagtcctgagctccgtcaagcctacgaagcggttcaaccccaagtggtggagttctacacccgtctggggcaatcgcgccccctctatgaaggctttaaggcactggcggccagtccagaatttcacagctatcccccggcgcgcaaacgcattgttgaagcagccattcgcaatgctgaacacagtggggttggcctcacgggtgccgccaaggagcgcttcaatgccattcaactggaattggcggagctttccacccaattctccaacaaccttttagatgccaccaaggcctttcgcctcaagctcacccaacctgatgaagtggctggactgccccccagcctactggcgctggctgcccaaaccgctcgccaagatggcattgagaccgcaactccagaaacagggccatggcacatcaccctcgacttccccagctttggcccctttatgcagcacagccagcggcgggacctacgggaacagctctatcgtgcctacatctcccgtgccagcaggggtgagtgggataatcagccaattcttgagcgcatccttgccctgcgggttgaagaggcccagcttttaggattcaacacctatgctgaactcagccttgccagcaaaatggcggacagtgtcgccagtgtggaaaaactccttgaggaactgcgtcaagtcagctatagtgctgcggcgcgggaactggaagaactcaaagcctttgctgctgcccaaggggcacccgaagccaatgatctgcagcactgggatattccctattgggcagaacgtcaacgggaagccctctttgacttcaaggatgaggaactacgcccctactttcctttacctcaagtgcttgagggtctatttggcttagtgaagcggctctttggggtgacggttgtgccagccgatggccaagtccccgtttggcatcccgatgtgcgcttttttgcgattctagacgaaaacaacgtaacgatcgcccacttttaccttgatccctatagccgtcctggcgagaaacgcggcggcgcctggatggatgactgccttggtcgcgctaaatatcgccttcagggggaatggcgtacccgtttacccgttgcctacttaatctgcaatcaaacgccccctgtggatggcaagcccagcctgatgacctttagtgaagtggaaaccctcttccacgaatttggacatggtttgcaccacctgctgacacgggtggacgaagcgggtgccgccggcattaacaatgtggagtgggatgccgtcgaactccccagtcaatttatggagaattggtgctaccatcgcccaaccctttttggcatggcacgccactatgaaaccggggaacccctgccagaacactactacgaaaaactggttgccgcccgtacctaccgcgccggcagtgccctattaagacagttgcactttagtttgttggatttggagctgcaccatcgctatcgaccaggggagggggaaaccccgcaacaggtgcgcgatcgcgttgcccagacaacaactattttgcctcccctgccagaggatgcgtttctctgtagctttagccacatttttgctggggggtatgctgcgggttactacagctatctttgggcagaagttctcagtgctgacgcttttgctgcctttgaggacgtcggcctagacaatgagcaagcgatcgctgaaatgggacgacgctaccgcgaaaccgtgcttgcccttggcggcagccaagcccctatggaaattttcaaagccttccgaggccgcgaaccaagcaccgaggccctactccgccaccgcggtttagtatcaaaaaattaa

SEQ ID NO: 98015 - protein, 702 aa, Thermosynechococcus elongatus BP-1
MVVATSPHTDNPLLRGDGFPPFDQIQVSHVEPAVRQLLQELTQELEALEQSFTPTWEGLVEPLERLSDRLDWTWGIVSHLTGVKNSPELRQAYEAVQPQVVEFYTRLGQSRPLYEGFKALAASPEFHSYPPARKRIVEAAIRNAEHSGVGLTGAAKERFNAIQLELAELSTQFSNNLLDATKAFRLKLTQPDEVAGLPPSLLALAAQTARQDGIETATPETGPWHITLDFPSFGPFMQHSQRRDLREQLYRAYISRASRGEWDNQPILERILALRVEEAQLLGFNTYAELSLASKMADSVASVEKLLEELRQVSYSAAARELEELKAFAAAQGAPEANDLQHWDIPYWAERQREALFDFKDEELRPYFPLPQVLEGLFGLVKRLFGVTVVPADGQVPVWHPDVRFFAILDENNVTIAHFYLDPYSRPGEKRGGAWMDDCLGRAKYRLQGEWRTRLPVAYLICNQTPPVDGKPSLMTFSEVETLFHEFGHGLHHLLTRVDEAGAAGINNVEWDAVELPSQFMENWCYHRPTLFGMARHYETGEPLPEHYYEKLVAARTYRAGSALLRQLHFSLLDLELHHRYRPGEGETPQQVRDRVAQTTTILPPLPEDAFLCSFSHIFAGGYAAGYYSYLWAEVLSADAFAAFEDVGLDNEQAIAEMGRRYRETVLALGGSQAPMEIFKAFRGREPSTEALLRHRGLVSKN

SEQ ID NO: 98016 - DNA, 1956 bp, Leptospira interrogans serovar Lai str. 56601
  CDS (1)..(1956): transl_table=11
atgtttcctgaatttgaagcagataaagtaatactcactaagaacgaaattttagaaaaaatcaaaaagatccgaaatgaaattccggttttactttctcaaaaagaaaggtcttacgagaacgttatttgtcctttagacgatctcgtgcaagaaatgcaggtagagtttaccgttcttgcccatctaaatagcgtaaaaaattctaaggagatccaaacgtattatacggaagtgcttccagaaattaccgctttttattctgacttaggacaaaacgaagaattaaactctgtatatcaggaaattctaaagaatgaagagaataccttgagtattccccgaaataaaagtcttcaagattctattctacaatttcggttgagtggtattggtttaaaaccagagattaaaaaaaggatccaggaaattcaaattcgactttccgatttaaataatcaatattctcaaaatcttctggatgctacaaacacatttgaattgattttggatcgcccagaagacgtagaaggtattccagaatccgatctaaacgctgctaaaacagaagacggtaaatattgttttacacttcagatgcctagttataccgcttatatgactcatggtccaaatcggaatattcgagaatcattatataaggcttatactacacgtgctcctcaaaatggaaaactgatccaagaaatactttctttgagaagtgaacttgcaagacttttagactatttcagttacgcggaactttctttggccactaaagtagccaattccgttcctacggttttaaaatttttaagagacctcgccaaacaagttaaaccgattgcagaaaaagaatttaaagatctttctgattttgcaaaaactttgggaattgattctatccaggcttatgatactgcgtttgtaagtgaaaagatgatgaagtcccaattcaattttgatgaagaggaaactcgtccatattttgaaaaggacagtgtcatttccggaacattccaatttttgaatatgctttttggaattgaatttcgcaaaacttccgctaaagtctgggaagaaaaggttcaagtttatgatctttataaggaaggaaaacttctctctcgtttatatttggacttggaaactcgtaaggacaaacagggcggagcttggatgcacaactggcattccagaaatagaatgaatggacgcgaagttcttccaactgcgtttgtggtttgtaattttcctgtttctacaaaagattctccatctcttttaaaacatagggacgtggtaactttctttcacgaaatgggacacgctttacatcatctttgtacaaaaatagaagagccccccgtaagtggtattaatggagtagagtgggacgcagtagaatttccgtcacagtttttggaaaattttgcgaccgaagcggacgttctaaagatattcggaaaacattataaaaccggagaaacgattccggattctatgatcgtaaaactcaaggagactaaaaactttctttccgcaatgggaatcgtaagacaacttgagttctcactttttgatattttcattcatttaaaaagtcatacagaagaagaggtacattctattcttcaagacgttcgtaaagaagtagcggttgtgattcctccggaatataatcgtttccaaaacggattctctcatattttttcgggaggttatgccgcgggatattatagttataagtgggcggaagtcatgagtgccgacgcatttttcgcttttgtggaaagagggatttttgattctgaactgagtgaagtatactttagagagattttagaaaaaggcggaagtgaaaacgcgatgatactttttaaaagatttttaggaagagaaccagaggtaaaatctctattgaaactatacgggcttaaggaagcggcttaa

SEQ ID NO: 98017 - protein, 651 aa, Leptospira interrogans serovar Lai str. 56601
MFPEFEADKVILTKNEILEKIKKIRNEIPVLLSQKERSYENVICPLDDLVQEMQVEFTVLAHLNSVKNSKEIQTYYTEVLPEITAFYSDLGQNEELNSVYQEILKNEENTLSIPRNKSLQDSILQFRLSGIGLKPEIKKRIQEIQIRLSDLNNQYSQNLLDATNTFELILDRPEDVEGIPESDLNAAKTEDGKYCFTLQMPSYTAYMTHGPNRNIRESLYKAYTTRAPQNGKLIQEILSLRSELARLLDYFSYAELSLATKVANSVPTVLKFLRDLAKQVKPIAEKEFKDLSDFAKTLGIDSIQAYDTAFVSEKMMKSQFNFDEEETRPYFEKDSVISGTFQFLNMLFGIEFRKTSAKVWEEKVQVYDLYKEGKLLSRLYLDLETRKDKQGGAWMHNWHSRNRMNGREVLPTAFVVCNFPVSTKDSPSLLKHRDVVTFFHEMGHALHHLCTKIEEPPVSGINGVEWDAVEFPSQFLENFATEADVLKIFGKHYKTGETIPDSMIVKLKETKNFLSAMGIVRQLEFSLFDIFIHLKSHTEEEVHSILQDVRKEVAVVIPPEYNRFQNGFSHIFSGGYAAGYYSYKWAEVMSADAFFAFVERGIFDSELSEVYFREILEKGGSENAMILFKRFLGREPEVKSLLKLYGLKEAA

SEQ ID NO: 98018 - DNA, 2151 bp, Shewanella oneidensis MR-1
  CDS (1)..(2151): transl_table=11
atgcgtaaaagttttattgcaatcgccattggcgccacactgatgaccggagcaatgacaggctgcagttctcaagataccaaagccacaaatgtcaccgcagtgcaaacacaaaaccccttgttccaagccagcacgctgcaatatcaagcacctgatttcaatgccattaaagatgagcattttcagcctgcacttgaacaaggcattaaagagcaataccaagaaatattgaccattgcgaataatccagctgcgcctaccttcgataacactattgtcgccatggaaaaaagtggagccctactcaatcgcgcatcaagtgtgttctacaatctagcaggttcaaacagcaatccaaccctgcgcaaaatccagggtgaaatggcccccaaaatggcagcccactcggacaatatcaacctcaacccagcgctgtttgcccgtattgaaacgatttataacaatcgcaataacttaggcttaacccctgaagcagtgcgtttggtcgagatgtaccatcaacgcttcatcatggcaggcgcaaaactgaccgatgagcaaaaagtaaagatccgtgccttaaacgaagagcaatctacacttaccaatgaattctcccaacgcttactgcgcttaaccaaagacatcgccattgttgtcgataacaaagagcaactcgctggcctctctgacagtgaaatcacctcagcagcaaacgatgccaaagccgcaggccacgatggtaaatacttaatcaacatcactaacaccactcgccaaccagttctggcctcattagagaaccgtgaattgcgccaacgcatttgggaagcctcggcaaaccgtgggttaaagggtgaaaacgaaaccgcatccttagtgtctcgcttagcccaattacgtgccgaacgtgcagcactgcttggttatgaaaactgggccagctatcgccttgcaccgcaaatggctaaaacccctgaagcggtttacagcatgttcggctcaatggtgccagccgttgttgccaatactgagaaagaagccgccgatattcaagcgatgatcaacaagaccggtggcaagtttgaactcgcaccatgggactgggaattctacgccgagaaagttcgccaagaaaaatacgccctcgatgccaatagcatccgcccctacttcgaatttaaccgcgtacttgaagatggtgtgttttatacccttaaagagctgtatggcgttaccttaaagccacgcccagatttgcctgtataccacccagatgtgaaagcctacgaaatgtttgatgccgatggctcaagcatggcgattttctatgctgactactttgcccgtgaaggcaaacgcggtggcgcatggatgagttcgtttgtgggtcaatccttcctcgaaggcacaaagcctgtcgtggttaacgtgatgaacattaaaaaagcgccagaaggtcaaccgaccttcgttagctacaatgaagtcaccactatgttccacgaaatgggtcacggcactcacggtatgttttccaaagtgacttatccaagtctttcagggacttcagtatcccgtgactttgtggaattcccatcgactttcgaagaagattgggcagctcaccctaaagtgttagcaaattacgctaaacactacgaaacgggcaaacctatccctgatgagttactgcaaaaacttttaaaatcaggtagtttcaaccaaggcttcgatacgttagagtatatggctgccgccctcgttgatatggaatggcactcattaagccctgatgcgccactgcaagatgtagcaacatttgaagccaatgcgctgaaaaaacacggcttaaatatcaccgctgtaccaccacgttataagtcgacttactttgcccacgctttccccggtggctactcagcaagttactacgcatatatgtggagtgagattttagcggccgatgcctttgcctatgtgcaaactcaaggtggcttaaaccgtgacatcggcatgaaataccgcaagaccattcgcgaagtgggcaacagtattgcgccaatggaagcttacaaaaacttccgcggacaagaacccaccaccgagggtttactcaaccgccgcggactcaatcagaccaaataa

SEQ ID NO: 98019 - protein, 716 aa, Shewanella oneidensis MR-1
MRKSFIAIAIGATLMTGAMTGCSSQDTKATNVTAVQTQNPLFQASTLQYQAPDFNAIKDEHFQPALEQGIKEQYQEILTIANNPAAPTFDNTIVAMEKSGALLNRASSVFYNLAGSNSNPTLRKIQGEMAPKMAAHSDNINLNPALFARIETIYNNRNNLGLTPEAVRLVEMYHQRFIMAGAKLTDEQKVKIRALNEEQSTLTNEFSQRLLRLTKDIAIVVDNKEQLAGLSDSEITSAANDAKAAGHDGKYLINITNTTRQPVLASLENRELRQRIWEASANRGLKGENETASLVSRLAQLRAERAALLGYENWASYRLAPQMAKTPEAVYSMFGSMVPAVVANTEKEAADIQAMINKTGGKFELAPWDWEFYAEKVRQEKYALDANSIRPYFEFNRVLEDGVFYTLKELYGVTLKPRPDLPVYHPDVKAYEMFDADGSSMAIFYADYFAREGKRGGAWMSSFVGQSFLEGTKPVVVNVMNIKKAPEGQPTFVSYNEVTTMFHEMGHGTHGMFSKVTYPSLSGTSVSRDFVEFPSTFEEDWAAHPKVLANYAKHYETGKPIPDELLQKLLKSGSFNQGFDTLEYMAAALVDMEWHSLSPDAPLQDVATFEANALKKHGLNITAVPPRYKSTYFAHAFPGGYSASYYAYMWSEILAADAFAYVQTQGGLNRDIGMKYRKTIREVGNSIAPMEAYKNFRGQEPTTEGLLNRRGLNQTK

SEQ ID NO: 98020 - DNA, 2151 bp, Shewanella oneidensis MR-1
  CDS (1)..(2151): transl_table=11
atgcgtaagtctgttattactaccgctgttgccgcggcgttgtttttgggtgcctgttctgaaaattctgctgtcaatactgaagcgaccaatgctgtcgcaacccaagttgctccaaccacagctcaagccagcgcgagcaatgtattgttgagcaagagtccactgcaggatcaagcccctcaatttaatttgattaagagctcggattatgcacccgcctttgcgcaggggataaaagagcatgaggctcaaatcgcagcgattattgccaataagcagttgcctagctttgagaatactattctcgcaatggaaacctcaggtgagttgttgacccgagtttcccgcaccttcttcaatcttgctggtttgatgtcggatgacaacattcaaaaaacagaagccgatttagcgcctaaattatcggctcatcgcgataatatttacctcgatccaagcttatttgcccgtgttgaggcggtatatcaacaacgaaccaatttaaatgctgaggataagcacttagttgagttctattacgatcaatttgtacgtgctggcgccaaattatccgatgtcgataaagccaaaatgcgtgactataatgccgagctcgctacgcttgcgactgagttttcgcaaaatagtttaaagtcatttaaagatgatgtgattgttgtgactgacaaggcactgttagacggattatctgacagcgaaatcgccactttagccgctgcggcgcaagcggcgggcaaaaccggttatttgatcagtttagtgaacacaactcgtcagccgattcttacaagtttaaacaaccgtgaacttcgccaaaaagtttggcaaacctcagcccacagagctattgccaacaatggcccattgattgtaaaaatggcgcaaattcgtgctaagaaagccaatttactcggctttgacacgtgggcttcctatgcagtggccgatcaaatggccaaaacgccttctgccgtttacgagatcttagatgatctcgcgcctaaagccctggctcgtgctaaagtggaagcggctgatattcaagctgaaatcaaaaaagcgggcggtgattttgagttacaaccatgggattggtctttttacgcagataaagttcgtaaggaaaagtatgctcttgatgaaaacagcattaaaccttactttgaatttaactcagtattgaaagatggtctgttcttcgcgatgcataaactctacggcattagcgtcaaaccccgaactgatttacctgtttggcacagtgatgtgctggcctttgaggttttcgataaagacaacagttctatcggcttattctatctcgacccttatgcccgtgaaggcaagggcggcggtgcttggatggatgagtttgtcactcaaagtggcttactgggcactaagcctgtggtgtataacgcgcttaatattccaaaacctgcagaggggccaaccctgatgaccttcgatgaagtgacaaccctgttccatgagtttggtcatgcggtgcacggtttattctctaaggtgaaatacccgagcgtggcaggcacttctacagcacgtgactttgtggagtttccatcccaagtcaacgaagactggaatattgatcctgccgttattgccaattacgccaagcattatcaaaccggtgagccaattcctaaagccttgctcgataagattttagctgcgaataaatttggtcagggttttgataccgttgagtatttagcggctgcattactcgatatggaatggcattcaatcggtgcggatacgaaaattaccgatgtggagcagtttgagcatcaagctttggcaaaacatggccttgattttgcgccgatcccaccgcgttataagtcgagttattttagccatgctttctcaggtggttactctgccggatattatgcttatctgtggactgaggtgtttgctgccgatgcttttgcttatatggggcagcatggaggcctaaccctcgagaatggcaataaattccgtggggccgtattgtctaagggcaacagtgaagatttgatgcagaattacatcaacctaactggtcaaaaaccgacgaccaacgcgctcttaaaacgtcgtggtttagtcgaataa

SEQ ID NO: 98021 - protein, 716 aa, Shewanella oneidensis MR-1
MRKSVITTAVAAALFLGACSENSAVNTEATNAVATQVAPTTAQASASNVLLSKSPLQDQAPQFNLIKSSDYAPAFAQGIKEHEAQIAAIIANKQLPSFENTILAMETSGELLTRVSRTFFNLAGLMSDDNIQKTEADLAPKLSAHRDNIYLDPSLFARVEAVYQQRTNLNAEDKHLVEFYYDQFVRAGAKLSDVDKAKMRDYNAELATLATEFSQNSLKSFKDDVIVVTDKALLDGLSDSEIATLAAAAQAAGKTGYLISLVNTTRQPILTSLNNRELRQKVWQTSAHRAIANNGPLIVKMAQIRAKKANLLGFDTWASYAVADQMAKTPSAVYEILDDLAPKALARAKVEAADIQAEIKKAGGDFELQPWDWSFYADKVRKEKYALDENSIKPYFEFNSVLKDGLFFAMHKLYGISVKPRTDLPVWHSDVLAFEVFDKDNSSIGLFYLDPYAREGKGGGAWMDEFVTQSGLLGTKPVVYNALNIPKPAEGPTLMTFDEVTTLFHEFGHAVHGLFSKVKYPSVAGTSTARDFVEFPSQVNEDWNIDPAVIANYAKHYQTGEPIPKALLDKILAANKFGQGFDTVEYLAAALLDMEWHSIGADTKITDVEQFEHQALAKHGLDFAPIPPRYKSSYFSHAFSGGYSAGYYAYLWTEVFAADAFAYMGQHGGLTLENGNKFRGAVLSKGNSEDLMQNYINLTGQKPTTNALLKRRGLVE

SEQ ID NO: 98022 - DNA, 2040 bp, Shewanella oneidensis MR-1
  CDS (1)..(2040): transl_table=11
atgagcaaccctttgcttaacggcgcaagcttaccgcttttttcacagattaaacctgaacatattcaagttgccgttgagcatgctattgctcagtgccgcgccaaaatcgatgaggtgctgcaaaatccagggccctatacttgggaaaacctgattgctccacttgagcaagtggacgatgaactaagccaaatttggtcgcccgtttcccacatgaactctgtcactagcacagatgaatggcgcgcggcccacgatgcttgtttacctcttttatccgaatatggcacttacgttggtcaacaccaagggctatatgaggcatataaatctctgcgtgcatccgaggtatttgagcaattaagccaagcgcagcaaatggtgattgagcacagtttgcgtgacttcgagctctcgggtatcggcttagatgacgcgcaaaaactgcgttatggtgaaatcgttaagcgtctttctgaacttaccagcggcttttcaaatcaattgcttgatgcgacccaagcctggactaagttaattaccgatgaggctgaactcgctggcttgccagattctgccaaggcggcagcgaaagcaatggccgaggcccgtgaactcgaaggctggttgtttaccttagatttcccttcctatttacctgtgatgacctacagtgaaaaccgtgagttaagggaagagtgctatcgcgccttcgtgactcgcgcatcggatcaaggcccgaatgcaggcgaatttgataacggtcctttgatggatgaaatcctcgcgctgcgccatgaactggcacaattattaggttttgatagctttgccgaaaaatccctcgcgactaaaatggccgaaacgcctgcgcaggtgatggcattcttaaatgaattggcgctgcgttctaaagatcaagctaaggccgaactggccgagctaaaagcctttgcgcaggaacaatatggcgtgagtgaaatggcttcctgggacttaagtttttatgccgagaagttacagcaacataagtatgagatttctcaagagttgctgcgcccttacttccctgaagataaagtgctatcaggcttgttttacactgtctcacgcctctttggtttgaagattattgagcaaaccgagtttgaccgttggcataaggatgtacgtttcttcgatatttttgacgaaacgggcgagcacagaggcagcttctatttagatttatacgcccgcactggtaaacgcggcggcgcttggatggatgattgccgcgtgcgtcgtcaaaccgccaatggcctacaaaaacccgttgcctatctcacctgtaacttcaatggtccagttgatggcaagcctgcgcttttcactcacgatgaagtgacgactttattccatgagtttggccatggcattcaccatatgctgaccaaaatcgatgttgctggcgtatctggtatcaacggtgtgccttgggatgcagtcgagttacctagccaatttatggaaaactggtgctggcaggaagaagccttagcggagatctccggtcattatgaaacgggtgagcctttacctaaagcgatgttagataagatgttagcggcgaaaaacttccaatccggcatgatgatgttgcgtcagctcgagttttcactgttcgattttagactgcatcacgaatacgaccctgctaaaggtgcgtgtattcaagagaccttagacgaagtgcgtcgtcaggtggcggtattaatccctccggcatttaaccgtttccaacacggttttgcgcatatttttgctggtggttatgccgcgggttattacagctacaaatgggctgaagtgctgtcggcggatgcgttttcccgcttcgaagaagaaggcatcttcaatcctgaaacgggtcgccgtttcctgcacaatatcctcgaaatgggcggttcggcggagccgatggatttatttaagcagtttatggggcgcgagccgagtatcgatgcactgctaagacattctgggatcgccgcataa

SEQ ID NO: 98023 - protein, 679 aa, Shewanella oneidensis MR-1
MSNPLLNGASLPLFSQIKPEHIQVAVEHAIAQCRAKIDEVLQNPGPYTWENLIAPLEQVDDELSQIWSPVSHMNSVTSTDEWRAAHDACLPLLSEYGTYVGQHQGLYEAYKSLRASEVFEQLSQAQQMVIEHSLRDFELSGIGLDDAQKLRYGEIVKRLSELTSGFSNQLLDATQAWTKLITDEAELAGLPDSAKAAAKAMAEARELEGWLFTLDFPSYLPVMTYSENRELREECYRAFVTRASDQGPNAGEFDNGPLMDEILALRHELAQLLGFDSFAEKSLATKMAETPAQVMAFLNELALRSKDQAKAELAELKAFAQEQYGVSEMASWDLSFYAEKLQQHKYEISQELLRPYFPEDKVLSGLFYTVSRLFGLKIIEQTEFDRWHKDVRFFDIFDETGEHRGSFYLDLYARTGKRGGAWMDDCRVRRQTANGLQKPVAYLTCNFNGPVDGKPALFTHDEVTTLFHEFGHGIHHMLTKIDVAGVSGINGVPWDAVELPSQFMENWCWQEEALAEISGHYETGEPLPKAMLDKMLAAKNFQSGMMMLRQLEFSLFDFRLHHEYDPAKGACIQETLDEVRRQVAVLIPPAFNRFQHGFAHIFAGGYAAGYYSYKWAEVLSADAFSRFEEEGIFNPETGRRFLHNILEMGGSAEPMDLFKQFMGREPSIDALLRHSGIAA

SEQ ID NO: 98024 - DNA, 2037 bp, Corynebacterium efficiens YS-314
  CDS (1)..(2037): transl_table=11
atgagtgttgatgccctgctgaccgcaagtaccctgccctaccagctgcctgatttcgccgcgatcgagaccgctgatttcctccccgccttcgagatcgccctcgctgagcacctggcggagatcgagggtattaccgccaacccggagcctgtgacctgggagaacaccgtggaggccctcgagcgtgcaggccagccgctcaaccgtgtggccgcggtgtttttcaacctgcagggcaccgattcctccgatgagatggacgcgatcgcccaggagatcgccccgaagctggcggcgcactatgacgcgatctaccacaacaccacgctgttccagcgactggagtcgctgaccgccccggccgatgaggagtccgagcgcctgctggcccacaccctgcgtgcttttcgacgccgcggtgccgccctcgacgcccccggcaaggcccgcctgtcggagatcaaccaacgcctttccgccctgtcggaacagttcggccgaaatctgctcaaggacacccgggatctcgcggtttccttcgaggacaccgagctcgcgggattcagtcccgcgcgggtggaggcggccgcagcctatgccgagagcctgggccgtgaggggtatgtggttcccctggagctgcccaccgtgcaggccgagcaggcggtgctgacctcccctgacgcccgcgcgaaactgtatgaggcctcccagaagcgagggcaggaatcaaacactgaggtgctcctggaaaccgtccgcctgcgtgccgagcgtgcccagctgctgggttatcccacgcatgccgattatgtcatcgaggaggagaccgccgatgatgtcgacgccgtgcgcggactcctctacgatctggcacccagcgccgcctccaatgcacgggcggagtacaaactgtcagccgaggaggcggaggccgcgggggagaaggtcgatgccgcggactggccgttctgggaggcgaaggtgcgcgaacgcgattacgccctcgatgatgccgagctgcgcaagtatttccccctgtcccgtgtgctggaagatggcgtcttctactccgccaaccgcctctacggcatcaccgtgaccaagcgccccgacctgcaggggtacgccgagggcgtggatgtgtgggaggtgaaggaccacgacgggtccggcatcggcctgctgctcaccgactatttcggccgcccctccaagcgcggtggggcctggatgagcagcttcgtcgaccagtcgcacctgctgggcacgaaaccggtggtggtcaacgtcatgggcatcaccaaaccgacctccggcgaggcgttgctgtccctggatgaggtgaccaccctgttccacgagttcggtcacgggctccacggtctgctctccgatgtgcgctacccgagtttctccggcacctcggtgcccagggactatgtggagttcccctcccagatcaacgagaactgggccttcgacccggcggtggtgcgcaactacgcccgccaccatgaaacaggtgaggtcatccccgatgagatgctcgccgccattgaggcctcccgccagttcgggcaggggttcgccacctccgagtacctggccgcctccatcatcgatctggcctggcactccctgaccccggaggaggccgccgcggtcaccgacatcgaacagttcgaacaggatgccctgcagcacgccggcctggacgtggaccatgtcgccccgcgctaccgttcgacctacttcaaccacatcttcgccggtgggtactccgccggctactactcctacctgtgggctgaggccctggatgccgatggtttcgactggttcaccgaaaccggtgccgccggggaggaggcatcgcaggacaccgcccgcgaggccggtcagaagttccgggacctggtgctctcccgcggtgcggccgccgattactcccgttccttcgagaccctgcgcggccgggcaaaggacatccagccgctgctgcgtcgccgtggcctggcaggtgcgatctag

SEQ ID NO: 98025 - protein, 678 aa, Corynebacterium efficiens YS-314
MSVDALLTASTLPYQLPDFAAIETADFLPAFEIALAEHLAEIEGITANPEPVTWENTVEALERAGQPLNRVAAVFFNLQGTDSSDEMDAIAQEIAPKLAAHYDAIYHNTTLFQRLESLTAPADEESERLLAHTLRAFRRRGAALDAPGKARLSEINQRLSALSEQFGRNLLKDTRDLAVSFEDTELAGFSPARVEAAAAYAESLGREGYVVPLELPTVQAEQAVLTSPDARAKLYEASQKRGQESNTEVLLETVRLRAERAQLLGYPTHADYVIEEETADDVDAVRGLLYDLAPSAASNARAEYKLSAEEAEAAGEKVDAADWPFWEAKVRERDYALDDAELRKYFPLSRVLEDGVFYSANRLYGITVTKRPDLQGYAEGVDVWEVKDHDGSGIGLLLTDYFGRPSKRGGAWMSSFVDQSHLLGTKPVVVNVMGITKPTSGEALLSLDEVTTLFHEFGHGLHGLLSDVRYPSFSGTSVPRDYVEFPSQINENWAFDPAVVRNYARHHETGEVIPDEMLAAIEASRQFGQGFATSEYLAASIIDLAWHSLTPEEAAAVTDIEQFEQDALQHAGLDVDHVAPRYRSTYFNHIFAGGYSAGYYSYLWAEALDADGFDWFTETGAAGEEASQDTAREAGQKFRDLVLSRGAAADYSRSFETLRGRAKDIQPLLRRRGLAGAI

SEQ ID NO: 98026 - DNA, 1938 bp, Rattus norvegicus
  CDS (1)..(1938)
atgaaaccccccgcagcctgtgctggggacgtggtggatacagtgtcaccatgctccaccgtgaatcatctgcgctgggacctgagcgcacagcagatcagagctctaaccacacagctcatcgagcagaccaagtgtgtgtacgaccgtgtgggcgcccaggacttcgaggacgtgtcctatgagagcacactgaaggcactggctgacgtggaggtcacctacacagtgcagaggaacattctcgacttcccccagcacgtgtctccgaacaaggacatccgcgcagccagcacagaggctgacaagaagctctcagagtttgatgtggagatgagcatgaggcaggacgtgtaccagagggtcgtgtggctgcaggagaaaatcccgaaagactcactgaagcctgaggcagctcgctacctggagcggctcatcaagctgggccggagaaacgggctccacttacctcaggacacacaggagaagatcaagaacatcaagaagaggctgagcctgctgtgcatcgacttcaacaagaacctgaatgaggacaccaccttcctgcccttcacgagagaggagctgggcgggctccccgaggacttcctgaactccctggagaagacagaggacggcaaactgaaggtcaccctcaagtatccacactatttcccactgctgaagaagtgccacgtgcccgagacacgacgcctgttggaggaggccttcaactgtcgctgcaaggaggagaactgtgccatcctgaaggagctagtgtccctgcgggcgcagaagtccaacctgctgggattccgcacacacgcagactacgtcctggagatgaacatggccaagaccagtcagacagtagccaccttcctagatgaactggcccggaagctgaagccgctgggtgagcaggagcgtgcggtgatcctggagctgaaggaggcagagtgccaagcgcgggctgccattcgatgggcgcatccacgcatgggacatgcggtactacatgaaccaggtggaggaggaacacgctaccgcgtagaccagaacctgctgaaggagtacttccccatgcaggtggtcacgcgtgggctgctggccatctaccaagagctgctggggctgaccttcacgctggaggaaggtgctgccgcctggcacgaagacgtgcggctgtactctgtgcgtgacgccgcctctggagaggagattggcaagttctacctcgacctgtaccccagggaagggaagtatggccacgcggcctgcttcggcctgcagcctggctgcctacggcaggatggcagccgacagctggccatcgcggccatggtggccaatttcaccaagcccacacctgacgtgccttccctgctgcagcacgatgaggtggagacctacttccacgagttcgggcacgtcatgcaccagctctgctcacaggcagagtttgctatgttcagtgggacccacgtggagcgggactttgtggaggcaccgtcacagatgctggagaactgggtgtgggaaaaggagccactgatgcgcatgtcccagcattaccgcacaggaggcgaggcccctgaggacctcctggagaagctcatcaagtctcgccaggccaatgcaggtctcttcaaccttcggcagattgtccttgccaaggtagatcaggtcctgcacacacagacagatgtagacccagctgaggaatatgcccgctctgccaggagatccttggggtgccagccacaccaggtaccaacatgccagccacttttggccacctcgctggtggctacgacgctcagtactatggctacttgtggagtgaggtgtactccatggacatgttccacacacgcttcaagcaggagggtgtgcttagccccaaggttggcatggattaccggaccagcatcctga

SEQ ID NO: 98027 - protein, 645 aa, Rattus norvegicus
MKPPAACAGDVVDTVSPCSTVNHLRWDLSAQQIRALTTQLIEQTKCVYDRVGAQDFEDVSYESTLKALADVEVTYTVQRNILDFPQHVSPNKDIRAASTEADKKLSEFDVEMSMRQDVYQRVVWLQEKIPKDSLKPEAARYLERLIKLGRRNGLHLPQDTQEKIKNIKKRLSLLCIDFNKNLNEDTTFLPFTREELGGLPEDFLNSLEKTEDGKLKVTLKYPHYFPLLKKCHVPETRRLLEEAFNCRCKEENCAILKELVSLRAQKSNLLGFRTHADYVLEMNMAKTSQTVATFLDELARKLKPLGEQERAVILELKEAECQARAAIRWAHPRMGHAVLHEPGGGGTRYRVDQNLLKEYFPMQVVTRGLLAIYQELLGLTFTLEEGAAAWHEDVRLYSVRDAASGEEIGKFYLDLYPREGKYGHAACFGLQPGCLRQDGSRQLAIAAMVANFTKPTPDVPSLLQHDEVETYFHEFGHVMHQLCSQAEFAMFSGTHVERDFVEAPSQMLENWVWEKEPLMRMSQHYRTGGEAPEDLLEKLIKSRQANAGLFNLRQIVLAKVDQVLHTQTDVDPAEEYARSARRSLGCQPHQVPTCQPLLATSLVATTLSTMATCGVRCTPWTCSTHASSRRVCLAPRLAWITGPAS

SEQ ID NO: 98028 - DNA, 2025 bp, Xylella fastidiosa Temecula1
  CDS (1)..(2025): transl_table=11
atgagtaacccactcctcgatttctcagaccttcctcgcttcgacgcgatcctccctgaacacgttggcccggccattgagcagttgctcgcagaggcggaggcagccgtcgcccacgcggaacaggtaacgccggtgacatgggagaacttcgtagtaccgctggacgatgccaccgagcggttgtatcgcgcgtggggccaggtggcgcatttggaggcggtggtcaacacgccggcgctgcgtgaggcgtataacgtcactctgccgaaagtcactcgattcagcagtacgctcggacagaacctggcgctgtatgcgcagtacaaagcattagcgtgtgcgccggaatgggaccgtgataatgcggtacggtgcaaggttgttgataacgctttgcgtgatttccgtctcggcggtgccgagctggatgccgccgggaaagctcgtctggcagagatcaagcaggagctgtcggcattgtctgcaacgttttcgcaaaatgtgcttgatgcaacagaggcatggtcctacaccaccgaagacgccgctttgttatccggtctgccgacagagactgtcgctaccgcgcgggcggccgcagaaaagaagggggtatcaggctggacgttcacgttacagatgccctgctatctgtcggtccaaagcgatgctgacaaccgcgcgttacgagagcgctcatatcatgctagtgcgatacgcgcttcggaatttggcgatgccgctttggataatagtccgcacattcatcagattctcacgctgcgttccgaattggcagcgctgcttggtttctcctgttacgcggcatactcggtcgcaaccaagatggcagaggatccagctgaggtactcagcttcctgcatgacttggcaggacgtgccaagccgcatgctcaacgtgatcgccgtgaactggaaacgttcgcacgcgaggcgctggggcttgagacgctggaagcctgggacattgcatatgccagtgagaagctgaaacaagcccgttacaatttctccgagcaggaagtaaagcagtatttcaccgaacccaaggtcctggctgggttgttcgaggtgatccgctccctgtatggactgcgaatcgaagaagacgccgcgccggtctggcatccagatgttcgcttctaccgtctcattgatacgaatgggcaacgcgtcggccagttttatctggatctgtatgcacgggagggcaagcgcggcggggcatggatggatgattgccgtaaccgccgtgacaaaggcgatggggtgcaaactccggtggtctatttggtgtgcaatttcggtcgtggtaacgacggtgtgctgcctacgttccgtcatcaggaggtcattactttatttcacgaaatgggccatgggctgcatcagttactgacccggattggggaactgggcgtggctggtattaatggtgtggaatgggatgcggtggagttgcccagtcagttcatggaaaacttttgctgggagtgggaacgcgttcaagccatgacggcacacgtggagaccggtgcaccgctgccacgcagtctgttcgatcggatggtctgcgcgcgcaattttcagagcggaatgttcaccgtgcgccaacttgagttcgcgctattcgacatgctgctacatagtgacttcgatccagcacaggacagcgtactgggactgttagaacgcgtccgtgatgaagtggccgtcaaccggttaccggactggaatcgttttccgcaccagttcagacatatttttgctggtggttatgcagcgggatattacagttacaaatgggccgaagtcctcagcgcagacgcttatgctgcatttgaagaggctccggatcaatttgccgaaataggggcgcgctttctcgacgaaatcctaagtcgtggcggcagtcgcagcgcagcagagaatttccaagccttccgcaaacgcgcgcctcgcattgatgccttgctgaagcgcaacgggatgacagaatag

SEQ ID NO: 98029 - protein, 674 aa, Xylella fastidiosa Temecula1
MSNPLLDFSDLPRFDAILPEHVGPAIEQLLAEAEAAVAHAEQVTPVTWENFVVPLDDATERLYRAWGQVAHLEAVVNTPALREAYNVTLPKVTRFSSTLGQNLALYAQYKALACAPEWDRDNAVRCKVVDNALRDFRLGGAELDAAGKARLAEIKQELSALSATFSQNVLDATEAWSYTTEDAALLSGLPTETVATARAAAEKKGVSGWTFTLQMPCYLSVQSDADNRALRERSYHASAIRASEFGDAALDNSPHIHQILTLRSELAALLGFSCYAAYSVATKMAEDPAEVLSFLHDLAGRAKPHAQRDRRELETFAREALGLETLEAWDIAYASEKLKQARYNFSEQEVKQYFTEPKVLAGLFEVIRSLYGLRIEEDAAPVWHPDVRFYRLIDTNGQRVGQFYLDLYAREGKRGGAWMDDCRNRRDKGDGVQTPVVYLVCNFGRGNDGVLPTFRHQEVITLFHEMGHGLHQLLTRIGELGVAGINGVEWDAVELPSQFMENFCWEWERVQAMTAHVETGAPLPRSLFDRMVCARNFQSGMFTVRQLEFALFDMLLHSDFDPAQDSVLGLLERVRDEVAVNRLPDWNRFPHQFRHIFAGGYAAGYYSYKWAEVLSADAYAAFEEAPDQFAEIGARFLDEILSRGGSRSAAENFQAFRKRAPRIDALLKRNGMTE

SEQ ID NO: 98030 - DNA, 2064 bp, Xylella fastidiosa Temecula1
  CDS (1)..(2064): transl_table=11
atgccagttactaccagcaatccactgttaacggccagttccttaccgttccaagcgccaccgttcgataaaattaaggacagcgattatttgcccgcgttcgaggagggaatgaagcaacatctggctgaaatcaccaagattgctgagaatcccgatgcaccgaccttcgaaaacactatcgaaatgctggagcacagcggcacaaccttggatagggtctcacgaatttttttcggtctagtacatgctgacaccaatgatacgcgccaaaagattcaggaagaaatcgcgcctaagctggctgcacaccaggatgagatttatttgaatcccaagctgttcactcggatcaagtcaatttacgatcagcgtgacacgcttagtttggacccattacagaaacgtttggtcgaacgtgattatgaaggattcgtacatgccggcgctcagttgcctgaagcagataaaacaactttacgtaaaatcaacgtagaagagagtactctgtccacacagtttcacgctaagctagtcgccgccacagcggcaagtgccattgtggttgatgaaaaaaataaacttgatggactgagcgagggcgacattgctgcagcagcggaggctgccaaggcgcgtaagctcaatgacaagtacgtactcgcattacaaaataccactcaacaacctatatcagcttcgctgaaggatcgtgaattacgtgctctggtgttacaagcttcagaaactagggccgaaaaaggtgacgctaacgatacccgccaaatcgtgcagcgcctaactcagttacgtgcacaaaaagccaagttactcggtttcccaaactatgccgcttataacttggcagatcagatggcaaagacccctgaagcagcgctaaaactactcaacgataccgtgcctgcggctactgcaaaagcacgtaaagaggctgccgaaattcaaaaattgattgataagcaacgtgtcaatactaaagcgaatcactttgagttggttgcctctgactgggatttctatgcggagcaggtgcgcaaagccaagtacaatttggatgaagagcaaatcaaaccgtattttgagctcgacaacgtgctgcaaaacggtgttttctacgccgccaatcagttatacgggatcacttttaaggagcgcaaagatataccaacttaccatccggacatgaaggtttacgaggtgtttgaccatgacggcggctcgttggcactgttctacactgattactttaaacgtgacagtaaatccggtggtgcttggatggatgtgttcgttgaacaaaatgcgatcaccgggaccaaacccgtggtctacaacgtttgcaactttactaagcctgcacctggccagccggcactattgagcttcaaagacgtgaccaccctcttccacgagtttggccatgcgttacacgggatgttttcgaaagtgaagtatccttcgttggcaggcacctcaacatcacgcgattttgttgaattcccgtcgcaattcaacgaacactgggcctctgatccaaaggtgttttcacattatgccaagcactaccaaaccggtgagtccatgccacagagtttggtggacagtattcgcaaggcaaaaactttcaaccagggttacgcaactaccgagtacctttcagccgcacttctagacttggcttggcataccttgccagccgatgcgccactggaggatgtggacaaattcgaagccgatgcactgaagaagtacaaggtcaatctgaaagaagtgccgccacgctatcgcactagctattttgaccatatttggagtggcggctattcggcaagctattacgcttacttttggtctgaagtgttgagtgatgacgcattcgagtggtttaagcagcacggtggtctagaccgtaagaatggcgatatattccgcgacaaaattctctcgcgtggcaacagcattgagttgggcgatttgtatcggcagttccgcggccagaatccgagtgtgcaaccactgttagataaccgtgggttaaaataa

SEQ ID NO: 98031 - protein, 687 aa, Xylella fastidiosa Temecula1
MPVTTSNPLLTASSLPFQAPPFDKIKDSDYLPAFEEGMKQHLAEITKIAENPDAPTFENTIEMLEHSGTTLDRVSRIFFGLVHADTNDTRQKIQEEIAPKLAAHQDEIYLNPKLFTRIKSIYDQRDTLSLDPLQKRLVERDYEGFVHAGAQLPEADKTTLRKINVEESTLSTQFHAKLVAATAASAIVVDEKNKLDGLSEGDIAAAAEAAKARKLNDKYVLALQNTTQQPISASLKDRELRALVLQASETRAEKGDANDTRQIVQRLTQLRAQKAKLLGFPNYAAYNLADQMAKTPEAALKLLNDTVPAATAKARKEAAEIQKLIDKQRVNTKANHFELVASDWDFYAEQVRKAKYNLDEEQIKPYFELDNVLQNGVFYAANQLYGITFKERKDIPTYHPDMKVYEVFDHDGGSLALFYTDYFKRDSKSGGAWMDVFVEQNAITGTKPVVYNVCNFTKPAPGQPALLSFKDVTTLFHEFGHALHGMFSKVKYPSLAGTSTSRDFVEFPSQFNEHWASDPKVFSHYAKHYQTGESMPQSLVDSIRKAKTFNQGYATTEYLSAALLDLAWHTLPADAPLEDVDKFEADALKKYKVNLKEVPPRYRTSYFDHIWSGGYSASYYAYFWSEVLSDDAFEWFKQHGGLDRKNGDIFRDKILSRGNSIELGDLYRQFRGQNPSVQPLLDNRGLK

SEQ ID NO: 98032 - DNA, 2052 bp, Pseudomonas syringae pv. tomato str. DC3000
  CDS (1)..(2052): transl_table=11
gtgagcgcgaacaaccctcttctgcaatcgtacgacctgccacccttttcggcgattcgtgccgaacatgtcaaacctgctatcgaacaaatcctggccgacaaccgtgccgcgattgtcgacatcctcagcaaacagggctcgacgccgacctgggccgggctggtgttgaccatggacgagctgaacgaccgcttgggcgctgcctggagcccggtcagccatctgaatgccgtgtgcaacagccctgaactgcgtgaagcgtatgagtcgtgcctgccggcattgagcgcctactccaccgagatgggccagaatcgcgcactgtttcaggcttatgaagcgctggccaacagccctgaggccgcaggctttgacgtcggtcagaagaccattctggagcaatcgctgcgcgacttccgcctgtccggcatcgacctgccgcccgagcagcagaaacgttatgcgcaagtgcagagcaaattgtccgagctgggcagccagttttccaaccagttgctcgatgccactcaggcctggaccaagctggtcgctgacgagtccgccctcgccggcctgaccgattctgccaagcaacagatggccgcagctgccaaggccaaggacctcgaaggctacttgattaccctggaattcccgagctactacgcggtaatgacctacgccgaagaccgtgccctgcgcgaagaagtctacgcagcttactgtacccgtgcttcggaccagggtcccaacgctggcaagaacgacaatacgccggtgatggagcagattctcgatctgcgccaggagctggcgcagttgctcggctacgcgaactttgccgagctgagcctggcgaccaagatggcagagtccagtgatcaggtgttgagtttcctgcgtgatctggccaaacgcagcaagccgttcgctgctcaggacctggagcagctcaagacttatgcggccgaacagggttgcccggacctgcaaagctgggacagcggtttttacggcgagaagctgcgcgaacagcgttacagcgtttcccaggaaatcctgcgcgcctacttccccatcgataaggtgctcggcggcctgtttgccatcgtccagcgtctgtacggcatcgagattgccgagcagaaaggcttcgacacctggcacccggacgttcgtctgttcgagatcaaggaaaacggccagcacgtcgggcgtttcttctttgatttgtatgctcgcgccaacaagcgtggcggtgcctggatggatggcgcccgtgatcgtcgtcgcactgcgcaaggtgcgctgcaaagcccggtggctaatctggtatgcaacttcacgccggccgctgccggtaagcctgcgctgctgacccacgatgaagtcaccaccctgttccacgaattcggtcacggcttgcaccacctgctgacccgcgtcgagcatgcgggtgtttccggtatcaatggcgtggcatgggatgcggtcgagttgccgagccagttcatggaaaactggtgctgggagcctgaaggtctggcgctgatctccggtcattacgaaaccggcgagccactgccgcaggacctgctggagaaaatgctcgccgccaagaacttccagtccggtctgatgatggtgcgtcagctggagttctcgctgttcgactttgaattgcacgccacccacggtgacgggcgcagcgtgcttgatgtgctggaaggcattcgtgacgaagtgtcggtcatgcgtccgcctgcctataaccgtttcccgaacagctttgcgcacatctttgcaggcggttacgcagccggttactacagctacaagtgggccgaagtactgtctgccgatgcgttctccaagttcgaggaagacggcgtgcttaacgccgaaaccggtcgggcgtttcgcgaagccattctggcgcgtggcggctcacaggtgccgatggtgctgttcgtcgacttccgcggacgtgagccgtcgattgacgcattgttgcgtcacagtggcttgagtgaggacgcggcagcatga

SEQ ID NO: 98033 - protein, 683 aa, Pseudomonas syringae pv. tomato str. DC3000
MSANNPLLQSYDLPPFSAIRAEHVKPAIEQILADNRAAIVDILSKQGSTPTWAGLVLTMDELNDRLGAAWSPVSHLNAVCNSPELREAYESCLPALSAYSTEMGQNRALFQAYEALANSPEAAGFDVGQKTILEQSLRDFRLSGIDLPPEQQKRYAQVQSKLSELGSQFSNQLLDATQAWTKLVADESALAGLTDSAKQQMAAAAKAKDLEGYLITLEFPSYYAVMTYAEDRALREEVYAAYCTRASDQGPNAGKNDNTPVMEQILDLRQELAQLLGYANFAELSLATKMAESSDQVLSFLRDLAKRSKPFAAQDLEQLKTYAAEQGCPDLQSWDSGFYGEKLREQRYSVSQEILRAYFPIDKVLGGLFAIVQRLYGIEIAEQKGFDTWHPDVRLFEIKENGQHVGRFFFDLYARANKRGGAWMDGARDRRRTAQGALQSPVANLVCNFTPAAAGKPALLTHDEVTTLFHEFGHGLHHLLTRVEHAGVSGINGVAWDAVELPSQFMENWCWEPEGLALISGHYETGEPLPQDLLEKMLAAKNFQSGLMMVRQLEFSLFDFELHATHGDGRSVLDVLEGIRDEVSVMRPPAYNRFPNSFAHIFAGGYAAGYYSYKWAEVLSADAFSKFEEDGVLNAETGRAFREAILARGGSQVPMVLFVDFRGREPSIDALLRHSGLSEDAAA

SEQ ID NO: 98034 - DNA, 2043 bp, Vibrio parahaemolyticus RIMD 2210633
  CDS (1)..(2043): transl_table=11
atgtctaatccacttctaacgtttacggacctacctccgttttcgcaaatcaaaccagaacacattaaacctgctgtcgagcaggcgattgcagattgtcgcgccaaagttgaagaggtgctaaaagacaacaccaacccaacttgggaaaatgtgattgctcctctagaagaaattgatgaccgtctgagccgcatttggtcgccagttggtcacatgaactctgtggtgaacagcgaagctctgcgtgaagcgtacgaaagctgcttaccaattttgtcggaatacggcacttgggttggtcagcacaaaggcctgtacgaagcgtacaaaaccatcaaagcgagcgaagaatttgcaacgctaacgcgtgcccagcagaaaaccatcaccgatgcgctacgtgacttcgaattgtcgggcatcggcttgccatcagacgagcagcaccgttacggcgagatcagcaaacgcatgtctgagctgagctctaaattctccaacaatgtgctggatgccaccatgggttggaccaagcacatcacggatgagaaagacctcgcgggtatgccagaatcggcgttggcagcagcgaaagcagctgcagaagcaaaagagctcgatggctacctgatcacgctggatatcccatcttacctacctgtcatgacgtactgcgacaaccaagagttgcgtaaagaagtgtacgaagcgtacgtgacgcgcgcttctgatcgtggtccaaacgcaggcaaatgggacaactcagaaatcattactgagcagctaaaactgcgtcatgaaatcgcacgtatgctgggcttcaacaccttcagtgagaagtcgttggcgaccaaaatggcagaaactccggctcaagtgcttggcttcctaaatgacttagcgacacgtgcgaaaccgcagggtgagcgcgaaattgaagagttgcgtcagtttactaagagcgaatttggcgttgaagagctgaacgtgtgggatatcgcttactatagcgagaagcaaaaacagcacttgttccaaatctcggacgaagagctgcgcccatacttcccagagtcaaaagtcgtgagcggtctgtttgaagtgctaaaccgcgtgtttggcatgaccgttactgagcgtgaaggcgtagacacttggcacgaatctgtgcgtttcttcgacatctttgacgctgaaggcacactacgtggcagcttctacctagatctctacgctcgtgaacacaaacgtggcggcgcgtggatggatgactgtcgtggtcgtcgtattacgctatctggcgaactgcaaacgccggttgcgtacctaacctgtaacttcaaccgtccagtaggcgacaagccggcactgtttacgcacgatgaagttgtgacacttttccatgaatttggtcacggcatccaccacatgctgacgcaggtagaaactggcgcggtatcaggcattaatggcgtaccttgggatgcggttgagctaccaagtcagttcctagaaaactggtgttgggaagaagacgcgctggcgttcatttctggtcactacgaaacgggcgagccgctaccaaaagtgatgctagacaaaatgctcgcggcgaaaaacttccaatctgcgatgggtattttgcgtcagctagaattcggcttattcgacttcacgcttcacaccgaatatgacccagaagtgggtgcgcgtgtgctggaaaccttggcagaagtgaaagagaaagtggcggttgttccagcggttgagtgggcgcgtttctcacacagcttcggtcacatcttcgctggtggttacagcgcgggttactacagctacctgtgggcagaagtgttgtcgtcagacgcattctctcgttttgaagaagaaggtatcttcaacaaagagacgggtcaaagtttcctgaacaacatcctagaaatgggtggcagtgaagagccaatggagctgtttaagcgcttccgtggtcgtgaaccacaaatcgatgcactgctgcgccattcgggtattgcggcgtaa

SEQ ID NO: 98035 - protein, 680 aa, Vibrio parahaemolyticus RIMD 2210633
MSNPLLTFTDLPPFSQIKPEHIKPAVEQAIADCRAKVEEVLKDNTNPTWENVIAPLEEIDDRLSRIWSPVGHMNSVVNSEALREAYESCLPILSEYGTWVGQHKGLYEAYKTIKASEEFATLTRAQQKTITDALRDFELSGIGLPSDEQHRYGEISKRMSELSSKFSNNVLDATMGWTKHITDEKDLAGMPESALAAAKAAAEAKELDGYLITLDIPSYLPVMTYCDNQELRKEVYEAYVTRASDRGPNAGKWDNSEIITEQLKLRHEIARMLGFNTFSEKSLATKMAETPAQVLGFLNDLATRAKPQGEREIEELRQFTKSEFGVEELNVWDIAYYSEKQKQHLFQISDEELRPYFPESKVVSGLFEVLNRVFGMTVTEREGVDTWHESVRFFDIFDAEGTLRGSFYLDLYAREHKRGGAWMDDCRGRRITLSGELQTPVAYLTCNFNRPVGDKPALFTHDEVVTLFHEFGHGIHHMLTQVETGAVSGINGVPWDAVELPSQFLENWCWEEDALAFISGHYETGEPLPKVMLDKMLAAKNFQSAMGILRQLEFGLFDFTLHTEYDPEVGARVLETLAEVKEKVAVVPAVEWARFSHSFGHIFAGGYSAGYYSYLWAEVLSSDAFSRFEEEGIFNKETGQSFLNNILEMGGSEEPMELFKRFRGREPQIDALLRHSGIAA

SEQ ID NO: 98036 - DNA, 2085 bp, Bacteroides thetaiotaomicron VPI-5482
  CDS (1)..(2085): transl_table=11
atgattagaaaaactttaaccattttagcagtaagttgtatgatgtactcctgtggaacaaaaacagaaagcaaccctttcttcactgaatttcaaacagagtatggtgttccttccttcgataaaatcaaactggaacattacgaacccgcctttctgaaaggtattgaagagcagaatcagaatatccaagccattatcgcaagcccggaagtgcctactttcgacaatacgattgtagctttggacagcagcgcacccattctggaccgtgtaagcgccattttcttcaatatgacggatgcggaaacaaccgatgaactgaccgagctctctatcaaaatggcaccggtcctttccgagcacgaagataacatctccctgaatcaggagcttttcaaacgtgtaaacgttgtatatcaacagaaagattccatgaatctgaccacggaacagaaacgtctgctggacaaaacttacaaaggatttgtccgttcaggtgctaatctggatgcagagaaacaggcacgtctgcgtgaaatcaacaaagaactttccactctcggcatcacattcagcaataatatactgaatgaaaacaatgctttccagcttttcgtagacaagaaagaagatttagccggattgcccgaatggttctgccaaagcgcagccgaagaagccaaagctgccggacaaccggggaaatggctgttcaccctgcacaacgccagccgccttccgttcctgcaatacgctgagaaccgccctctccgtgagaaaatgtacaaagcatacatcaaccgcggcaataacaatgacaagaatgacaacaaagaaacgatccgcaagatcgtctccctccgcctggaaaaagcaaggctattgggcttcaacaactacgccaacttcgtactggatgagacaatgtcaaagaatgacagcaacgtaatgagtctgctgaacaacctttggagctatgccctcccgaaagcgaaagccgaagccgcagaacttcaacagttaatggacaaagaaggcaaaggagagaaactggaagcctgggactggtggtactacacagaaaaactccgcaaagagaaatacaacctctccgaagaagacaccaaaccttacttcaaactggagaatgtacgtgaaggagctttcgcagtcgccaacaaactatatggtatcactctgaacaaactggaaggtatcccgacttatcatccggatgtagaagtcttcgaagtgaaagacgctgacggctcccaactgggcatattctatgtagactatttcccgcgttcaggaaaaagcggtggcgcatggatgagcaattaccgcgaacagcagggagcaacccgccccttggtatgcaacgtatgcagtttcaccaaaccggtcggcgacaccccttctctgctgactatggacgaagtagaaactctgttccacgaattcgggcacgctctgcatggcttactgacaaagtgcgaatacaaagggacttccggcaccaatgtcgtacgcgattttgttgaacttccttctcagatcaacgaacattgggctaccgaaccggaagtgctgaaaatgtatgccaaacactatcagacaggagaagtaatccccgatgaaatcatcgaaaagattctgaaacagaaaacgttcaaccaaggattcatgaccaccgagttactggctgccgccatcctcgacatgaaccttcacatgataacagatgtaaagaatctggatatgcttgctttcgaaaaagaagccatggacaagctcggcctgatccccgaaattgccccccgctaccgcgtcacttacttcaatcatatcattggcggatacgctgccggatactacagttacctttgggcgaatgtacttgacaatgatgcctttgaagccttcaaagaacatggaatctttgataaaaacactgccgacctcttccgctacaacgtattggaaaagggagacagcgaagatccgatgatactttataagaatttccgcggtgcagaaccaagcctggagccgttactgaaaaacagaggaatgaaataa

SEQ ID NO: 98037 - protein, 694 aa, Bacteroides thetaiotaomicron VPI-5482
MIRKTLTILAVSCMMYSCGTKTESNPFFTEFQTEYGVPSFDKIKLEHYEPAFLKGIEEQNQNIQAIIASPEVPTFDNTIVALDSSAPILDRVSAIFFNMTDAETTDELTELSIKMAPVLSEHEDNISLNQELFKRVNVVYQQKDSMNLTTEQKRLLDKTYKGFVRSGANLDAEKQARLREINKELSTLGITFSNNILNENNAFQLFVDKKEDLAGLPEWFCQSAAEEAKAAGQPGKWLFTLHNASRLPFLQYAENRPLREKMYKAYINRGNNNDKNDNKETIRKIVSLRLEKARLLGFNNYANFVLDETMSKNDSNVMSLLNNLWSYALPKAKAEAAELQQLMDKEGKGEKLEAWDWWYYTEKLRKEKYNLSEEDTKPYFKLENVREGAFAVANKLYGITLNKLEGIPTYHPDVEVFEVKDADGSQLGIFYVDYFPRSGKSGGAWMSNYREQQGATRPLVCNVCSFTKPVGDTPSLLTMDEVETLFHEFGHALHGLLTKCEYKGTSGTNVVRDFVELPSQINEHWATEPEVLKMYAKHYQTGEVIPDEIIEKILKQKTFNQGFMTTELLAAAILDMNLHMITDVKNLDMLAFEKEAMDKLGLIPEIAPRYRVTYFNHIIGGYAAGYYSYLWANVLDNDAFEAFKEHGIFDKNTADLFRYNVLEKGDSEDPMILYKNFRGAEPSLEPLLKNRGMK

SEQ ID NO: 98038 - DNA, 2070 bp, Bacteroides thetaiotaomicron VPI-5482
  CDS (1)..(2070): transl_table=11
atgaacaatatactgaacgctcagaatcctttcttcggtcagtatcagacaccgcatgggactgtgccctttgaccggatcaagacagagcattatgagcctgccatcctcgaaggaatcaaacaacagaatgcggaacttgatgcgatcatacaaaacccggagaaggcgacatttacaaatacaatagaagcctacgaacaatccggaaggctgctggacaaagtaactgccgtattcggcaatatgcttagtgctgaaaccaatgacgacttacaggcattggctcagaaaatcatgccactactcagcgaacacagcaacaacatcacactgaatgagaagttgtttgcccgcgtgaaagaagtgtacggacaaaaacaatctctgcaactgacccaggaacagaatcgcctgctagacgatatatacgacagttttgtacgccacggtgccaacctcgaaggagaagcccgtgaacaataccgacaactgaccaacgaactgagcaaactgacactcgacttcagcgaaaacaacctgaaggagacaaacaggtatcaaatgcttctgacagacaaagccagcattgccggactgccggaaatcatcgtagaagctgctgccgaaacagccagaagtgaggataaagaaggatgggctttcaccctgcacgctccaagttatgtgcctttcatgacttatgccgacaaccgcgagttgcgccataagctctacatcgcatataatacaaagtgtacacacgataacgaattcaacaatatcgaaatcgtaaagaagctggttaatacacgcatgaaaatagcccagctactaggatataaagattatgcggaatataccctcaaaaaacgaatggctgaaaacagcgatgccgtatataagctgctcaaccaactattggaagcctacactcccaccgcacagaaagaatatctcgaagtacaggaactggcacgtgaggaacaaggtgatgacttcattgtcatgccctgggactggagctactattccaataagctgaaaaacaagaaattcaatatcaatgaagaaatgctccgtccttacttcgaactggaacaagtaaaaaaaggagtattcggactggcagaaagactctacggaatcactttccggaaaaatacggaaatcccggtttatcacaaagatgttgaagcctacgaggtattcgacaaagacggtaagttcctgtccgtactgtacactgacttccatccccgtcccggaaaacgcgccggagcctggatgaccagctacaaggaacaatggatagatcccgtaaccggtgaagacagccgaccgcatatatctgtagtgatgaacttcaccaagccaaccgaaagcaaacctgctttgctgactttcaacgaagtggagacattcctgcatgagttcgggcacagcctgcatggcatgtttgccaactcaacctatcagagcctaagcggaacaaacgtatattgggactttgtggaacttccttcacagatcatggaaaactttgccatcgagaaagaatttcttaatacctttgcccgtcattatgaaaccggagaagtgcttccggacgaactgatacagagactcgtggatgcttcgaatttcaatgcagcctatgcctgcctgagacaagtgagcttcgggctgctcgatatggcatggtacacccgcaacactcctttcgagggcgatgtaaaagcctatgaacaggaagcctggaaagacgcacaagtattgccgatagtcaaagaagcctgcatgagtacacaattctcccatatctttgccggaggatattccgcaggatattacagttataaatgggcagaagtgctggatgcggatgcgttctcactgttcaaacagcaaggaatcttcaaccgtgaagtagcagattcgttccgcaacaatatcctgtcgaaaggaggtacagaacacccgatggtgctctacaagcgcttccgcgggcaggagcctaccattgacgcattgctgatccgaaacggcataaagaaacaatacaattaa

SEQ ID NO: 98039 - protein, 689 aa, Bacteroides thetaiotaomicron VPI-5482
MNNILNAQNPFFGQYQTPHGTVPFDRIKTEHYEPAILEGIKQQNAELDAIIQNPEKATFTNTIEAYEQSGRLLDKVTAVFGNMLSAETNDDLQALAQKIMPLLSEHSNNITLNEKLFARVKEVYGQKQSLQLTQEQNRLLDDIYDSFVRHGANLEGEAREQYRQLTNELSKLTLDFSENNLKETNRYQMLLTDKASIAGLPEIIVEAAAETARSEDKEGWAFTLHAPSYVPFMTYADNRELRHKLYIAYNTKCTHDNEFNNIEIVKKLVNTRMKIAQLLGYKDYAEYTLKKRMAENSDAVYKLLNQLLEAYTPTAQKEYLEVQELAREEQGDDFIVMPWDWSYYSNKLKNKKFNINEEMLRPYFELEQVKKGVFGLAERLYGITFRKNTEIPVYHKDVEAYEVFDKDGKFLSVLYTDFHPRPGKRAGAWMTSYKEQWIDPVTGEDSRPHISVVMNFTKPTESKPALLTFNEVETFLHEFGHSLHGMFANSTYQSLSGTNVYWDFVELPSQIMENFAIEKEFLNTFARHYETGEVLPDELIQRLVDASNFNAAYACLRQVSFGLLDMAWYTRNTPFEGDVKAYEQEAWKDAQVLPIVKEACMSTQFSHIFAGGYSAGYYSYKWAEVLDADAFSLFKQQGIFNREVADSFRNNILSKGGTEHPMVLYKRFRGQEPTIDALLIRNGIKKQYN

SEQ ID NO: 98040 - DNA, 2034 bp, Coxiella burnetii RSA 493
  CDS (1)..(2034): transl_table=11
atgacaaaaacagaccttacaatcgacttgcctaaatttagctacatcgtccaaagcgatattgaatcttctttagatcagttattagctgataattacgatgaaatcaaccaactcgtcaaatcaggcgattatacatggaaggcattcattcagccgttagaagatattaatgatcggttgcatcgttattgggcgcccattagtcacctgaacgcggttgttaataatccaaagttgcgcgaaatttatcatgcctgtttacctaaactgacggattattctactaagctcagtcatcatcaagaactctatcaggctattcaatcaattgctgatgggatggagtatcaaaagctcaacaatgcacagcgaaaagtgattgataatgacctgcgcgattttaaattagccggtgtgaccttatcatccgaaaaaaagaaacagtacgcagaactaacgaaaacgttatcgcaactgcaaaatcaatttgaagaaaatttattagacgcaacccaaggttggcacaaacaaattttggatgaaaataaattacgcggtattcccaatcacgctgttattgcagctcgtgaaaccgcagagcagcgcggtttagaaggatggctatttacgttagaaattccctcctatttggccgtcataatgcacgctgattctcgttcgttgcgcaaagaaatgtatacggcatttgtcacccgcgcctccgatcaaggtcctaacgctaaaaaatgggacaacaccgcattgatggaacaaatactggatgctcgtttaaaattggcgaaccttttagggttcactaattttgctgaatattcgttggcgactaaaatggtaaaatcgccgcagcaagtgattgctttcatgaatcaactcgtagaagcggcgctgccgaaagcgaaacaagaattcctagaactgagcgaattttcaaaaaaggaattaggtattgaaaagttagaagcttgggatattgcctacgcggctgaaaaattccgtgagcgttatttttctatttctcaagaggatttacgcccttattttcccgaggcgcaagtcatacaagggctatttaagatcgtaaatcgacttttccaaataaccattaagcccgtcagtcccgctgacgtttggcacccggacgcgcattgttatgccgtttatgataataaagatcaattacgcgcttatttttactttgacctttatgctcgtgaaaacaaacgtggcggtgcgtggatggatgatcaccgtccgaggcgctgtttatccgatggaaaaatacaactgcccattgcattcgtggtttgtaatttaaatcctccgaccgcgaatcaacccgctttgtttagccatgacgacgttgttacgttatttcacgaatttggacacgctcttcagcacatgttgacgaaaattgattacgcggaaatttcgggcattcatggcgttccgtgggatgccgtagagttagccagtcaatttttagaaaattgggcatggcaaaaagaaccgttatttatgatggcgaagcactatcaaacgggcgaaaccatgccggacgagttgttccaacgcttgcacaaaactaaaaattttcatgcgggattgcaaatgatgcgtcagttggaatttggcttattcgatatgcgattgcatatggagtttgattcgacgcaaaaaaatcagattcaacagattcttaatgaagtgcgaaaagccgtttgcgtaattcccgtgcctgattttaaccgctttcagcacagtttctcacatatttttgcgggcggctacgcggccggttattatagctacaaatgggcagaagtaatggcagccgatgctttttctctttttgaagaaaagggaatattcgatcaagatagcgcgcgacgattctcagcgtgtattttagaatcgggtggttcagaagaccctttaaatttatttaaagcttttcgaggacgagagccgaaagtggaagctttgttgcgacaaagaggaattgtataa

SEQ ID NO: 98041 - protein, 677 aa, Coxiella burnetii RSA 493
MTKTDLTIDLPKFSYIVQSDIESSLDQLLADNYDEINQLVKSGDYTWKAFIQPLEDINDRLHRYWAPISHLNAVVNNPKLREIYHACLPKLTDYSTKLSHHQELYQAIQSIADGMEYQKLNNAQRKVIDNDLRDFKLAGVTLSSEKKKQYAELTKTLSQLQNQFEENLLDATQGWHKQILDENKLRGIPNHAVIAARETAEQRGLEGWLFTLEIPSYLAVIMHADSRSLRKEMYTAFVTRASDQGPNAKKWDNTALMEQILDARLKLANLLGFTNFAEYSLATKMVKSPQQVIAFMNQLVEAALPKAKQEFLELSEFSKKELGIEKLEAWDIAYAAEKFRERYFSISQEDLRPYFPEAQVIQGLFKIVNRLFQITIKPVSPADVWHPDAHCYAVYDNKDQLRAYFYFDLYARENKRGGAWMDDHRPRRCLSDGKIQLPIAFVVCNLNPPTANQPALFSHDDVVTLFHEFGHALQHMLTKIDYAEISGIHGVPWDAVELASQFLENWAWQKEPLFMMAKHYQTGETMPDELFQRLHKTKNFHAGLQMMRQLEFGLFDMRLHMEFDSTQKNQIQQILNEVRKAVCVIPVPDFNRFQHSFSHIFAGGYAAGYYSYKWAEVMAADAFSLFEEKGIFDQDSARRFSACILESGGSEDPLNLFKAFRGREPKVEALLRQRGIV

SEQ ID NO: 98042 - DNA, 2046 bp, Shigella flexneri 2a str. 2457T
  CDS (1)..(2046): transl_table=11
atgacaacaatgaatcctttccttgtgcaaagcacactgccgtatctggctcctcattttgatcaaattgccaatcatcactatcgcccggcattcgatgagggaatgcaacaaaagcgggcagaaattgctgccatcgcgcttaacccgcaaacgcctgatttcaacaatactattctggcactggaacaaagcggagaattaattacccgcgttaccagcgtcttttttgcgatgactgcggcgcataccaatgatgaattacagcgtcttgatgaacagttttccgctgaactggcggaactggctaatgatatctatctgaacggtgaattattcgcgcgggtagatgctgtctggcagcgccgtgaatccctggggcttgatagtgaatccatccgcctggtggaggttattcatcaacgttttgtccttgccggagccaaacttgcacaagctgataaagcaaaattaaaagtactgaatacagaagctgcgaccctgaccagccagtttaaccagcggttacttgcagcaaataaatccggcggtctggttgtgaacgatatcgcgcagctggcaggaatgagtgagcaagagattgcgctggcggcagaggcggctcgcgagaaaggtctggataacaaatggctgattccgctgctgaataccacccaacaaccggcgcttgccgaaatgcgcgatcgtgcgacgcgtgaaaaactgtttattgcgggctggacgcgagcggaaaaaaatgatgccaatgatacccgcgctatcattcaacgtctggtagagattcgcgcacagcaggcgaaactgcttggttttcctcattatgccgcatggaaaatcgccgatcagatggcaaaaacgccagaagcagcactcaactttatgcgggaaattgttccagcggcgcgtcaacgtgcgagcgatgaattagcctccatacaggcggttatcgataagcagcagggcgggtttagcgcgcagccgtgggactgggcattttatgcggaacaggtacggcgggagaaatttgatcttgatgaggcgcagctcaggccatattttgaattaaacacggtgttaaatgaaggtgtattctggaccgcgaatcagctcttcggtattaagtttgtcgaacgttttgatattccggtctaccatcctgacgttcgtgtgtgggaaatttttgatcataatggcgtgggactggcgttattttacggtgatttcttcgcccgtgattcaaaaagcggcggtgcatggatgggcaattttgttgagcaatcaacgcttaatgaaacgcatccggtaatttataacgtctgcaattatcagaaacccgctgccggtgagcctgcgttgttactctgggatgatgtaataaccttattccatgaatttggtcatacgctgcacggcctttttgcccgccagcgttatgccacgctttccggcaccaacacgccgcgtgattttgtcgaatttccgtcgcaaatcaacgaacactgggcaacgcatccgcaggtattcgctcgctacgcccggcattatcagagcggggcagcaatgcctgacgaactgcaacagaaaatgcgtaatgccagcctgttcaacaaagggtatgagatgagcgaactgcttagcgccgcacttctcgatatgcgctggcattgcctggaagaaaacgaagcaatgcaggatgtcgatgattttgaattgcgggcgctggtggcggaaaatatggatcttcctgctataccgccacgctatcgcagcagttatttcgcccatatttttggtggcggatatgctgcaggttattacgcttatctgtggacgcaaatgttggccgatgatggttaccagtggtttgttgagcagggcggattaacgcgtgaaaatgggcagcgttttcgcgaggcgatcctttccagaggtaacagcgaagatctggaacgcctgcatcgacaatggcgtggtaaggctcctcagattatgccgatgctgcaacatcgtggcttgaacatataa

SEQ ID NO: 98043 - protein, 681 aa, Shigella flexneri 2a str. 2457T
MTTMNPFLVQSTLPYLAPHFDQIANHHYRPAFDEGMQQKRAEIAAIALNPQTPDFNNTILALEQSGELITRVTSVFFAMTAAHTNDELQRLDEQFSAELAELANDIYLNGELFARVDAVWQRRESLGLDSESIRLVEVIHQRFVLAGAKLAQADKAKLKVLNTEAATLTSQFNQRLLAANKSGGLVVNDIAQLAGMSEQEIALAAEAAREKGLDNKWLIPLLNTTQQPALAEMRDRATREKLFIAGWTRAEKNDANDTRAIIQRLVEIRAQQAKLLGFPHYAAWKIADQMAKTPEAALNFMREIVPAARQRASDELASIQAVIDKQQGGFSAQPWDWAFYAEQVRREKFDLDEAQLRPYFELNTVLNEGVFWTANQLFGIKFVERFDIPVYHPDVRVWEIFDHNGVGLALFYGDFFARDSKSGGAWMGNFVEQSTLNETHPVIYNVCNYQKPAAGEPALLLWDDVITLFHEFGHTLHGLFARQRYATLSGTNTPRDFVEFPSQINEHWATHPQVFARYARHYQSGAAMPDELQQKMRNASLFNKGYEMSELLSAALLDMRWHCLEENEAMQDVDDFELRALVAENMDLPAIPPRYRSSYFAHIFGGGYAAGYYAYLWTQMLADDGYQWFVEQGGLTRENGQRFREAILSRGNSEDLERLHRQWRGKAPQIMPMLQHRGLNI

SEQ ID NO: 98044 - DNA, 2106 bp, Nitrosomonas europaea ATCC 19718
  CDS (1)..(2106): transl_table=11
atgaaaaacccgctgttagatttttccacgcttcctcgctatgaggaaattcggaacgaacacatcacgcctgctatggacgagttgttgcgcgactgccgtgcggtagtgaatagagttaaaaatgcgacagaatctcctgactggcaggattttgtgcaaccggtggtggatgcgaatgagcgtttgtcgcgtgcgtgggggcagatagcgcatttgaatgcggtcatgaataacccggagctgcgcgaaatctataacgccaatctgccgcgtattacgcagtactatgccgagttgtcgcaggatccagtattgtttgagaaattccggcagttgcgggcagatccggcattcaatgatttaagtcaggcacgcaggaaaattgtggacaatcagttacgtgattttcacttgggaggtgccgaactgccgctggaagataaagcccggttcatgcagattcaggaagaactgtcggcgttgagctcaaaattcaacgataacctgttggatgcaaccaacgcgttttctttgtttatagaaaaccgggatgaacttgccggaattccggaggatgtattgcaggcggcgcgtgaagcggcaaccaaagatacttcgattactgtgccgggctggaaatttactctgcatgcaccttcctatctgccggtcatgcagtatgcggataaccgcagtttacgtgaacggatgtatcgggcatatgtgacacgggcgagtgagcttgaagctgttccggagcagactgtgaatcgtgacaacatgcctttgatcgaaaagatgctacgtttgcgccaggaggaagcaaggctgctgagttacgattgttacgcacaggtgtcactgactcccaagatggcggaaacgccgcagcaggtgctggattttctgaatgagctggcagccaaagcgagaccttacgcagaaagagatctggcagagctgcagcagtttgccgctgataagctgaaactggatcgactcgaaatgtgggatattgcctacgccagcgaaaagctgcgtatcgagcgttatgctttttctgagcaggaggtcaagcaatatttcccggagaacaaggtattgcctggcatgttccgactggtggagactctgtacggcatacgtatcagcgaagcagagccggcacgtaacattcagtgctggcatccggatgtgaaatttttcgatattgctgacgcgaatggtaatttgctggggcagttttatctggatctttatgcccgccccggtaagcgtggcggggcttggatggatgacgcgatcacccggcggaagattgaggtacctgaaatcggccgttccgaaatccaggcgccagttgcctaccttacttgcaatttttcggcacccgtgacgatcgacggccagttgcgcccggcattgttcacgcatgatgaggtaattacgctgtttcatgaatttggtcatggattgcatcatttgctgacccggatggatgagctgggtgtttccggtatcaacggggtcgagtgggatgcggttgaactgcccagccagttcatggaaaacttctgctgggagtgggaagtattgcgtggtatgactgcgcatgtggaaaccggcaatccgctaccgcgcgcgttattcgataagatgctcgcagccaagaacttccagagtggccttcagactttgcgtcagattgagtttgccttgtttgatatgcatttgcacacggattttgacccgcagggcagtgaaaccgtgttacagcgtctggataaaatccgccagcgggttgccgtcatcattccacccgcgttcaaccggtttccggacagcttcggacatatatttgctggaggttatgctgccggttattacagttataaatgggcggaagtattgtctgccgatgcttacagcctgttcgaagagaatggtgccggccaggtggtcagtgcaaaaactggagagcgtttctggcatgaaattcttgccgtaggtggtagccgcccggcacttgaatcattcattgcatttcgcggacgcgagccaaaaattgatgcgttgctgcggcatcatggtatggcagcctga

SEQ ID NO: 98045 - protein, 701 aa, Nitrosomonas europaea ATCC 19718
MKNPLLDFSTLPRYEEIRNEHITPAMDELLRDCRAVVNRVKNATESPDWQDFVQPVVDANERLSRAWGQIAHLNAVMNNPELREIYNANLPRITQYYAELSQDPVLFEKFRQLRADPAFNDLSQARRKIVDNQLRDFHLGGAELPLEDKARFMQIQEELSALSSKFNDNLLDATNAFSLFIENRDELAGIPEDVLQAAREAATKDTSITVPGWKFTLHAPSYLPVMQYADNRSLRERMYRAYVTRASELEAVPEQTVNRDNMPLIEKMLRLRQEEARLLSYDCYAQVSLTPKMAETPQQVLDFLNELAAKARPYAERDLAELQQFAADKLKLDRLEMWDIAYASEKLRIERYAFSEQEVKQYFPENKVLPGMFRLVETLYGIRISEAEPARNIQCWHPDVKFFDIADANGNLLGQFYLDLYARPGKRGGAWMDDAITRRKIEVPEIGRSEIQAPVAYLTCNFSAPVTIDGQLRPALFTHDEVITLFHEFGHGLHHLLTRMDELGVSGINGVEWDAVELPSQFMENFCWEWEVLRGMTAHVETGNPLPRALFDKMLAAKNFQSGLQTLRQIEFALFDMHLHTDFDPQGSETVLQRLDKIRQRVAVIIPPAFNRFPDSFGHIFAGGYAAGYYSYKWAEVLSADAYSLFEENGAGQVVSAKTGERFWHEILAVGGSRPALESFIAFRGREPKIDALLRHHGMAA

SEQ ID NO: 98046 - DNA, 2241 bp, Rhodopirellula baltica SH 1
  CDS (1)..(2241): transl_table=11
atgtgcggatgcggtggtggaacttctgaaattaaaagggttcatcaaatgagatggtgtgttgttccggcaagcttccttgccgtgatcgtgttggtccaaccttcctattcacaagaatcttccgtgaacagctcgcaatctcttctgtcctcctcaccgcttctgaaaccctggttgggaccgcatggcggagtgccgccatggaatgaagttcgtgttgatgaatttgatgccgccttcgacgccgcgattgagcaggctgaaaaggagatcaaccaaatcgccaatcagtccgcaccgcccacgttcgagaacaccattctcgcgatggaaacggtcggcgaagccctgcaccgggtcgaggtgttgttcgatgttcatgccggtaacctaaatctcgggccgatcccggatttggaacgcagcatcacgccgaagctggcggcttattctgactccgtcacccaaaacgcagcgttgttcgctcggatcgaagcgattcacgatgacgtttttgagaagaagactgcgacgctggacgacgatgcaaaacgtctgctcgatgaaacgttcaaaagttttgttcgccgaggggctcggttgagtcctgaggacaaatcaaaattgtcccagatcaacactcgattggctcggttgttcacagacttcaaccagaacgttctcgaagaagaaaagggacacgtcacttggattgatgatgagtcgcgattgtccggtgtgccccaatcgactcgcgacgcaatggcggtcgcggctgaagaaaagggtggcaaggccaagtgggccgtcaccaacacgcgttcgtccatggacccgttcttgaccaatgccgacgatcgtgagcttcgggaagaggtttggcgaaactattacttccgcagtgacaacaacgatcaatacgacaacaaaggcatcattcgcgaaatcctgaacctgcgagcggcgcgagccaagttgctcgggtatccaacccacgcccattggcgcatggaatccacgatggcgggtacccccgaccgtgcaatggatttgatgatgaaagtctggcctcacgctgtgcagcgtgtcgcgaccgaagtggcggacatgcaagcgattgcggacgccgagatggaagcggctggcaaaccgaagatcaaaatcgaaccgtgggattatcgctactacgccgagaaagtccgggcgaaaaaatacgacttggacatggcggaagttcgtccctatttgcagctcgatcgtttggtcgaagcgatgatgtggtgtgcggacgaattgttcggtttccagttccgtccgatcggcaacttgccggtcttccatcccgatgtcaccgtttacgaagtggtgcagaagtccgacggaagccatgtgggactgttttatctcgacccgttcgctcgcgaaggcaaacgtagcggcgcatggatgatggattaccgaggccaatcgggatgggatcttgatcccgcctccgcggacgttcctgttcgaacacccatcgtttcaaacaacagcaactttgttcccgctgcggacggcaagccagttttgatttcttgggacgatgcgaccacactgttccacgaatttgggcatgctctgcatgggctttctagtcgcgtgcattacccatcgcagtccggcaccaacgtggctcgtgacttcgttgagttcccgtcgcaggtgctggagcattggttgtcgactcctgaagtgttgactcgctacgcgacgcactacgagacgggcgagcccatgccgaaggaattgctcgacaagatcgaagcttcgtcaaagttcaacagcgggttcgaaaccgttgagtatctcgcttgtgcgatcctggacatgaagctgcatcagttgcaggctggcgacattgatatcagtgagtttgaaaagtcggcactcgcagaaatcggcatgccagacgaattgccgatgcgtcaccgtctgcctcacttcagtcacctgttcagcagcgacgcttactcggccggttactacagctacctttggagcgacgcgctaacggcggatgcggcggagatgttcgttgaggccggaagcttctttgacgaggaaaccgccgcgaagttgttcgatcacattctcagcgtcggcgacacgattgaccccgtcgaaacctaccgcaatttccgcggtcgagatgtcgatacagaagccttgctccgcaaacgcggtttcgcggaatga

SEQ ID NO: 98047 - protein, 746 aa, Rhodopirellula baltica SH 1
MCGCGGGTSEIKRVHQMRWCVVPASFLAVIVLVQPSYSQESSVNSSQSLLSSSPLLKPWLGPHGGVPPWNEVRVDEFDAAFDAAIEQAEKEINQIANQSAPPTFENTILAMETVGEALHRVEVLFDVHAGNLNLGPIPDLERSITPKLAAYSDSVTQNAALFARIEAIHDDVFEKKTATLDDDAKRLLDETFKSFVRRGARLSPEDKSKLSQINTRLARLFTDFNQNVLEEEKGHVTWIDDESRLSGVPQSTRDAMAVAAEEKGGKAKWAVTNTRSSMDPFLTNADDRELREEVWRNYYFRSDNNDQYDNKGIIREILNLRAARAKLLGYPTHAHWRMESTMAGTPDRAMDLMMKVWPHAVQRVATEVADMQAIADAEMEAAGKPKIKIEPWDYRYYAEKVRAKKYDLDMAEVRPYLQLDRLVEAMMWCADELFGFQFRPIGNLPVFHPDVTVYEVVQKSDGSHVGLFYLDPFAREGKRSGAWMMDYRGQSGWDLDPASADVPVRTPIVSNNSNFVPAADGKPVLISWDDATTLFHEFGHALHGLSSRVHYPSQSGTNVARDFVEFPSQVLEHWLSTPEVLTRYATHYETGEPMPKELLDKIEASSKFNSGFETVEYLACAILDMKLHQLQAGDIDISEFEKSALAEIGMPDELPMRHRLPHFSHLFSSDAYSAGYYSYLWSDALTADAAEMFVEAGSFFDEETAAKLFDHILSVGDTIDPVETYRNFRGRDVDTEALLRKRGFAE

SEQ ID NO: 98048 - DNA, 2043 bp, Wigglesworthia glossinidia endosymbiont of Glossina brevipalpis
  CDS (1)..(2043): transl_table=11
atgataaattttttaaaaaaaaacgacttacctaaattttctttaatcaaagagaatgatataattaaaattattgaaagcgcaataaagaaatgtaaaaactctattaatacaattgtttctaaaaacaatttattttcttgggataatttatgtcaaccaatatcagaattagataattatttaaacaaaatttggtctccaatatctaatttgtatttaacttgtaatacaatagatttaagaaaatcatacgaaaaaagtttaattttaatatcagaatatagcacttgggtaggtcaaaataaaaaattatataaagctttttgttcattaaaaaaaagtagtaattatttaaatttaaatatagatcaaaaaaaacatatagataatattatattggattttaaattatctggaattaatttagaaaaagacgaaaaaatacaatattctaatataataaaagaattatcttctattagcacaaattttaataataatatattagattctaacaaaatatggaacaaacacattacatgtaaagaagaattaaatgggattcctaaagatgttgttgatttagccagagaaaatgcaaaaaaaaatggaaaaaaaggatggatatttaatttagattacaatacatattcatcaataattaattattgtgaaaatgaaaatttaagaaaagaaatatattatgcatatcatactagagcttcagatcaaaataaattttttaaaaatctaaacaatgggccattgatacaaagaatactattattaaaatctaaattgtctaaattgttaggttttaaaaattatgcagaaaaatctttagtaaataaaatggctgaatctatagattcagtagaacaatttatatataacttatatgaatgtgtaaaaaaatctggattaaaagaaataaaaaatttacacaaatttgcaaaagaaaaatataattttaaaaaattaaatccgtgggatatgtctttttttagcgaaaaacaaaaaaaattttatttttttataaatgaagaaaaattaagagagtttttcccagaagatcaagttttaataggactatttaatatagtaaattgtatttatggtattgaaattatagaaaataaaaacatagaagtatggaatccagaagtaaaattttttgaaatttatgataaaaacaaaaactatattggaggattttatttagatttgtattctagaaaaaacaaaaaagacggagcatggatggattcttattctagcagaatgttattgtctaatggagaaatagaaaaaccaatatcttatattatatgtaattttagaaaaataaaaaaatttaataaaaatttattattacacagagaagtattaactcttttccatgagtttggccataatcttcatcatgttttaactagaataaattcttttggagtatctggaataaatggtgttccttgggatgtagtagaatttcctagccaattaatggaaaattattgttgggacaaaaaatctattaaattaatttcaaagcattataaaagcgaaaagtcgttgacagatgaaacaattcaaaaccttataaaaacaaaaaattatcaatttagtttatttgtattacggcaaattgaattttctttgtttgatttaaaaatacatactttaccatatgatgaaataaaaaataaaaataaaatattagatgttcttgataaaataagaaaagaaatatcagtatttccaagatgtaattgggaaagatttcctaatacctttagtcatatattttctggaggatattctgctgggtattatagttatttatggtctagcactatggcaatagatgcttggtcaaaatttaaagaaattggaatattaaacgaaaaagtaggaaaattatttttagataacattttatctaaaggtggatcagaagatcctttagtattgttttctaggttcagaggaagaaaacctaaaatatctcattttattaaatattatggaataagataa

SEQ ID NO: 98049 - protein, 680 aa, Wigglesworthia glossinidia endosymbiont of Glossina brevipalpis
MINFLKKNDLPKFSLIKENDIIKIIESAIKKCKNSINTIVSKNNLFSWDNLCQPISELDNYLNKIWSPISNLYLTCNTIDLRKSYEKSLILISEYSTWVGQNKKLYKAFCSLKKSSNYLNLNIDQKKHIDNIILDFKLSGINLEKDEKIQYSNIIKELSSISTNFNNNILDSNKIWNKHITCKEELNGIPKDVVDLARENAKKNGKKGWIFNLDYNTYSSIINYCENENLRKEIYYAYHTRASDQNKFFKNLNNGPLIQRILLLKSKLSKLLGFKNYAEKSLVNKMAESIDSVEQFIYNLYECVKKSGLKEIKNLHKFAKEKYNFKKLNPWDMSFFSEKQKKFYFFINEEKLREFFPEDQVLIGLFNIVNCIYGIEIIENKNIEVWNPEVKFFEIYDKNKNYIGGFYLDLYSRKNKKDGAWMDSYSSRMLLSNGEIEKPISYIICNFRKIKKFNKNLLLHREVLTLFHEFGHNLHHVLTRINSFGVSGINGVPWDVVEFPSQLMENYCWDKKSIKLISKHYKSEKSLTDETIQNLIKTKNYQFSLFVLRQIEFSLFDLKIHTLPYDEIKNKNKILDVLDKIRKEISVFPRCNWERFPNTFSHIFSGGYSAGYYSYLWSSTMAIDAWSKFKEIGILNEKVGKLFLDNILSKGGSEDPLVLFSRFRGRKPKISHFIKYYGIR

SEQ ID NO: 98050 - DNA, 2127 bp, Prochlorococcus marinus subsp. marinus str. CCMP1375
  CDS (1)..(2127): transl_table=11
atgcaaaaacttccagcactattgattggtaaaggattaccactctttgaagagattactagtctagaaattgagcaatgtattccaactctattaaatatacttcacaaggaatttgatgttttagaaaatgagttaaaagagaagttgatctcagaaaaagctttaacttgggaagatctaataaaccctttgtacaaaattgaagagaagcttcgctggagctggggaattgtctcacatttaaatggagtatctaattctcctgaactaagaaaagtctatgctgatcaacagcctgaagtaattcgatttggcaatcgattgggtcaaagcaaggtactatttaatgcactcttaaaccttttcaataaaaacaaacaatctctagataacacacagctaagaattcttgaatcagaattactatcaatgaagaatagaggtgtaggtttaacaggtgaagacaaaaaaatatttaattctaacagtgaacgtcttgcggaactttctaatatctttagtaataacgtattagatgcaacaaaagaatggaaacttctactaacaaaacctgaacagatagaagggctaccaaaacgtagcctagaagcaatggcaaaagctgcaaaagaagctgatgatatttttcaagaaaataggggggaaggaccttcagcagaaaaaggtccatggctactaggtctagacatgccaagctataccacttttattacatactcaaagaataggcacttgcgtgaaattatttataaagcctacataagtagagccagtagtggaaagctaaataatcaaaagttaattgaacaaattctttcaattagaaaacaccaagctcaacttcttggctacaaaaactgggctgaaataagcttgtcaagcaaaatggccagtaatgtatctcaagtagaagaattgcttgaagaactcagatccgcagcaatgccagctgccaaggaagaaataaaaagattagagttatttgctgccgatgaaactggtactgacttctataaattagctccttgggatgtcaattattggtcagaaaagttaaggcaaaagctatttgatctcaatcaagaaaatctaagagcttggttcccacttcctcaagtacttaatggtttatttaggttatgtgaaagactattcgagatctctataaaaccatgtagcgcaaagtatcctgtatggcacaaagatgttgaattatatgatgtgttagataaagatgatacacacattgcttccttttacttagatccattctcaagacctgctagtaaacgaggaggtgcatggatggacgaatgcctaacaaaagaaagattagataatggagacgtcgtaataccagtggcatatttagtttgtaatcaaacaccgccaactgaaagactccccagtctgatgagttttgaagaagtgaaaaccctatttcatgagttcggacatggcctacagcacatgcttacaaaagttgaatatccaaaagcagcagggatcaataatgtggaatgggatgcagttgaactccctagccaatttatggaaaattggtgcctagaagagaaaacaatcaacgacattgcaaagcattgggagactaagcaaccacttcctaatgaagaatttcaaaaattaagactaaatcaaaccttcaattcaggacttaatacgttaagacaaattcactttgctttaactgatatacgtctacataatctttggaacgataatctagggattactccagatgaacttagaaggaatctagctaagacaacatgtgtaatagagcctattccagaagatcaattcttatgcgcatttagtcatatttttgctggtggatattcagcaggttattactcttataagtgggctgaagtactaagtgcagatgcattttcggcgttcgaagaagctggattagacaatgaatcaaatattagattaattgggaaacgattcagggatacaatactcagccttggaggaagcaaatcaccaaatgaaatcttccaatcattcagaggaagacctgcaactagcgaagcattaatcaaacattgtggacttagaacagctatcaaataa

SEQ ID NO: 98051 - protein, 708 aa, Prochlorococcus marinus subsp. marinus str. CCMP1375
MQKLPALLIGKGLPLFEEITSLEIEQCIPTLLNILHKEFDVLENELKEKLISEKALTWEDLINPLYKIEEKLRWSWGIVSHLNGVSNSPELRKVYADQQPEVIRFGNRLGQSKVLFNALLNLFNKNKQSLDNTQLRILESELLSMKNRGVGLTGEDKKIFNSNSERLAELSNIFSNNVLDATKEWKLLLTKPEQIEGLPKRSLEAMAKAAKEADDIFQENRGEGPSAEKGPWLLGLDMPSYTTFITYSKNRHLREIIYKAYISRASSGKLNNQKLIEQILSIRKHQAQLLGYKNWAEISLSSKMASNVSQVEELLEELRSAAMPAAKEEIKRLELFAADETGTDFYKLAPWDVNYWSEKLRQKLFDLNQENLRAWFPLPQVLNGLFRLCERLFEISIKPCSAKYPVWHKDVELYDVLDKDDTHIASFYLDPFSRPASKRGGAWMDECLTKERLDNGDVVIPVAYLVCNQTPPTERLPSLMSFEEVKTLFHEFGHGLQHMLTKVEYPKAAGINNVEWDAVELPSQFMENWCLEEKTINDIAKHWETKQPLPNEEFQKLRLNQTFNSGLNTLRQIHFALTDIRLHNLWNDNLGITPDELRRNLAKTTCVIEPIPEDQFLCAFSHIFAGGYSAGYYSYKWAEVLSADAFSAFEEAGLDNESNIRLIGKRFRDTILSLGGSKSPNEIFQSFRGRPATSEALIKHCGLRTAIK

SEQ ID NO: 98052 - DNA, 2088 bp, Candidatus Blochmannia floridanus
  CDS (1)..(2088): transl_table=11
atgataaaactaaatcaggattttttatcaaatttgcctgcattttcttctatgaagttaagtgatgttagtggttttatacaaaaaaaaataaataactgttattctacagtggaaaaaattttatcaaaaaaattagttactatttcttggaaagaaatatatgatcctattatgtttgcagaaaatgagttaaaattagcttggtctcctatagttcatttgtatcgtgtaagaaatgatgagtcattacgattagtatatgagaataatttaatgtctatattagaatatagatattggataacgcataatactaatttatataaatattattgtttattgagtaagcaagattcttataaaagcttaaatattacgaaaaagatggcattaagaagaactttgattaattataaattatcaggagtctatttgtctggtgataaaaagaaatattatcgacgtattgtctcagaattaactaaacttagtttatattatgaaaataatgttttagacgcaacattaggttggaagaaattaattactaataaagatttattatctggaataccagaagataaattaaaaatagcatgtttagaagctcaacttaataatcaaaaaggttggttgtttacgttacattatcctagttattctgctattttattatattgtgataattcggaattgagagaggaattttattgggcttttaatactcgagcttcagatcaagggccgaatgcgaatcaatgggataatactgagattatgaatgaaattatatcattaagacataatttagcacaaacattaggatttaatagttatttggaaaaatctttacaagaaaagatgaataagaatcctcaacaaatacttaattttttaatgaatttgtcaaatcatattaagtatagtattagtgaagaatttttaaaaattcagaattttgcaaagaaatattattcttgtgtaaatatgcaaccttgggattatgaatattttcgtgagaaacaaaaaatgtatcttttttctgtttcagaaacagaattaagtgtttattttccagaagagaaagttttggatgtaatgtttgaaatagcaaagcgcttgtatggtattagtataaaaaaacgtaattatgtagatgtgtggcatcctagtgttcagttttttgatatttttgatttgaataataagaaatggaagggaggattttatttagatttatatttaagagacaataagtttggtggagcctggatggatgtatattcagatatgatgcacactgaaggtatgttatataaacaatatccgatagtatatttaatttgcaatttttctgttattgataaaaagtttggccaatcgtgtttattaacatttgataatgtaagcactctttttcatgaatttggacatgtattacatcatatattaacatcaataagtattccaagtatttctggtgttaatggagtttcattagatttggtagaggttcctagtcaatttatggaaaaattttgttgggatacaaatatattacgtgcaatgtctatgcattataaaacaaaaaaatctttatcaaataaaatgattaataatgtgcagaaattacaattatatcaatcaaaatataatttatttaaacaggttatatatgggttatttgattatcatattcatcatgaatatgatttaaatcaaaaaataccagtatttttggtatttaataaaataataaagagtatattttcatatccagttatgaatactgatagatttcctaatacttttactcatattttttctgatgattatgcagcagggtactatagttatttatggtcagatacattagcatcgaagatttggttaagttttaaaaaaatgaaattgaaaaatataaatttaagaaaattgatttttgatgatatgctttatttaagtatgtctacaaattgtgagaaatatttttctagtttttttaataaaacggttacgatacaatctcttttaaaatattataacatatctacattagataataatttttttaaattattatag

SEQ ID NO: 98053 - protein, 695 aa, Candidatus Blochmannia floridanus
MIKLNQDFLSNLPAFSSMKLSDVSGFIQKKINNCYSTVEKILSKKLVTISWKEIYDPIMFAENELKLAWSPIVHLYRVRNDESLRLVYENNLMSILEYRYWITHNTNLYKYYCLLSKQDSYKSLNITKKMALRRTLINYKLSGVYLSGDKKKYYRRIVSELTKLSLYYENNVLDATLGWKKLITNKDLLSGIPEDKLKIACLEAQLNNQKGWLFTLHYPSYSAILLYCDNSELREEFYWAFNTRASDQGPNANQWDNTEIMNEIISLRHNLAQTLGFNSYLEKSLQEKMNKNPQQILNFLMNLSNHIKYSISEEFLKIQNFAKKYYSCVNMQPWDYEYFREKQKMYLFSVSETELSVYFPEEKVLDVMFEIAKRLYGISIKKRNYVDVWHPSVQFFDIFDLNNKKWKGGFYLDLYLRDNKFGGAWMDVYSDMMHTEGMLYKQYPIVYLICNFSVIDKKFGQSCLLTFDNVSTLFHEFGHVLHHILTSISIPSISGVNGVSLDLVEVPSQFMEKFCWDTNILRAMSMHYKTKKSLSNKMINNVQKLQLYQSKYNLFKQVIYGLFDYHIHHEYDLNQKIPVFLVFNKIIKSIFSYPVMNTDRFPNTFTHIFSDDYAAGYYSYLWSDTLASKIWLSFKKMKLKNINLRKLIFDDMLYLSMSTNCEKYFSSFFNKTVTIQSLLKYYNISTLDNNFFKLL

SEQ ID NO: 98054 - DNA, 2061 bp, Bordetella pertussis Tohama I
  CDS (1)..(2061): transl_table=11
atgacccagaatcccctgcttgcgccggtcgccgacctggtcgactacgccgccgtcaaacccgaacacatcgtgccggccgtccaggccctggtggatatcgcccgcgcggcggtcgaacacgcggccgacccggccctgcccgccacctgggacgccgtggtggcgcccctggacagcgcatccgagcgcctgtggcgcgcctggtcggtggccggccacctgaacgcggtggtcaacacgcccgtgctgcgcgaggcctacaacgccgcgctgccgctggtcaccgaattctccacctgggtcggcctgcacgaaggcctgtaccgccagtaccagcgcctgcaggccgccgaggatttcgcggcctggccgccggtgcgccgccgcgtggtcgagctggcgctgcgcgacttccgcctcagcggcgtcgagctgcaaggggccgcgcgcgaacgctacgccgagatctccgaccgcgaggcccaggcatcgcagaagttctccgagaacgtgctcgacgccatcgacgcgtggtcgctgctggtcgacgaccaggcgcgcctggacggcatcccggccgacgtgctggccgcggcgcgcaaggcggccgaggacgatggcgccaccggctggaagctgacgctgaaaatgccctgctacctgcccgtcatgcagtacgcgcgcgaccgcgccctgcgcgaaaccctgtaccgcgcgtacggcaccgtcgcgtccgagcatggcgacgccgcctacgacaactcgccgctgatcgaagaactgctgcagctgcgcgccgacgaagccgggctgctgcagtaccccaccttcgccgccctgcgcctgcagacccgcatggcgcgcgacgccaccgaagtcgtggacttcctgcgcgacctggcgcgccgcgccaagccgtacgccgaacgcgacctggccgaattgcaggccttcgccgccggcgagctgggcctggccgagctgcagccctgggacgtgcccttcgccgccgagcggctgcgcgaatcgcgctatgcctactcggaagacgagatcaagcagtacttcaccgagccgcgcgtgctggcgggcctgttcgaggtcatcgagacgctgttcgacgtgcgcctgcgcgaagtgccggtgtcgtcctggcatgccgacgtgcgcggcgtgcgggtcgaaagcccggacggcgcgacgctggggcatctttacctcgacctgtacgcgcgcgccggcaagcaaagcggcgcctgggtcgacagcgagcgcagccgacgccgcgtgcaaggcgatctgcagacgccggtcgcctacctgacgtgcaacttctcgcgccccaatggcgacaaggccgcgctgctcacgcacgatgacgtcatcacgctgttccacgaaaccggccacgcgctgcacgccctgctgtccgaagtggacgagcccggcgcggcggcgttcgccagcgtcgagtgggacgccatcgaactgccgtcgcagttcatggagaacttctgctgggaatggagcgtggtgcagaagctgtcggcccatgtcgaaaccggccagccgctgccgcgcgatctctacgaccgcctggtggcggcgcgcaacttccagagcggcatgcagaccgtgcgccagatcgagttcgcgctgttcgacatgatgctgcacgaccgcccgcaaggcgcgcctatcgccgacgtgctggcgctgctgcagcaggtgcgccaggaagtcgcggtgctgttcccgcccgcgtggcatcgcctgccccacagcttctcgcacctgtttgccggcggttatggcgccgggtactacagctacaagtgggccgaggtgctgtcggccgacgcgtacgaagccttcgaggaagccgcccgccagggcgagccggccgccaccacgctggacggcgccaccggcgcgcgctttcgcaaggaaatcctcgccgtcggcggcgcccgccccgccgccgactccttccgcgccttccgcggccgcgaaccccgcatcgacgccctgctgcggcacagcggcatgcaagcctga

SEQ ID NO: 98055 - protein, 686 aa, Bordetella pertussis Tohama I
MTQNPLLAPVADLVDYAAVKPEHIVPAVQALVDIARAAVEHAADPALPATWDAVVAPLDSASERLWRAWSVAGHLNAVVNTPVLREAYNAALPLVTEFSTWVGLHEGLYRQYQRLQAAEDFAAWPPVRRRVVELALRDFRLSGVELQGAARERYAEISDREAQASQKFSENVLDAIDAWSLLVDDQARLDGIPADVLAAARKAAEDDGATGWKLTLKMPCYLPVMQYARDRALRETLYRAYGTVASEHGDAAYDNSPLIEELLQLRADEAGLLQYPTFAALRLQTRMARDATEVVDFLRDLARRAKPYAERDLAELQAFAAGELGLAELQPWDVPFAAERLRESRYAYSEDEIKQYFTEPRVLAGLFEVIETLFDVRLREVPVSSWHADVRGVRVESPDGATLGHLYLDLYARAGKQSGAWVDSERSRRRVQGDLQTPVAYLTCNFSRPNGDKAALLTHDDVITLFHETGHALHALLSEVDEPGAAAFASVEWDAIELPSQFMENFCWEWSVVQKLSAHVETGQPLPRDLYDRLVAARNFQSGMQTVRQIEFALFDMMLHDRPQGAPIADVLALLQQVRQEVAVLFPPAWHRLPHSFSHLFAGGYGAGYYSYKWAEVLSADAYEAFEEAARQGEPAATTLDGATGARFRKEILAVGGARPAADSFRAFRGREPRIDALLRHSGMQA

SEQ ID NO: 98056 - DNA, 2088 bp, Prochlorococcus marinus subsp. pastoris str. CCMP1986
  CDS (1)..(2088): transl_table=11
atggaaacttcaatttttaattacggagaattaccagaatttaacaaattttcttccgatagaattaatcaagaatttccaggcgtaatagaaaagataaatctagatttcaaaaaaattgaaaaatttttatctaattacttagaacaagaaaatctagaatgggacaaagtaattaatcctttaaatgaagtcaatgagattctaaggtggagttggggagttataagtcatcttaatggagtaaaaaattctgaaagcttaagagaaatttactcaaagtttctacctgaaattattaatctaagtaataagtttggacaaagtaaaattatttatagtgctcttttaaagcttaaaaaaacaaatgattttgatgaaatcaaaaatagaattctagaaaaagaaattctcgaaatggaacatagaggtatttcattaaatacagatacccagaaagaattcaatgttatttctgaaaagcttggaaaactttctacaaaattcagcaataatgttttagatgctactaattcttggtcattaatcctaaatgataaatctcaaatagatggagtcccagaaagggttttagaactaatgtcaatatcagctcacaaatccttaaataaagaaggagaagctgatgcaaaaaatgggccatggagattaagtttagatattccgacctataccgcgtttatgacatatgccagtgaccgtaatctcagggaaaaattatataaagcttttgtaagcagagcctctcatggagaaaaaaataactctcaaataattgaagaaattctatctcttaggactaaacaggctaaacttcttggttacgaaagctgggcagaattaagcctttcaacaaaaatggctaaggaaattaataatgttgaaaaacttttagaggagattagaaagcctgcctttaaaacagccaaaaatgaattagttagacttaataagttttcaaaagataatggattccctaactctgaaaatcttcaatcatgggacattagctattggtcggagcttctcagaaaggaaaaacttaatttagatcaagaatcacttagaccctggttccctctgaatgatgttttaaaaggtctttttaaacttagtgaaaagctcttcgacatcaaagtaattgaagccataaatgaagctcctatatggaatgatgacgttttgttttttaatatcctaaataaagatgataaaaaaatagcttcattttatctggatccctactctcgtcccgagtcaaagaggggaggtgcctggatggacgaatgccttaacagaaacaatattggtagaattacattacctgttgcttatttagtttgtaatcaaaccccgccatccaaagacaaaccaagtttgatgagttttgatgaagttcaaaccttgttccatgaatttggtcatggtcttcaacatatgcttaccacagtaaatcttccacaagcagccggtattaataatgtagaatgggatgctgttgaacttcctagtcaatttatggaaaactggtgttttcacaaaaacactttattaaatattgccaaacactataaaacaggggagaaattatctgatgagaatttcgaaaaattagtaaagaatagaacttttaattgcggaatggctactttaagacaactacattttgcaattacagatataagattgcatagcaatattaatagtaatcagggtaaaaattctgatgagataagaaaagaaattgccagaaatacaacggtaatcgagcctattcgagaagataagttcctttgttgctttagccacatatttgcaggaggttattccgctggatattattcttataaatgggcagaggttttaagcgccgatgctttttctatgtttgaagaggctgatttagaaaataatcaaaatataaaagtcataggtaaaaaattcaaagatacaattttaagtcttggtggaagtttctctcctttagaggtatttaaattatttagagggagagaacctaaaaccgattctttgataagacacttaggtctatcatctgttaattaa

SEQ ID NO: 98057 - protein, 695 aa, Prochlorococcus marinus subsp. pastoris str. CCMP1986
METSIFNYGELPEFNKFSSDRINQEFPGVIEKINLDFKKIEKFLSNYLEQENLEWDKVINPLNEVNEILRWSWGVISHLNGVKNSESLREIYSKFLPEIINLSNKFGQSKIIYSALLKLKKTNDFDEIKNRILEKEILEMEHRGISLNTDTQKEFNVISEKLGKLSTKFSNNVLDATNSWSLILNDKSQIDGVPERVLELMSISAHKSLNKEGEADAKNGPWRLSLDIPTYTAFMTYASDRNLREKLYKAFVSRASHGEKNNSQIIEEILSLRTKQAKLLGYESWAELSLSTKMAKEINNVEKLLEEIRKPAFKTAKNELVRLNKFSKDNGFPNSENLQSWDISYWSELLRKEKLNLDQESLRPWFPLNDVLKGLFKLSEKLFDIKVIEAINEAPIWNDDVLFFNILNKDDKKIASFYLDPYSRPESKRGGAWMDECLNRNNIGRITLPVAYLVCNQTPPSKDKPSLMSFDEVQTLFHEFGHGLQHMLTTVNLPQAAGINNVEWDAVELPSQFMENWCFHKNTLLNIAKHYKTGEKLSDENFEKLVKNRTFNCGMATLRQLHFAITDIRLHSNINSNQGKNSDEIRKEIARNTTVIEPIREDKFLCCFSHIFAGGYSAGYYSYKWAEVLSADAFSMFEEADLENNQNIKVIGKKFKDTILSLGGSFSPLEVFKLFRGREPKTDSLIRHLGLSSVN

SEQ ID NO: 98058 - DNA, 2148 bp, Prochlorococcus marinus str. MIT 9313
  CDS (1)..(2148): transl_table=11
atgcctgttgctgtgaacgaaataaagtcatcagccctcctccagggtgaaggaatcccaaacttcactgccattactgctcaacaagttcaggatcacatgcctgaacttctctgtgctcttaacaaacaattcagccggctggaacaagacatagacaaagttttggtgtctggcaagagcattaattgggaacaagtcatgtctcctctgcatcggctgcaagagcaattgcgttggagctggggagtcgtatcccatctcaacggcgtctgcaatacctccgaattacggcaagctcacgctgcacaagaaccagaggtggtgcgctttggaaaccttatgggccaaagccaaacacttcatcgtgccctgcgccggcttaaagaccagacctcaaggccattgctggattcgactcaacagcggattttgaacgcggaattactctccatggatcaacgaggcgtgggtctcgatgacgacgcacagcaggcttttaatacaaccagtgaacaactggccgagctgtcgacctgcttcagcaatcacgtcctggatgcaacccagggatggagcctgctcctcaatcgatcagcacaagttgaaggactgccgcagagggccttggaggttttgtccttagcagccaagcaagccggagatcaccgagaagacggtggagaacctacagcggagcagggtccctggcgattaggtctagatatgccccgctacatccccttcatcacccatgcaaaagatcgagggctacgtgaaacgctctacaaggctcatgtgagtagagcgagtgcaggtgagttaaacaatcaaccattgattgaagagctgctaagccttcggcttgagcaagctcaaaggcttggctacaggaactgggctgaactcagcctggccagcaaaatggccgagggcgttgaggccgtcgagcagttgcttgatgagttgcgtgctgccgctttacccgcagcccaaaaggagttaattgagctcgaggcctgtgccaaaaaacatggagctccagaggccagccagctcaaaccatgggatgtgaacttctgggctgaacggctgaggcaagagcgctttgaccttgatcaagaagcgctgcgcccttggtttcccctgccacaggttttggaaggtttgttcggactttgtgaacgtctttttggcattcgcattcaaagtgccgacggcgaggctccgatctggcatcaagacgtgcgttatttccgggtgttgaatgccaatggttctgacctggcagcgttctacctcgatccctatagccgaccagccagcaagcgagggggggcatggatggacgaatgcctgacacgcagcaaaagcctcgagggccaatcgattcttcctgtggcctatttgatttgtaaccagactccaccgcaagcagagacgccaagtctgatgagcttcgatgaggtggagactttgttccatgagttcggccatggccttcagcacatgctcacgaccgttgagtatccacaggctgcaggaatcaacaacgtggaatgggacgcagtggaactgcctagccagttcatggagaactggtgcctcgatcgcaccacgttgatggggatggcacgtcactggcgtactggcgaaccgcttccggaggaggagttcgcaaaattgcgctccagccgcacctttaatgccggtttggcaactctgcgccaggtgcatttcgctctcactgatctgcgtttgcatagttgctggacaccagatctcggcgtgaccccagatcagctgcgccgtcagattgctcagaccaccacggtgatgcttccgatcgccgaagatcaattcctctgtagctttggccacatcttcgccggtggttattccgccgggtactactcctacaagtgggcagaagttcttagtgctgatgcctttgctgcctttgaggaagctggtctggaacttgaagatcaagttcgactcactggcgctcgctttcgcgacacagttctcagtttgggaggtagccattccccagcagacgtctatgagcaattccgtggacgaccagcgaccactgaggcattgattcgccattccggcttagccgcaagcgctgcggatcagtga

SEQ ID NO: 98059 - protein, 715 aa, Prochlorococcus marinus str. MIT 9313
MPVAVNEIKSSALLQGEGIPNFTAITAQQVQDHMPELLCALNKQFSRLEQDIDKVLVSGKSINWEQVMSPLHRLQEQLRWSWGVVSHLNGVCNTSELRQAHAAQEPEVVRFGNLMGQSQTLHRALRRLKDQTSRPLLDSTQQRILNAELLSMDQRGVGLDDDAQQAFNTTSEQLAELSTCFSNHVLDATQGWSLLLNRSAQVEGLPQRALEVLSLAAKQAGDHREDGGEPTAEQGPWRLGLDMPRYIPFITHAKDRGLRETLYKAHVSRASAGELNNQPLIEELLSLRLEQAQRLGYRNWAELSLASKMAEGVEAVEQLLDELRAAALPAAQKELIELEACAKKHGAPEASQLKPWDVNFWAERLRQERFDLDQEALRPWFPLPQVLEGLFGLCERLFGIRIQSADGEAPIWHQDVRYFRVLNANGSDLAAFYLDPYSRPASKRGGAWMDECLTRSKSLEGQSILPVAYLICNQTPPQAETPSLMSFDEVETLFHEFGHGLQHMLTTVEYPQAAGINNVEWDAVELPSQFMENWCLDRTTLMGMARHWRTGEPLPEEEFAKLRSSRTFNAGLATLRQVHFALTDLRLHSCWTPDLGVTPDQLRRQIAQTTTVMLPIAEDQFLCSFGHIFAGGYSAGYYSYKWAEVLSADAFAAFEEAGLELEDQVRLTGARFRDTVLSLGGSHSPADVYEQFRGRPATTEALIRHSGLAASAADQ

SEQ ID NO: 98060 - DNA, 2106 bp, Synechococcus sp. WH 8102
  CDS (1)..(2106): transl_table=11
atgagcacctccatgccctccgccctgcttgaggggcacggccttccctgtttcgagcagatcacaccggatctggtccagcaggacatccccgtcctgctggctcaacttgaacagcagttcacagaactggagacgacgcttcagtccaggctggatagtggcgcctccatcagctgggaggaggtgatgcagccgatgcggcgcatcggagagcgtctccgctggagttggggtgtgatctcccacctcaacggcgtctgcaattcgccggagctgcgtgaagcccacgcggctcaacaacctgaggtcgtgcgacttagcaaccgcctgggtcagagcaaggtgctgcatcaggttctctgccgcctgcaggacgagccgagcgagcccctcagcgccacccgccagcgaatactcgactccgaactgctgtcgatgcaacagcggggtgtcggtctcgatggcgagcatcagaaagctttcaaccaagccagcgaacgtctcgcagccctctccaccagctttggcaatcacgttcttgatgccacccagcaatggaccctcaagctcaccaatcccgagcaggtgcaaggtctgcccaagcgagcactggaggccctggcggccgcagcacgggattccggtgacgcagaagccactgccgaggggggaccgtggctggtgggtctggacatgccgagatacatcccggttctcacccacgccgatgacaggtcactgagggagaccgtttatcgagcccatgtcagccgtgccagccagggagagctggacaatgctccactgatcgaggaaatcctcggactgcgccgggagcaggcccagcggcttggctactcccattgggccgaactcagccttgccagcaagatggccgacgacgttccggccgtcgaagcgctgctggaggagctgcgtgccgcggcctatccagccgccgagacggagctggagcaactcaaggcctgcgccagccgacagggtgcagccgaagccgacgccctggccccctgggacatcacctattggtcagaaaaactgcgacgcgaacggtttgatctggaccaggaagccctgcgcccatggttcccgctgcctcaggtgctcgatggcctgttcggcctttgttcacgtctgtttgatgtggagatcacgccgggagatggcgaggcgcctgtgtggcataacgacgtgcgtttctttcacgtccgtcgccgtggtggcgaaccgatcgccgcgttttatctggatccatacagccgtcccgccagcaaacgcggtggagcctggatggatgagtgcctcgggcgtcaccgcactagtgacggcagccttgtgctgcccgtggcttacctgatctgcaaccagactccccccgttggagaagcccccagcctgatgagcttcgaagaggtggagaccctcttccacgaattcggccatggtctgcagcacatgctcaccaccgtcgaggaaccggaagccgccggcatcagcaatgtggaatgggatgcggtggaacttcccagtcagttcatggagaactggtgtctggaccaaagcaccttgatgggcatggcccgccactggcagaccggagaacctctgccccaggacgaggtgaacaaactccgcaacagccgcaccttcaatgccggactggcaaccttgcggcaggtgcacttcgccctcaccgatctgcggctgcacagccagtggacgccgcagctgggactgagtccagacgagttacgtcgcgacatcgccaacaccaccaccgtgatgcacccgatcccggaagatcgcttcctttgcgccttcgggcacatcttcgcggggggatattccgccggctactactcctacaaatgggccgaggtgctcagtgccgatgcctatgccgcctttgaggaggtcggcctcgaccaggaggatcaggtgcgtgccaccggtgcccgcttccgggacacggtgctgagccttggcggcagccgcgcgccagctgaggtgttcaaggccttccgcggtcgagtctccagcagcgaggccctgatccgccattcgggtcttcaggcgacctga

SEQ ID NO: 98061 - protein, 701 aa, Synechococcus sp. WH 8102
MSTSMPSALLEGHGLPCFEQITPDLVQQDIPVLLAQLEQQFTELETTLQSRLDSGASISWEEVMQPMRRIGERLRWSWGVISHLNGVCNSPELREAHAAQQPEVVRLSNRLGQSKVLHQVLCRLQDEPSEPLSATRQRILDSELLSMQQRGVGLDGEHQKAFNQASERLAALSTSFGNHVLDATQQWTLKLTNPEQVQGLPKRALEALAAAARDSGDAEATAEGGPWLVGLDMPRYIPVLTHADDRSLRETVYRAHVSRASQGELDNAPLIEEILGLRREQAQRLGYSHWAELSLASKMADDVPAVEALLEELRAAAYPAAETELEQLKACASRQGAAEADALAPWDITYWSEKLRRERFDLDQEALRPWFPLPQVLDGLFGLCSRLFDVEITPGDGEAPVWHNDVRFFHVRRRGGEPIAAFYLDPYSRPASKRGGAWMDECLGRHRTSDGSLVLPVAYLICNQTPPVGEAPSLMSFEEVETLFHEFGHGLQHMLTTVEEPEAAGISNVEWDAVELPSQFMENWCLDQSTLMGMARHWQTGEPLPQDEVNKLRNSRTFNAGLATLRQVHFALTDLRLHSQWTPQLGLSPDELRRDIANTTTVMHPIPEDRFLCAFGHIFAGGYSAGYYSYKWAEVLSADAYAAFEEVGLDQEDQVRATGARFRDTVLSLGGSRAPAEVFKAFRGRVSSSEALIRHSGLQAT

SEQ ID NO: 98062 - DNA, 2040 bp, Chromobacterium violaceum ATCC 12472
  CDS (1)..(2040): transl_table=11
atgagccagaaccccttacttgatttctccgacctgccgcgcttcgacgccatcaagccggagcacatcacccccgccctcgatgtattgctggccgacgcccgcgccgccatcgatgccgtcgtcgccgccggcggagacagctgggacgccgtggtggagccgctgaccgacgccaccgagaaactcggccgcgcctggggcgtggtcggccatctgaacggcgtgatgggcaacaccgagggcctgcgcgaggcgtacaacgccgaaatcccgcgcatttccgccttcttcaccgaactggggcagaacctcgacctgttcgcccgcttcaaggcggtggcggccaaccctgaattcgccgccgccagcgccgcgcagaagaaagtgatcgaaaacgacctgcgcgacttccgcctggccggcgccgagctgccggacgcgcaaaaggcgcgcttcgccgaactgtccagccggctggccgagctgtccaaccagttttcgcagcacgtgatggacgccaccgacggcttcagcctgtacatcgaagacgttgccgagctggccggcattccagaggacacgttggccatgtacgccgcgatggccgaggccgacggccagccgggcaaatacaagctgggcctgcaattcccgctgctgttcccggtgctgcagtacgccgacaaccgcgctttgcgcgaaaaactgtacgaagccaacgccaagcgcgcgtcggagttcggtccggccgagcaggacaacggcccgctgatccgcgagaagctgaagctggcggccgaggaggcgcaactgctgggcttcgccaactacgccgagctgtcgctgtacaccaagatggcggaaagcccgcagcaggtgatcgccttcctgcgcgacctggcccgccgcgccaagccctacgccgagcaggaccgcgccgagctggaggccttcgcccgcgacgagctgggcctggacgcgctgcaggcctgggacatcagctacgccagcgagaagctgcgcgtcgcccgctatgccttctccgagcacgaagtgaagcagtacttccccgagcccaaggtgctgcagggcctgttcggcgtggtcggcaccctgtacggcgtgcgtttcgccgagcgccgggtcgccacgtggcaccctgacgtgcgctacttcgagatcttccagggcgacaccctgctgggcggtttctacctcgacctctacgcccgcgacggcaagcgccccggcgcgtggatggacgacgtgcgcggccgccgccgcaagggcgagcaggtgcagaccccggtggcctacctggtgtgcaacttcagccgcccggtgggcgacaagccggcctacttcacccacgacgaggtgatcaccctgttccacgagtgcggccacggcctgcaccacctgctgacccgcatcgaggtggccggcgtggccggcatcagcggcgtggagtgggacgccgtcgagctgcccagccagttcatggaaaacttctgctgggagtgggacgtgctgcagggcatgaccgcgcacagcgaaagcggccagccgctgccgcgcgagctgtacgacaagatgatcgccgccaagaacttccagtccggcatgcagatggtgcgccagctggagttttccttgttcgacatgctgctgtacaccgccggcaatcccgacagcgtggactggctggcgctgctggagcaggtgcgcgacgaggtggcggtcaaccgtccgccggcctacaaccgcttccccaacagcttcagccacatcttcggcggcggctacgcggccggctactacagctacaagtgggcggaagtgctgtccgccgacgcctacgccgcgttcgaggaggccggcggcgccaatccgcaggtgggccgccagttctgggacgaaatcctggcggtcggcggcagccgcccggcgctggagtcgttccgcgccttccgcggccgcgatcccgaaatcgacgcgctgctgcgccactccggcatggcgccggaggcggcgtaa

SEQ ID NO: 98063 - protein, 679 aa, Chromobacterium violaceum ATCC 12472
MSQNPLLDFSDLPRFDAIKPEHITPALDVLLADARAAIDAVVAAGGDSWDAVVEPLTDATEKLGRAWGVVGHLNGVMGNTEGLREAYNAEIPRISAFFTELGQNLDLFARFKAVAANPEFAAASAAQKKVIENDLRDFRLAGAELPDAQKARFAELSSRLAELSNQFSQHVMDATDGFSLYIEDVAELAGIPEDTLAMYAAMAEADGQPGKYKLGLQFPLLFPVLQYADNRALREKLYEANAKRASEFGPAEQDNGPLIREKLKLAAEEAQLLGFANYAELSLYTKMAESPQQVIAFLRDLARRAKPYAEQDRAELEAFARDELGLDALQAWDISYASEKLRVARYAFSEHEVKQYFPEPKVLQGLFGVVGTLYGVRFAERRVATWHPDVRYFEIFQGDTLLGGFYLDLYARDGKRPGAWMDDVRGRRRKGEQVQTPVAYLVCNFSRPVGDKPAYFTHDEVITLFHECGHGLHHLLTRIEVAGVAGISGVEWDAVELPSQFMENFCWEWDVLQGMTAHSESGQPLPRELYDKMIAAKNFQSGMQMVRQLEFSLFDMLLYTAGNPDSVDWLALLEQVRDEVAVNRPPAYNRFPNSFSHIFGGGYAAGYYSYKWAEVLSADAYAAFEEAGGANPQVGRQFWDEILAVGGSRPALESFRAFRGRDPEIDALLRHSGMAPEAA

SEQ ID NO: 98064 - DNA, 2025 bp, Chromobacterium violaceum ATCC 12472
  CDS (1)..(2025): transl_table=11
atgaacgccaatcccctgctgcaagactggaccaccccgcaccagttgcccccgttcgagcagatccgtcccgagcacttcgaaccggccttcgacgcgctgttcgccgaacacctggccgagatcgacgcgctggcggcgcgggcggaacccgccgacttcgacaacaccgccgccgccttcgatcgctgcggcctgaagctggagcgcgcccaactgctgctggacaacctgaccgcgtcggaaacctcgcccgagctgcaggaagtggagcgccggatggcgcccaagctggccggccaccgcagccgcgtatacatgcacgagggtttcttcgcccggctcgacgccgtccatgcccggcgggacagcctggggctgagcgaggaacagggccggctgctggacctgatccaccgcgacttcgtccgcgccggcgccaagctgcaaggcgacgaccgccggcgttacgccgacatcgtgtcccggctggccgaactgaccaccgccttcagccaaaacgtgctggccgacgaaagcgaatacgcgctgcagctgggcgaggccgacctcgccggcctgcctcccttcctgctggacgccgcccgcgcagcggccgaagcgcgcggcttgccgggctgggcgatcacgctgtcgcgctcgtccatcgtgcccttcctcaccttctccgcccgccgcgagctgcgcgaaaccgcttggcgcgcctggaccggccgcggcgaacacccggagcgcgacaaccgtccgctggccaggcagatcctggcgctgcgcgtcgagcaggccgggctgctcggctacgccagcttcgccgactatgcgatcgccaaccgcatggccggcaccccggccgcggtccacgcgctgatggaccaggtgtgggagccggccaaggcccgcttcgaagcggaaaaagcgatgctgcgcgaagaggccgccaagctcggcgagccggccgacatccagccctgggactggttttacctggcggagaaagtgcgtatcgcccgctacgcgctggacgacgccgagatcaagccctacttcggcctggacaatatgatcgccgcgatgttcgacgtcgccggccgcctgttcggcctcgagttcgccgaacggcacgacctcaagctctaccaccccgacgtgcgcgcctgggacgtcagccgcggcggcaaggtgatcggcctgttcctaggcgacaactacgcccgccagaacaagcgcggcggcgcctggatgcatgtctaccgctggcaggcccgcaacggcggcgtggcgctgcccatcgtcgtcaacaacaacaacttcgccaagtccggccgcggccagacgctgctgagcttcgacgacgtgcgcacgctgttccacgaattcggccacggcctgcacggcctgctgtccgatgtcgaataccggctgctggccagccccaactgcccatgggactacgtcgagctgccgtcgcagctgatggagaactgggcgctggtgccggaggtgctggaaaaacacgcccgccacgcgcaaaccggcgcggccatcccggccgaactggtcgccaagatcaaggcggcgcgccacttcaaccagggcttcgaaacggtgcgctacgccgcgtccacgctgatcgacctggcgctgcacgagcgcgccgacgccgagggcgtcgacatcgccgccttcgaggcggcggagcgcgagcggctgggcatcccgccggcggccggcatgaatcaccgcccgccccacttcggccatatcttctccgacgacgcctacgccgccggctactacgtctacatgtgggcggaagtgctggaagccgaagcgttcgccgcgttcgaggaagccggcgacccgtttgatccggaactggcggacaagctgtaccgccacatctacagcgccggcgacgcccgcgagcagcgcgccgccttccgcgccttccgcggccgcgatccgcaagcggaagcgatgctgaaaaaccgcggcctgctgtaa

SEQ ID NO: 98065 - protein, 674 aa, Chromobacterium violaceum ATCC 12472
MNANPLLQDWTTPHQLPPFEQIRPEHFEPAFDALFAEHLAEIDALAARAEPADFDNTAAAFDRCGLKLERAQLLLDNLTASETSPELQEVERRMAPKLAGHRSRVYMHEGFFARLDAVHARRDSLGLSEEQGRLLDLIHRDFVRAGAKLQGDDRRRYADIVSRLAELTTAFSQNVLADESEYALQLGEADLAGLPPFLLDAARAAAEARGLPGWAITLSRSSIVPFLTFSARRELRETAWRAWTGRGEHPERDNRPLARQILALRVEQAGLLGYASFADYAIANRMAGTPAAVHALMDQVWEPAKARFEAEKAMLREEAAKLGEPADIQPWDWFYLAEKVRIARYALDDAEIKPYFGLDNMIAAMFDVAGRLFGLEFAERHDLKLYHPDVRAWDVSRGGKVIGLFLGDNYARQNKRGGAWMHVYRWQARNGGVALPIVVNNNNFAKSGRGQTLLSFDDVRTLFHEFGHGLHGLLSDVEYRLLASPNCPWDYVELPSQLMENWALVPEVLEKHARHAQTGAAIPAELVAKIKAARHFNQGFETVRYAASTLIDLALHERADAEGVDIAAFEAAERERLGIPPAAGMNHRPPHFGHIFSDDAYAAGYYVYMWAEVLEAEAFAAFEEAGDPFDPELADKLYRHIYSAGDAREQRAAFRAFRGRDPQAEAMLKNRGLL

SEQ ID NO: 98066 - DNA, 2016 bp, Chromobacterium violaceum ATCC 12472
  CDS (1)..(2016): transl_table=11
atgaacaacccgctgctgcaagcctgggacacgccacaccagctgccgccgttcgatctcattcgcgccgagcacttcgcgcccgccatcgagcagttgatggccgagcacaggcgggccatctccgccatcgccgcccagaccggccccgtcagcttcgccaacaccgcggaagcgctggacgccgccgcgctgccgctgaaacgcgtgacgctggtgctgcacaatctgtgcagttcgcactccagcccggaactgcgcgccgtcgagcgcgagctggcgccgcggctggccgcccaccacagcgccattttcctggacacgcaactgttcgcccgactggacgaggcgatgcgcgcggcgcccggctgggagttgagcgaggaacaacgccgcctgctgcagcgctggcacctggacttcaccttggccggcgcccggctgcaaggcgaagcgaggcgcgaattcgccgattgcgtcgccgagctggcgtcgctgtccgccgccttcggccagaacgtgctggccgacgaaacggagtacgcgctccaattgcagaacgaggccgatctcgccggcctgcccggctggctgcgggacgcgtcggcccgcgccgcgcgcgagcgcggcttggacggccacgccatcacgctggcgcgctccagcacggtcgccttcctcacccactccagccgcgccgacctgcgccaggcgctgtggcgcgcctggacttcgcgcggaacgacacaggcgcgcgacaaccgccctctgatccgccgcatgctgcaactgcgccaacgccaggcccgtctgctcggctacgccaattatgccgattacgcgctgagcgaccgcatggcgggttcgccgcaagcggtgtaccggctgctggagccgacctgggaagccgcgctcgcccagttcgcgcgggaaaaggcgctgttgcaggagacggcccggcgcgaggggctgcccgatgacatcgcgccctgggactggcgctatctggcggagaaggtcaggctggagcgctacgcgctggacgacgccgaaatcaagccctacttcagcctggacaatatgatcgccgcaatgttcgatgtcgccggccgtctgttcggcctgagcttcgccgagcgcggcgacctgccgcgctaccacccggacctgcgcggctgggaggtgctgcgcgacggcgccgtcatcggcgtgttcctcagcgacaacttcgcccgccccggcaagaagggcggcgcctggatgagcgtctaccgcgcccagggccgccatggcggactgtctctgcccatcgtggtcaacaacaccaacttttccaagggcgagccgacgctgctgggcctggacgacgtgcgcacgctattccatgaattcggccacgcgctgcatggtctgctgtcggacgtagactatcagcgcctgtccggcacccaggtgctgcgcgacttcgtcgagctgccgtcccagctgatggaaaactgggcctggacgccggacatcctggacaggcacgcgcggcacgcagaaaccgaccgtcccatgccagaggcgctgcgcgcccgcattctcgccgcgcagaacttccagcagggctatgccaccgtgcgctacacgatatcggcgctgctggatctggcgctgcaccaggaggccgacggcgtcgacgaccccgcggccttcgaaacggaactatgccagcattacggcctgccggcggaagccgggcttgcccactcgctgccccacttcaaccacctgttcaacggcggctacgcggctggctactacgtttacctatgggcggaagtgctggaggccgaagctttcgcccgcttcgaggaaagcggcgacctgttcgatccggagctcgccgcctcgctgtgccgccacatctacagcgcaggcaacgcccgcaaccccaagcaagccttccaggctttctccgggcgtgaaccatccgtgcaggccatgctgaaaaaaagagggttgaccgtctag

SEQ ID NO: 98067 - protein, 671 aa, Chromobacterium violaceum ATCC 12472
MNNPLLQAWDTPHQLPPFDLIRAEHFAPAIEQLMAEHRRAISAIAAQTGPVSFANTAEALDAAALPLKRVTLVLHNLCSSHSSPELRAVERELAPRLAAHHSAIFLDTQLFARLDEAMRAAPGWELSEEQRRLLQRWHLDFTLAGARLQGEARREFADCVAELASLSAAFGQNVLADETEYALQLQNEADLAGLPGWLRDASARAARERGLDGHAITLARSSTVAFLTHSSRADLRQALWRAWTSRGTTQARDNRPLIRRMLQLRQRQARLLGYANYADYALSDRMAGSPQAVYRLLEPTWEAALAQFAREKALLQETARREGLPDDIAPWDWRYLAEKVRLERYALDDAEIKPYFSLDNMIAAMFDVAGRLFGLSFAERGDLPRYHPDLRGWEVLRDGAVIGVFLSDNFARPGKKGGAWMSVYRAQGRHGGLSLPIVVNNTNFSKGEPTLLGLDDVRTLFHEFGHALHGLLSDVDYQRLSGTQVLRDFVELPSQLMENWAWTPDILDRHARHAETDRPMPEALRARILAAQNFQQGYATVRYTISALLDLALHQEADGVDDPAAFETELCQHYGLPAEAGLAHSLPHFNHLFNGGYAAGYYVYLWAEVLEAEAFARFEESGDLFDPELAASLCRHIYSAGNARNPKQAFQAFSGREPSVQAMLKKRGLTV

SEQ ID NO: 98068 - DNA, 2088 bp, Porphyromonas gingivalis W83
  CDS (1)..(2088): transl_table=11
atgctcacagcatgtaacggcagccgtaaaggagatgccaacctctccgacaatcctctgctgcaatcgagtgctctcttcatggaagcacccgaattcgacaaaatcaaaaccgaacacttcctgcctgctttcgaagccggcatggagcagcagttggccgagatcgattcgatcgtgaacaactccgaagctcccactttcgagaatacgctcgtagccatggaacgttcgggacagacactcaaacgtgtttccaatgtcttcttcggtctcacgggagccaatacgaacgatgaactacagaaaatcgaagaaaaagtatcgccccttttggctgcacacagcgatgccatctaccttaacgacaaacttttccaacgcgtaaaagccgtttacgaaagtgaccaatccgccatcgaacccgagggacaaaagttgatccaagagtattacgatgcctttgtccgtgccggtgccaatctgagtgccgaggacaaggccaagctcatggaactgaacaaggaagaggcttcgctgacgaccgaattcggcaacaagctgatcgcagccaccaatgccgcagcggtaatcgtagggagcaaagactcgctcgatggtcttagcgaaacggagatagccaaagctgcaagcgatgccaaagctgccggccacgaaggcaaatacctgttgaatatcaccaataccactcagcaggattatctctcggtactgaacgaccgtaccattcgtcagcgtgtattggaggcctctatccatcgcacggacaaaggcgatgccaacgacacgcagtccatcgtacttcgtctggccaggctccgcgcacagaaggctcgccttctcggcttccctaattatgccgcatggaagcttcagaatcagatggctaataatccggagacagtgctggcttttgtcaagtcgatagctacgccctatgctccacaggcacagaaagacgctgccgaacttcaggcttatgcccgctccaaaggtttcgaaggagaccttacggctgctgactggaactactatgccgataagctccgcaaggaaaagttcggtctggatgagaacgaagtgaagcagtactttgtgacggacagcgtcctcaagaatggagtattctatgctgccaacaagctctatggcctcacattcaaggagcgtaccgatctgcccgtctatgccgaagatgtacgcgtattcgatgttatcgaccaagatggcaagcagctcgcactcttctacaccgacctctatcgccgtccgaccaagagcggaggtgcatggatgagcaactgggtagaccaaagctacctgctgaaccaaaagccggtgatctacaatgtttgcaactatgccaaaggcgttgatggtcagccctctctcatcaactacgatgaggtgaccactctcttccacgaattcggtcatgccctccacggtatgtttgccgcccagcagtatcctttgctctccggtacgaatgtggcgcgtgacttcgtcgagatgccgtctcagctcaacgaacattgggctatggatccggaagtgtttgccaactacgctaagcactggaagacacaggagcctatgccggccgaattggtcaagaagattcaggatgcgagcgacttcaatcaggcttattctatgggagaaaatcttgcagccgtaagcctcgatcaggcatggcatacgctcacggtcgaagaggcggaggccattaccgacgtggccaagttcgaagaagaagccctgcgcaaagtcggtctctacaatccgcagatacctcctcgctatcgctcctcttatttccgccatatctggagcaatggttatgcatccggttactacgcttatctgtggacagaagtgctggatcacaacgtttatcaatggatggtgcaaaacggtggtatgactccgcaaaacggacaacgccttcgggatatgattctttcgcgtggcaatacacaggatttcaacgtgatcttcaccgcgttcaccggtctgcaaaagcctgacatcagggatttgctccgcgctcgcggtctcatgtaa

SEQ ID NO: 98069 - protein, 695 aa, Porphyromonas gingivalis W83
MLTACNGSRKGDANLSDNPLLQSSALFMEAPEFDKIKTEHFLPAFEAGMEQQLAEIDSIVNNSEAPTFENTLVAMERSGQTLKRVSNVFFGLTGANTNDELQKIEEKVSPLLAAHSDAIYLNDKLFQRVKAVYESDQSAIEPEGQKLIQEYYDAFVRAGANLSAEDKAKLMELNKEEASLTTEFGNKLIAATNAAAVIVGSKDSLDGLSETEIAKAASDAKAAGHEGKYLLNITNTTQQDYLSVLNDRTIRQRVLEASIHRTDKGDANDTQSIVLRLARLRAQKARLLGFPNYAAWKLQNQMANNPETVLAFVKSIATPYAPQAQKDAAELQAYARSKGFEGDLTAADWNYYADKLRKEKFGLDENEVKQYFVTDSVLKNGVFYAANKLYGLTFKERTDLPVYAEDVRVFDVIDQDGKQLALFYTDLYRRPTKSGGAWMSNWVDQSYLLNQKPVIYNVCNYAKGVDGQPSLINYDEVTTLFHEFGHALHGMFAAQQYPLLSGTNVARDFVEMPSQLNEHWAMDPEVFANYAKHWKTQEPMPAELVKKIQDASDFNQAYSMGENLAAVSLDQAWHTLTVEEAEAITDVAKFEEEALRKVGLYNPQIPPRYRSSYFRHIWSNGYASGYYAYLWTEVLDHNVYQWMVQNGGMTPQNGQRLRDMILSRGNTQDFNVIFTAFTGLQKPDIRDLLRARGLM

SEQ ID NO: 98070 - DNA, 2037 bp, Porphyromonas gingivalis W83
  CDS (1)..(2037): transl_table=11
atgaatcccctcttacaaccctttgatacgcctttcggcagttaccctttcgacaaaatttcgatagcagacttcaaggaagcatttgcccatgccttagcggaaaaacgggcagaagcagatgccatcatcaacagtaccgaaccgccgacttttgccaatacgattttggcattagagctttgcggtgaaaagctggagcttgtctgtggagctttctttaatctcctgcacgccgacagcaacgacgaactgatgaatctctcccgggagataatgcccgaactgacccgtctcagtacggatatagccctgagcgaacccttgttcgtgcgcatccgaaccgtatgggagagcgatgagaaagaaaagctctcggatgaagaaaaacgccttctgtataattgctatcggggctttgtcgatagcggagcactactccccacagagaaaaaagaccggctgcgtaccctgtccgaagagatgagtatggcctcattgacattcggacagaatgtgctcaaggacgagaaacgctacaaactccacctcagcgatccggcggctgtggccgggatgcccgagacggctctcgctctcgcttcggagaaagcccggcgaaagggctatacggagggttggcttttcgacctttctgctccgagctactttgcttttatgaagcattgtcccgatgggaacctgcgccggcagatgtatgaagcgaaaatgtgtgtcggcttcgtagacaatgagtataacaacgaagctctgatccgtagaatggtaaacggccgtctcgaggaggcacaactcctgggttacgataccttcgcccactttgctcttcatgacaggatggccaagaaccccaaggcagtccaagaactactggacaaactactggatgcatacaagcccaaagcgacagatgaattggagatgatccgcaaatgggctgccgacaagacatccgaagtcgataacttcacgatacaaccatgggattgggcatacttctcggaacagtacaaacaggcccactacgatctggacgatgagatgatgcgcccgtacttcgaattagggcgagtcacacgtggtatcttcggcttggccaaccgactgtacggacttcatttctccgaacggacggatgtgccggtctatcatccggatgtaaaggtgtacgaagtatcggacgaagacggctcttatatcggtctgctctacacggatttctttccacgcgaaggcaagcaaaacggagcatggatgaacaacctccgggaccagtccgaacatcagcacccgcacatcatcatcgtgatgaacttcacccctccttcggcggacaaaccctcgctcctgacagcaggtgaggtggagactttcctgcacgagttcggccatgccctgcatggcatgctgtccaaatgccgcttcagctccttgtccggcacctcggtagcccgtgacttcgtggaacttcccagccaaataatggaaaactggctgacagagaaagattttctcgacacctttgcccgccattatataacggacgaacctatgcctaccgaattggtggaaaaactcctctcggcacgaaattacctcgcagcaagcggtgcatgccgtcagctcagcttcggctatctcgacatggcatggcatggattgtctgctccggtggatgacaaattagacatcaaggcttttgaagaggctgcttggtcaaaagctcttattctacctccttcgcccccgaatgccgtgatgagcacggccttcggtcatatattctcgggaggctatgcagccggatactatggttacaaatgggcggaagtgctggatgccgatgctttcgcagctttcaaggaagtgggtattttcgatcgcgaggtagccggtcgtttccgccgtgagatattggagagaggcgatacggccgatgccatggagctgtatgtagctttccgtggacatgagccggacattgctcccctgctgaagcgtaccggcttggtttag

SEQ ID NO: 98071 - protein, 678 aa, Porphyromonas gingivalis W83
MNPLLQPFDTPFGSYPFDKISIADFKEAFAHALAEKRAEADAIINSTEPPTFANTILALELCGEKLELVCGAFFNLLHADSNDELMNLSREIMPELTRLSTDIALSEPLFVRIRTVWESDEKEKLSDEEKRLLYNCYRGFVDSGALLPTEKKDRLRTLSEEMSMASLTFGQNVLKDEKRYKLHLSDPAAVAGMPETALALASEKARRKGYTEGWLFDLSAPSYFAFMKHCPDGNLRRQMYEAKMCVGFVDNEYNNEALIRRMVNGRLEEAQLLGYDTFAHFALHDRMAKNPKAVQELLDKLLDAYKPKATDELEMIRKWAADKTSEVDNFTIQPWDWAYFSEQYKQAHYDLDDEMMRPYFELGRVTRGIFGLANRLYGLHFSERTDVPVYHPDVKVYEVSDEDGSYIGLLYTDFFPREGKQNGAWMNNLRDQSEHQHPHIIIVMNFTPPSADKPSLLTAGEVETFLHEFGHALHGMLSKCRFSSLSGTSVARDFVELPSQIMENWLTEKDFLDTFARHYITDEPMPTELVEKLLSARNYLAASGACRQLSFGYLDMAWHGLSAPVDDKLDIKAFEEAAWSKALILPPSPPNAVMSTAFGHIFSGGYAAGYYGYKWAEVLDADAFAAFKEVGIFDREVAGRFRREILERGDTADAMELYVAFRGHEPDIAPLLKRTGLV

SEQ ID NO: 98072 - DNA, 1857 bp, Oryza sativa (japonica cultivar-group)
  CDS (1)..(1857)
atgtctctccggaggcgggagcgccgggtcatcgccgcggccggcgcggcggcgctcgtcgccgtcggcctcaacctcgccttctccgccgtcgccgcccaccgccgcaggaagcggcgagagctcccagggtttactgcgcaagtcaacctctcagctgctgacatcaagagattagctgatcgcgtcgtttctaagtcgaaggaaacatacgacgctgtggctgcggttcccctagataaagtcagcttctctaatgtcattgcacctctggcggaattagatgctcagcagttcccactggttcaagcctgtgtgcttcctagaatggtctcaccgtctgatgatgtacgaagggccagtgcagaagcagagaaacgattggattctcacttccagcagtgcagctatagatcaaagttgaaggtaagagagtttgaacgcaatggtgctaaactaactcaaagcaagaaaacggagatggagaaactgaaatctcacattgatgacttaagtttgaagtatattcaaagcttaaatgattccacaaaatttcttctattgaacgaggaagacctggctgggatgccactagagttcttaaaggttggctctaccaggaaactgattgctgttgcttatggccagaaaggtggaaaagagaatatagccatcctggaaaaattggtccagctaagacaccggcttgctagattgctggggtatcccaattatgctgattatgctattgaacctagaatgccgaggacgtcaaggaagatggaggaggagggtgatgctcaatttagcgtggaagacctgttatactacatgaaaagagctgaggagctcaaggttgatcttgatattggtgaaattaaacaatttttccctgttgacctggtcatatcaggaatattgaagatgtttcaagatctgtttgcactgcgatttgaggaaatgaaggatgctgagacttggcacgatacagttcgtctcttttctgtctgggatgcaagttcaagtgatcttttgggttacttttttctggatatcttttccagggaaggaaaatatgcacatacctgcgtcgtggcacttcagaatagatgcctgtgttctaatggcacaagaaaggttccagttgcagttctattgtctcaatgcccgaaagagtttgatgggaattcagcactgctgaggttcccagaagttgtaaggatattccatgaattcagtcatgtggtccatcatatctccaacagagccaccttttctagattttcgggtcttcaactggagggggattttgctgaaattccaagtctgttacttgagaattggtgctatgagaacatttctctaaaaatgatgtctggcttccatcaggacattacgaagtctatcactagtgaggcttgccaatcactgaaaagaaggcgtgacatatttgctggcctgaaactgaaacaagagatccttttgtgccttgttgatcagataatacatacaggcgaaaatgtgaacattgatgacttaatcaaggatcttcatccaaaggtaatgctaggtatacctttgttggaagggaatagcccagcttcatgttttccacgtattgctattggctatgatgctgtgtgctacagttacatatggagtgaggtgtttgcggctgatctgtttgcatcaaaatttaaagacgacttgctaaatcagcatgcggggttgcggtttagaaataaggtattggctccaggaggctcgaaaaatccccttgatatcatatctgactaccttggacgagaaccatcattgcaagctttcattcagagccgaacgaggaacagtctgtga

SEQ ID NO: 98073 - protein, 618 aa, Oryza sativa (japonica cultivar-group)
MSLRRRERRVIAAAGAAALVAVGLNLAFSAVAAHRRRKRRELPGFTAQVNLSAADIKRLADRVVSKSKETYDAVAAVPLDKVSFSNVIAPLAELDAQQFPLVQACVLPRMVSPSDDVRRASAEAEKRLDSHFQQCSYRSKLKVREFERNGAKLTQSKKTEMEKLKSHIDDLSLKYIQSLNDSTKFLLLNEEDLAGMPLEFLKVGSTRKLIAVAYGQKGGKENIAILEKLVQLRHRLARLLGYPNYADYAIEPRMPRTSRKMEEEGDAQFSVEDLLYYMKRAEELKVDLDIGEIKQFFPVDLVISGILKMFQDLFALRFEEMKDAETWHDTVRLFSVWDASSSDLLGYFFLDIFSREGKYAHTCVVALQNRCLCSNGTRKVPVAVLLSQCPKEFDGNSALLRFPEVVRIFHEFSHVVHHISNRATFSRFSGLQLEGDFAEIPSLLLENWCYENISLKMMSGFHQDITKSITSEACQSLKRRRDIFAGLKLKQEILLCLVDQIIHTGENVNIDDLIKDLHPKVMLGIPLLEGNSPASCFPRIAIGYDAVCYSYIWSEVFAADLFASKFKDDLLNQHAGLRFRNKVLAPGGSKNPLDIISDYLGREPSLQAFIQSRTRNSL

SEQ ID NO: 98074 - DNA, 2043 bp, Photorhabdus luminescens subsp. laumondii TTO1
  CDS (1)..(2043): transl_table=11
atgactaacccgttactcgttccatcaggtttaccaaaattttcttctattaaaccagaacatgttgttccggctgtaaaggaagtcattgccaattatcgccaaaccgtcgaaaaaatattggccgagaataccgtttttacctgggataatctgtgtcaaccactggccgaagcaggtgataaacagtcccgtgcatggtcacctgtcaatcatctgaattcggttaaaaacagcccagaattacgcgccgtctatgaagaaagtttgccattactgtccgaattcagtacctggttaggtcagcacaagggattatatcaagcgtataagtcattacgtgaaagtgctgagtttgagaagctctctgtgcctcaacgcaaagttgtcgaaaatgcactgcgtgattttaaactatccggtattggtctgcccgaagagaagcagaaacgttatggcgagattagcgcacgtttgtcagatttaagttcgcaattcaacaataatgtgctcgatgccactatgggctggaccaaattaattactaatgtgaaagatctgtctggtctgcctgaaagcgcgattgccgccgctaaagctcaagcagaagctaaaggtcaaaaaggctggctactgactttagaagcaccaagctaccagccagttatcacttatgcagataaccgtgaactgcgtcgggaaatttaccacgcctacaatacccgcgcatccgatcaaggcccaaatgcaggtaaatgggataacagcgaagtaatcgccgaaatccttgcgctgcgtcacgaacaggctcaattgcttggtttcaaaaattatgctgaacaatcccttgcaaccaagatggcaaaaacccctaaggaagtgttggattttctgaatgatttgacaaaacgcgcacatccacagggcgaagaagaagtagatgagttaaaaggttttgctaaatggcatcattgtgcccacaagctagaagcttgggatatggcttactatggcgaaaaacaaaaacagtacgagttctctatcaatgatgagcagttacgtccttatttccctgaacaaaaggctgttgaaggattattcgaagttgttcgccgtatctatggtattactgccaaagagcgccatgatgtagaaacctggcatacggatgtccgtttctttgatctgtacgatgacaccaatgagctgcgcggtagcttctatatggatctgtacgcacgcgagaataaacgtggtggcgcttggatggatgagtgtatcagcaaaatgcgtcgttccaacggcgaactgcaaaaacctgtcgcttatctgaattgcaatttcaacaaacctgttggtaataaacccgcgctattcacccacaatgaagtcaatacgctgttccacgagtttggtcactgtctacacctgatgctgactcagattgaaactgccggtgtctccggtaccaatggtgtaccgtgggatgcggtcgaaatgccaagccaattcatggaaaactggtgctgggagccagaagcactggcattcatctctggtcactacgagactaaagaacctctaccacaagccctgctggataatctgttagcagccaaaaactatcaggctgctatgcggatcttgcgtcaacttgagtttggtcagttcgatttccgtctgcatgttaactacgatccaaagaaaggcgctcaaaccatgaagaccttaaaggaagtgaagaaattggtctcggtagtgccttcacctgaatggggccgtttcccacactcattcacccacatcttctctggcggttatgctgctggctactacagttatctgtgggctgatgtgttggcagccgatgcttactctcgcttcgaggaagaaggcatttttaaccgcgaaaccggacaatctttccttgataacattttgtcccgtggtggttccgaagagccaatggagctgttcaaacgcttccgtggccgtgaaccaaaactggatgcaatgctgcgcaaggccggtattaaagggtaa

SEQ ID NO: 98075 - protein, 680 aa, Photorhabdus luminescens subsp. laumondii TTO1
MTNPLLVPSGLPKFSSIKPEHVVPAVKEVIANYRQTVEKILAENTVFTWDNLCQPLAEAGDKQSRAWSPVNHLNSVKNSPELRAVYEESLPLLSEFSTWLGQHKGLYQAYKSLRESAEFEKLSVPQRKVVENALRDFKLSGIGLPEEKQKRYGEISARLSDLSSQFNNNVLDATMGWTKLITNVKDLSGLPESAIAAAKAQAEAKGQKGWLLTLEAPSYQPVITYADNRELRREIYHAYNTRASDQGPNAGKWDNSEVIAEILALRHEQAQLLGFKNYAEQSLATKMAKTPKEVLDFLNDLTKRAHPQGEEEVDELKGFAKWHHCAHKLEAWDMAYYGEKQKQYEFSINDEQLRPYFPEQKAVEGLFEVVRRIYGITAKERHDVETWHTDVRFFDLYDDTNELRGSFYMDLYARENKRGGAWMDECISKMRRSNGELQKPVAYLNCNFNKPVGNKPALFTHNEVNTLFHEFGHCLHLMLTQIETAGVSGTNGVPWDAVEMPSQFMENWCWEPEALAFISGHYETKEPLPQALLDNLLAAKNYQAAMRILRQLEFGQFDFRLHVNYDPKKGAQTMKTLKEVKKLVSVVPSPEWGRFPHSFTHIFSGGYAAGYYSYLWADVLAADAYSRFEEEGIFNRETGQSFLDNILSRGGSEEPMELFKRFRGREPKLDAMLRKAGIKG

SEQ ID NO: 98076 - DNA, 1980 bp, Corynebacterium diphtheriae NCTC 13129
  CDS (1)..(1980): transl_table=11
atgactaatcctttgcttcaaccttccaccttgccgtaccaattaccgcaatttgcggcaattcgagtagagcattatctcccagcttttactgaggcacttgcacgccacagtgcggaaattgctgcgattgcgaacaatccagaacctgccacgtgggaaaatacggttgaggagctcgagcgaagcggtcgcgatttggaacgagtggcggcagtcttttttaacttgcatggcacggattccagtgcagaaatggatgagattgcagctgagattgccccacggcttgcccagcattcggatgagatgtatctcaacgctgagctgttcgaaagaattaagcaatgcacaccaccagcggattcagagtcgcagcgtttgcatgagcacattatcaggacatttactcgccacggtgctggcctagaagacgttgcacgtttgaaagaaataaatgcgcggttgtcggtgctctcggatatgtttggccgtaatttattagagtccacgcagaaattagctgtgggtttttcctcgaaagaggagctcgcggggctaagtgatgctcgcattgagtcggctgccgctgatgcgaaagcattgggacgcgacggctatgtgcttccgctagagctgccgacggtccaaggcgaacagagctcgctagagaatccgcagtctcggcagcgggtatatgaggcgtcgcaacgcagaggcgctgataacaatcctgaggtgctcgtggaaatggtgcagctacgggccgagcgggccgaattgttgggatacctaacccacgcggactatgtgatttctgaagaaaccgccggaagcgccgaagctgcgcgaaagcttctttacgatttggcacccgcggcgaccgcaaatgcgctggcggaaaagaagctgctgtcggaggctgcaggagaagagatcaatcctgcagattggccgtactgggaatctcacgtacgtctgcgcgattatgcgctcaacgaggaagaactatcacagcatttcccgttgaagaaagtgcttgtcgacggagtcttcttcgccgcacatcgcctctacggtattactgtggagcctcgtcccgacttagaaggctacgcccctggtgtcgatgtgtgggaagttaaagaagaagatggccgtggtatcgggctattgctgactgattactacgggcggccgtcgaaacgcggtggtgcttggatgagtagctttgtcgatcaatcggagttgttgggtacaaagcctgttgtggtcaacgttatggggttgacggcaccaaccgatggttcggatgcactgctcagtatcgattcgttgaccaccgtcttccacgagtttggtcacgcgctgcatggtttgctttcgcaagtgcgttacccaacgttttctggcacaaacgtgccacgcgactacgtggagtttccatcgcagatcaatgaaaactgggcgtttgagccagaagtattgcgtaactatgcgccgaatcttcctgcacatgtggttgacgctattgaagaagcccgccagtttggtcaaggattcgccacaactgaataccttgctgcggcgatcattgatctcgcgtggcattcgttgaccagcgcacaagctcaaaagttgtcggcctcagacatagaagaatttgaacgtcgtgcactcgaagacgccggaatcgaaggcgtacaacctcgctacaagtccacctactttaatcacattttcgcaggtggatactctgctgggtactactcctatctttgggccgaagcgcttgatgcggatggatttgactggttcaaggaacaacaagacccccgcgttgccggacgacgattccgtgatcttgtactttcacgcggtggtgccgacgacttcactgaggcctatgaatcacttcgtggtcgcgaaaaagatgtcgcaccactgctacgtcgcaggggcctatcgggagccatgtga

SEQ ID NO: 98077 - protein, 659 aa, Corynebacterium diphtheriae NCTC 13129
MTNPLLQPSTLPYQLPQFAAIRVEHYLPAFTEALARHSAEIAAIANNPEPATWENTVEELERSGRDLERVAAVFFNLHGTDSSAEMDEIAAEIAPRLAQHSDEMYLNAELFERIKQCTPPADSESQRLHEHIIRTFTRHGAGLEDVARLKEINARLSVLSDMFGRNLLESTQKLAVGFSSKEELAGLSDARIESAAADAKALGRDGYVLPLELPTVQGEQSSLENPQSRQRVYEASQRRGADNNPEVLVEMVQLRAERAELLGYLTHADYVISEETAGSAEAARKLLYDLAPAATANALAEKKLLSEAAGEEINPADWPYWESHVRLRDYALNEEELSQHFPLKKVLVDGVFFAAHRLYGITVEPRPDLEGYAPGVDVWEVKEEDGRGIGLLLTDYYGRPSKRGGAWMSSFVDQSELLGTKPVVVNVMGLTAPTDGSDALLSIDSLTTVFHEFGHALHGLLSQVRYPTFSGTNVPRDYVEFPSQINENWAFEPEVLRNYAPNLPAHVVDAIEEARQFGQGFATTEYLAAAIIDLAWHSLTSAQAQKLSASDIEEFERRALEDAGIEGVQPRYKSTYFNHIFAGGYSAGYYSYLWAEALDADGFDWFKEQQDPRVAGRRFRDLVLSRGGADDFTEAYESLRGREKDVAPLLRRRGLSGAM

SEQ ID NO: 98078 - DNA, 2091 bp, Rhodopseudomonas palustris CGA009
  CDS (1)..(2091): transl_table=11
atgtcagaaagctccggaccgattgccgcacccgctgatgccggcaatccgctgctggccgcctggaccaccccgttcgagacaccgccgttcgccgagatcaggcccgagcacttcatgccggccttcgagcaggcgttcgccgaccacgcgggcgagatcgccgcgatcgtcaacgatccgaccgagccggacttcgacaacaccgtcacggcgctggagcgctcaggcaagctgctgaaccgggtcgccgcggtgttctacgatctggtgtcggcgcattcgagcccggagctgctgaagatcgacgaagaggtgtcgctgcggatggcgcggcactggaatccgatcatgatgaacgcggtgctgttcggccggatcgcggcgctgcgcgacaaggcggcgcggctgaacctgacgccggagcagagccggctgctggagcgcagctacacccgcttccaccgcgccggcgccggcctcgacgaggcgtccaaggcacgcatggcggcgatcaacgaacgcctggcgcagctcggcaccagcttcagccatcatctgctcggcgacgagcaggaatggatgatggagctcggcgagggcgataccgaggggctgcccgacagcttcgtggcggcggcgcgcgctgcggcggaagagcgcgggctgcccggcaaggccgtggtgacgctgtcgcggtcgtcggtcgagccgttcctgaagatgtcgagccggcgcgatctgcgcgagaaggtgtaccgcgccttcatcgctcgcggcgataacggtaacgataacgacaacaacgcgatcatcggcgagatcctgagcctgcgcgaagaaagcgccaagctgctcggctatccgacctttgcggcctaccgtctggaagactcgatggccaagacgccggaggcggtgcgcggccttttggagcgggtgtggaagccggcgcgcgctcgcgcgctcgccgaccgcgacgcgctgcaggagctggtcacggaagagggcagcaacttcaagctggcgccgtgggactggcgctactacgccgagaggctgcgccagcgccgcgccaatttcgacgatgcggcgatcaagccgtatctgacgctcgacggcatgatcgccgcggcgttcgacaccgccacgcggttgttcggcatcaccttcgaggaacgcaaggacgtcccggtgtggcatccggacgtccgggtgtgggaagtgaaggacgccgacggcgcgcatcgcgggctgttctacggcgactactatgcccggccctcgaaacgttccggcgcctggatgacctcgctgcgcgatcagcagaagctcgacagcgcggtggcgccgctgatcatcaacgtctgcaacttcgccaagggcgccggcggcgagccgtcgctgctgtcgcccgacgacgcccgcacgctgttccacgaattcggccacggcctgcacggtatgctgtcagacgtgacctacccgtcgctgtccggcaccagcgtgttcaccgacttcgtcgagctgccatcgcagctttacgagcactggcaggagcagccgcaagtgctgcggcagttcgcccgtcactatcagaccggcgagccgctgcccgacgatctgctgcagcggttcatcgccgcccgcaagttcggccagggcttcgccaccgtcgagttcgtctcctcggcgctgctcgatctcgaatttcacacccagcctgccgccagcatcggcgaggtccgcgccttcgagcgcaaggagctcgacaagatcggcatgcccgaagagatcgcgctgcggcaccggccgacccagttcggccacatcttctccggcgatcactacgcctcgggctactacagctacatgtggagcgaggtaatggacgccgacgcgttcggcgcgttcgaagaggccggcgacatcttcgcgccggacgtggccaagcggctgcgcgacgacatctattcgtccggcggctcgcgcgatccggaggaagcctatgtggcgttccgcggccgcaagccggagcccgacgcgctgctgcgccgccgcggcctgctcgacacgccggaggccgcgtag

SEQ ID NO: 98079 - protein, 696 aa, Rhodopseudomonas palustris CGA009
MSESSGPIAAPADAGNPLLAAWTTPFETPPFAEIRPEHFMPAFEQAFADHAGEIAAIVNDPTEPDFDNTVTALERSGKLLNRVAAVFYDLVSAHSSPELLKIDEEVSLRMARHWNPIMMNAVLFGRIAALRDKAARLNLTPEQSRLLERSYTRFHRAGAGLDEASKARMAAINERLAQLGTSFSHHLLGDEQEWMMELGEGDTEGLPDSFVAAARAAAEERGLPGKAVVTLSRSSVEPFLKMSSRRDLREKVYRAFIARGDNGNDNDNNAIIGEILSLREESAKLLGYPTFAAYRLEDSMAKTPEAVRGLLERVWKPARARALADRDALQELVTEEGSNFKLAPWDWRYYAERLRQRRANFDDAAIKPYLTLDGMIAAAFDTATRLFGITFEERKDVPVWHPDVRVWEVKDADGAHRGLFYGDYYARPSKRSGAWMTSLRDQQKLDSAVAPLIINVCNFAKGAGGEPSLLSPDDARTLFHEFGHGLHGMLSDVTYPSLSGTSVFTDFVELPSQLYEHWQEQPQVLRQFARHYQTGEPLPDDLLQRFIAARKFGQGFATVEFVSSALLDLEFHTQPAASIGEVRAFERKELDKIGMPEEIALRHRPTQFGHIFSGDHYASGYYSYMWSEVMDADAFGAFEEAGDIFAPDVAKRLRDDIYSSGGSRDPEEAYVAFRGRKPEPDALLRRRGLLDTPEAA

SEQ ID NO: 98080 - DNA, 2040 bp, Bdellovibrio bacteriovorus HD100
  CDS (1)..(2040): transl_table=11
atgaatacgactaatcctcttttgcaacccttcaagaacaaagatcaggctgtgccttttgatttgatcaaagttgagcactatgtgccggcggttgaagaagccatcaagatggctaaagaaaatgtggctaagatcaaagccaatccggaggctccggattttgaaaatacgattgtggctttggaagcggccagcgttcatgctgatcagatttccacgatctactccaacctggaagtggctcatgcggatgaagcgcttcaggctttggctaaagatatttatccgatgctgacggctttaagctctgacatctctttggattctgagatctttgcgcgcgtgaaagctgtttatgacaagcgcgaatccttgaacctgaatctggaacagactcgcctgctggaaaagacttacctgtctttcactcgcaacggggctttgctgaatgcggctgacaaagagactcttcgtcagatcgatcaggagctttctgttcttggtccgaaattctctgagaacgttttgaaagcgaccaattctttcgaaatgcttttggataaaaaagaagatgttgatggtttgcctgaaggcacacttgaaggtgcggcggctttggcgaaagccaaaggtcacgacggcaagtggatattcaatttgcagatcccttcttaccttccgttcatgacttatgcaaaaaaccgcgcgcttcgcgagaaaatgtggagagcgttttcttccaaagccttcaaaggtgaattcgacaatcaggccaacgttctgaaaattgttgagcttcgtgacaagcgcgcgaaagttttgaaattcaccacgcatgctgatttcgtgttggcagagcgtatggcgaaaaatccaaaaactgttatggacttcctgaacaaacttctggcggcttccaagaacgcgggcctgaaagacgttcaagaactgacagagttcgcgaacaagctggatggtctgacagagatcaaaccttgggacgtggcttattattctgaaaagctgaaagaagagcgttatgctttcaacgaagaggacctgcgcccttacttcaaacttgaaaacgtggttgaaggtgtgtttgctcacgcgaagaaactttacggcctgacgttcaaagaaaacaaagaaatcccggtctatcacccggaagtgaaagcttacgagatctatgaagatgcttctggcaaatacatgggtctgttctatacggattacttcccgcgcgagaccaaaaaaggcggcgcttggatgactcagttccgttcacagggtctgatcgacggcgaaatgaaacgcccgcacgtcagcatcgtgtgcaacttcacgcagccgactccgaccaagccgtcacttttgacttatgacgaagttcgcacgctcttccacgaattcggtcacgctttgcacggcatgctgtctgagtgtacttatccttccctgagcggtaccaatgtctattgggacttcgtggaacttccttcccagatcatggaaaactgggtgggcgaaaaagagggcctggacatctttgcccgtcactacgaaaccaacgaaccaatgccggcggagctgatcgagaaattgaaacgctcccagaaattccaggcgggttacatgtcctgccgtcagctgcaattcggcctgatggacatggcatggcactcgacggacccgggcactatcaaggacgtggatgcgtttgaagagctggcaacggccgaaacccgtctgttcccgaaagtggatggcgcgaattcctcttgcagcttcggccacatctttgctggcggttattctgcgggttattactcttacaaatgggcagaggttctggatgcggatgcctttgagtacttcaaggaaaaaggcctgttcaatcaggaagtggccaagaagttcaaagacaacgttctaagccgtggtggcaccgagcacccgatggatttgtacaaaaaattccgcggtcgtgagccggatccaaacgctcttttgcgtcgtgatggactgatttaa

SEQ ID NO: 98081 - protein, 679 aa, Bdellovibrio bacteriovorus HD100
MNTTNPLLQPFKNKDQAVPFDLIKVEHYVPAVEEAIKMAKENVAKIKANPEAPDFENTIVALEAASVHADQISTIYSNLEVAHADEALQALAKDIYPMLTALSSDISLDSEIFARVKAVYDKRESLNLNLEQTRLLEKTYLSFTRNGALLNAADKETLRQIDQELSVLGPKFSENVLKATNSFEMLLDKKEDVDGLPEGTLEGAAALAKAKGHDGKWIFNLQIPSYLPFMTYAKNRALREKMWRAFSSKAFKGEFDNQANVLKIVELRDKRAKVLKFTTHADFVLAERMAKNPKTVMDFLNKLLAASKNAGLKDVQELTEFANKLDGLTEIKPWDVAYYSEKLKEERYAFNEEDLRPYFKLENVVEGVFAHAKKLYGLTFKENKEIPVYHPEVKAYEIYEDASGKYMGLFYTDYFPRETKKGGAWMTQFRSQGLIDGEMKRPHVSIVCNFTQPTPTKPSLLTYDEVRTLFHEFGHALHGMLSECTYPSLSGTNVYWDFVELPSQIMENWVGEKEGLDIFARHYETNEPMPAELIEKLKRSQKFQAGYMSCRQLQFGLMDMAWHSTDPGTIKDVDAFEELATAETRLFPKVDGANSSCSFGHIFAGGYSAGYYSYKWAEVLDADAFEYFKEKGLFNQEVAKKFKDNVLSRGGTEHPMDLYKKFRGREPDPNALLRRDGLI

SEQ ID NO: 98082 - DNA, 2331 bp, Eremothecium gossypii
  CDS (1)..(2331)
atgtttgtgaggttttacaagcggttggatagacaatacatccaatcacagaggagatggatattatcttccaataaatgcctcttacaaggcaacaagaatgcaaccatttcacctctgaggagggcatttgatgaccaggaccattgggaagaatcacaggctcagaatacctcatcagagcaggataacaagggcaagaactcctcctacttttggtcccggagtaaagctaccgcgccgcaggtggcgcacacagggctatttcagaacccatacctaaactcgcccgaagggctacgaaaatttgccaataaatcacttaccgaggctactgcgttggtaaggaacctgagagaggattcgtcacaagaaggtctggtgcggtatatcattcgattagatcaactcagcgatatcttatgccgggtgattgacttgtgtgagtttttacgggctgcacatcccgatgaacaatttgttgccgcagctcaggaatgtcatgaacagatgtttgagattatgaatatcttgaatacagatgttgtgctttgcaaaagattaaaacaagtgctatcggacgagaatataagcagtaaactgagcagcgaggagatacgggtaggccatatattgctagaggattttgaaaaagcaggcgcatatgcgtcgcccgaagtcagaaagcagtttatacagttatcccaaaacatcagcattattggccaagacttcatcaacaacacagaatcattatcttccagctacataaagattccgtgcaaagatttggaatcgagtggcactagccatcttgttcttcgtcagctcaccaaggacaccatgggtaataactataagataccaactagtgggtatgctccgtatacactattgaatgcttgtccttcagaggctattcggaggcaggtatggaccgcaatgtttagttgttccgaaaaacaagtgaagaggcttaagagtttgcttcagcttcggcggaaacttgctaatatcatgggtgctacagactatgtttcctaccaattagagggaaagatggccaaatccccggaaaacgttaaaaatttccttaacacattggttgatcacactaagccgctggctgctggcgagcttgaagagctagcgaaactaaaacggaatgtagaaaacctatccgagacaaacacactaaaactcatgcggccatgggatcgggattactactcttcactatcccccaacttcacccggcctaaccatagggtggacggctttacatcgatcaatacctacttttctctgggagtcgttatgcaaggtatttcggacttgtttcgggacatatatgggataagcctgaagcctgtagtcgcccaagccggagaaacttgggcacctgacgtgcgcaagcttcaggtaatttccgagacagaaggcattattggcttaatctactgtgatttactagaaagacctgggaaaacaaccagcccgtctcatttcactgtttgctgctcacgtcaaatatatcctgaggagaatgatttttctacgatacaggtcggtgaaaatccagacggttcaagatttcagatgcctgtcatttctttaatatgcaactttagggcaactagacacgggaagaacaagtccctatgcttattggagttaagcgatgtggaaaccctcttccacgagatgggccatgcattgcattctatgctcggaaggactcagttacaaaatctcagcggaaccagatgcgtcacggactttgttgaactcccaagtattttgatggaacatttcgcaaaggaccgtcgcgtactgctgcgcatatcaagtaactatgcgaccggtgagcccatacccgaagagcttctttcagcttttcaagagcagaataactttttgaagaatactgaaacattttcacagatcaagatgtcgatgctggatcagcggttgcatagtatcaccgatcaggatgacataattgcggtataccatggtcttgaacgtgagatggaggttcttgttgacgaccaaacaaactggtgcggtagatttggccatttatttggctatggggcatcatattatagctatttaatggaccgggcaatagctgcaaagatatgggaccatttgtttaagaaggatccattcagcagaagcagtggtgaaaaattcaaagagggcgtcctaaaatggggtggtagtcgggacgcgtggcagtgcattgcagacgctctagatgaaccccgcctagtgaagggtgacgactgggcaatgaggtttattggggaagttgaagacatgtaa

SEQ ID NO: 98083 - protein, 776 aa, Eremothecium gossypii
MFVRFYKRLDRQYIQSQRRWILSSNKCLLQGNKNATISPLRRAFDDQDHWEESQAQNTSSEQDNKGKNSSYFWSRSKATAPQVAHTGLFQNPYLNSPEGLRKFANKSLTEATALVRNLREDSSQEGLVRYIIRLDQLSDILCRVIDLCEFLRAAHPDEQFVAAAQECHEQMFEIMNILNTDVVLCKRLKQVLSDENISSKLSSEEIRVGHILLEDFEKAGAYASPEVRKQFIQLSQNISIIGQDFINNTESLSSSYIKIPCKDLESSGTSHLVLRQLTKDTMGNNYKIPTSGYAPYTLLNACPSEAIRRQVWTAMFSCSEKQVKRLKSLLQLRRKLANIMGATDYVSYQLEGKMAKSPENVKNFLNTLVDHTKPLAAGELEELAKLKRNVENLSETNTLKLMRPWDRDYYSSLSPNFTRPNHRVDGFTSINTYFSLGVVMQGISDLFRDIYGISLKPVVAQAGETWAPDVRKLQVISETEGIIGLIYCDLLERPGKTTSPSHFTVCCSRQIYPEENDFSTIQVGENPDGSRFQMPVISLICNFRATRHGKNKSLCLLELSDVETLFHEMGHALHSMLGRTQLQNLSGTRCVTDFVELPSILMEHFAKDRRVLLRISSNYATGEPIPEELLSAFQEQNNFLKNTETFSQIKMSMLDQRLHSITDQDDIIAVYHGLEREMEVLVDDQTNWCGRFGHLFGYGASYYSYLMDRAIAAKIWDHLFKKDPFSRSSGEKFKEGVLKWGGSRDAWQCIADALDEPRLVKGDDWAMRFIGEVEDM

SEQ ID NO: 98084 - DNA, 2154 bp, Eremothecium gossypii
  CDS (1)..(2154)
atgacgaaggatttacttgggtactgggagtcccttgtcccgccgcaaccaccgccggtctggaattatactgccacggaagttatagaccttgcttatggtctagcccaaaagtcggacgctgtgtatgaaagcgtgttttctcaaaaagacgagttcactttggacaattatatctggccgcttctctacaatgaccaggagacagatctcctctggaaccaattgatatttctacgcaatgtctcgcctgatccaaaggtccgcgaagcgtctttgagtaccgggaagattttggaccagtgggtcgccaatatttcatcgaagtacgacttgtacaccaactttgaacatatatggacccaatacaaggacgacgaagagttcaaagtgacgaactacgagttgtacaagtatatggagaaggatgcaagctactataatcggaacaaaagaaacctcaccaatgccgaatcgatcgaacttggacaggtgacgaggaagatatctgtggacacccttcaattctccatcaaccttggcgaggaaaccgaatacatcacgtttacagaggaggaattagaaggcgtgtcccccctggtgttggaccagtttgagagaattattgagggtggggttaaaaagttgaaggtcactttcaagtaccctgacatcggccctgtgttgcgtacagctacgaatcctgagacacgcaggaaagcgtatgtggcagaccaaaatagggtggctgctaacgagcaactactattcgagaccttggatttgcggcggcggatggcgcagctccgtgggtacaagaattacgcagagtataatctacgcgataaaatggcgaaaaatgaagaaacagttatcccgtttctcaccgacttagtggagaggctattacccgtcggagagaaggaccgtgagatattgaagagtaaaaaggccgaggactacaagagcaagaaccttacttttgatggggaaatctacgcatgggataatgcctactataacaacaagatattacaagaaaagtaccagatagatcctgaagatatggcgcaatacttcccaattgaaagcgttattgaaggaatgcttgatacataccagacgttgttccgcttgaagtttgtggaagtaacggacccgagccagaagaacgtgtggcacgaagacgtaaagcagtttgcagtctggaacatcgacgatgaggactgtcccgagttccagggttggatatatttcgacttatatccccgcgacggtaagtacagtcatgccgccaacttcgggatggcttctgccttccgtaaaaaggatggctcccaatcgtacccggttaccgtcttggtttgtaatctcacaaagccaacacccactcgtacagctatcctccggcccggggagatcaccaccttatttcacgagttgggccacggcatacaccacctcgttgcaaacaacaagcttgcagcgcacaattcccttggttccgtcccctgggacttcgtcgaggcgccctcgcagatgttggagtattggaccggtcgtcgcgacgttctaactatgttgtcaaagcactatgaaaccggcgagaaaatcccgccctcccttttggacgcctggttcaacagctctggcctcggctcgggtctctattacttgggtcagctccgcctcggcctcttcgacatgtacgtgcacacccgcgaataccacggcctggaagtgcgaaagttatggaacgatatgcgcagagagatctcgctcatcaacagccagaactacacatctaccggttataatactttcgggcacattatgaccgggagctattcagcaggctactacggatatctctggtcccaggtgttcgcggcagatatgtaccagacaaagttcaagagcaatccattcaattccacagtgggaagacaatacagggacactattttggctcctggtggcttatacgatatgaacgataatttgagaaagttcctaggacgagaaccaaataacagagctttccttcgaggacttggcttcaatgcaacttcattgtccaggttattgcaggtcgaatcagccgaatctgtactcttgccgcgctcggacttaagggagctatttactatttag

SEQ ID NO: 98085 - protein, 717 aa, Eremothecium gossypii
MTKDLLGYWESLVPPQPPPVWNYTATEVIDLAYGLAQKSDAVYESVFSQKDEFTLDNYIWPLLYNDQETDLLWNQLIFLRNVSPDPKVREASLSTGKILDQWVANISSKYDLYTNFEHIWTQYKDDEEFKVTNYELYKYMEKDASYYNRNKRNLTNAESIELGQVTRKISVDTLQFSINLGEETEYITFTEEELEGVSPLVLDQFERIIEGGVKKLKVTFKYPDIGPVLRTATNPETRRKAYVADQNRVAANEQLLFETLDLRRRMAQLRGYKNYAEYNLRDKMAKNEETVIPFLTDLVERLLPVGEKDREILKSKKAEDYKSKNLTFDGEIYAWDNAYYNNKILQEKYQIDPEDMAQYFPIESVIEGMLDTYQTLFRLKFVEVTDPSQKNVWHEDVKQFAVWNIDDEDCPEFQGWIYFDLYPRDGKYSHAANFGMASAFRKKDGSQSYPVTVLVCNLTKPTPTRTAILRPGEITTLFHELGHGIHHLVANNKLAAHNSLGSVPWDFVEAPSQMLEYWTGRRDVLTMLSKHYETGEKIPPSLLDAWFNSSGLGSGLYYLGQLRLGLFDMYVHTREYHGLEVRKLWNDMRREISLINSQNYTSTGYNTFGHIMTGSYSAGYYGYLWSQVFAADMYQTKFKSNPFNSTVGRQYRDTILAPGGLYDMNDNLRKFLGREPNNRAFLRGLGFNATSLSRLLQVESAESVLLPRSDLRELFTI

SEQ ID NO: 98086 - DNA, 2052 bp, Eremothecium gossypii
  CDS (1)..(2052)
atgaaagatctcgcttctttggtcccgccgcaggcggcaccatcgtggaatttcagtgcacaagatgttattagtcttagccatcaattgatcaaccaaaccgaggcggtttaccacaacgtgttacaagaaaagccaccaacaattgacaattatatcatgcctctaatataccatgaggaggaaacagacctgctatggaaccagttggtgtttctccgcaatgtttcgcccgatccggagattcgtgaagcgtcgaagaacgcaacatccatgctggacgactggattattggccttacgtcaaagtatgacttgtatcagcactttgacgaggtgtgggcacaatataaggatgatgagaagttcaagaaggagaactttgagctatatcggtatatggagaaggatgcggatggctacagacgttctggtatgaaagtgccagttgagaacaggaaaaggcttgacgaagtcaaatctaagattgccgcagccgaattagagttttcgtcaaacctgggagaagaggtggagtatatcgcattcactaaggaggagctagagggtgtcccggacactgtcttgaaccaatttgaaaagattatcgaaggcggtgtcgaaaagttcaaagttacttttaagtatccagacattgggccggtattacgcctggccagcaaccctgagacaaggagacgcgcttctatggctgacgagaatagggtagctgcgaatgaaccgctccttttcgagacgctagaattgcgacgcgagctagccgatctacttggattcaagaattttgcagcatacaatcttgacgacaagatggcgaaaaatgaagagactgtcttgaaatttctcaatgatttggtagagaagctgctgcccgtggggaagaacgatctcgaaatattgaagaagaagaaggcggaagattacaaaagcaagaaccttacttttgatggcgaattctattcctgggatactggatattacaccaacaagatattgagggagcgctacaatgtcaaccctgatgaccttgcgcaatatttccccgttgaaagtgcaattgaaggaatgctaaacatatatacaacgctctttcgcctgaagtttgtagaaataacggacgaatgcgaaaagagtgtatggcacgaggatgtcaaacagtttgcagtttggaacattgatgatgaggacaatccaaagttccaaggctggctatattttgatctgcatcctcgtgatggaaaatacggccatgcagctaattttggaatggtttctgcataccgtaagagagatggctccaaatcatacccagttactatccttgtgactaacttttcaaagccgacacctaccagacctgctcttctgaagttgggagaactcacaacgttctttcatgagttaggccacggcatacacgatttggtgggttccaatgacttggagtcgctcaacgggcctgggtctgtcccatgggatttcgtcgaggcgccctctcagatgctggaatactggacggcacggcgtgacgttttaactatgttatccaagcactacgagacaggtgagaaaatcccgaagtcgctgctggatgcctggtttagtgttggcggcctcaattcaggattggccaacttgggccaactgaaacttggcttgttcgacatgtatgtgcacacccgcgattacaaaggagcggaggtacggaaattatggaatgatctcaccagagagatcgggctcatgaacttaaaaaactacactagcaccggctatgactcctttggacatattatggctggatatgctgctggctactatggctacctttggtcccaggtttttgctgcagatatgtacgacacaaagttcaagcccaacccattcaatgctacggtgggtgtggaatacagggacactattttagctaccggtggactttacgatatgacagataatttgaggaaattcttggggcgggatcccaacaataaggcattcctccgcggacttggtctgaaagctaggtag

SEQ ID NO: 98087 - protein, 683 aa, Eremothecium gossypii
MKDLASLVPPQAAPSWNFSAQDVISLSHQLINQTEAVYHNVLQEKPPTIDNYIMPLIYHEEETDLLWNQLVFLRNVSPDPEIREASKNATSMLDDWIIGLTSKYDLYQHFDEVWAQYKDDEKFKKENFELYRYMEKDADGYRRSGMKVPVENRKRLDEVKSKIAAAELEFSSNLGEEVEYIAFTKEELEGVPDTVLNQFEKIIEGGVEKFKVTFKYPDIGPVLRLASNPETRRRASMADENRVAANEPLLFETLELRRELADLLGFKNFAAYNLDDKMAKNEETVLKFLNDLVEKLLPVGKNDLEILKKKKAEDYKSKNLTFDGEFYSWDTGYYTNKILRERYNVNPDDLAQYFPVESAIEGMLNIYTTLFRLKFVEITDECEKSVWHEDVKQFAVWNIDDEDNPKFQGWLYFDLHPRDGKYGHAANFGMVSAYRKRDGSKSYPVTILVTNFSKPTPTRPALLKLGELTTFFHELGHGIHDLVGSNDLESLNGPGSVPWDFVEAPSQMLEYWTARRDVLTMLSKHYETGEKIPKSLLDAWFSVGGLNSGLANLGQLKLGLFDMYVHTRDYKGAEVRKLWNDLTREIGLMNLKNYTSTGYDSFGHIMAGYAAGYYGYLWSQVFAADMYDTKFKPNPFNATVGVEYRDTILATGGLYDMTDNLRKFLGRDPNNKAFLRGLGLKAR

SEQ ID NO: 98088 - DNA, 2064 bp, Sus scrofa
  CDS (1)..(2064)
atgaagcccccagcagcctgtgcaggagatgccctggatgtggcggcgccatgctctgctgtgaactacctccggtgggacctgagcgcccagcagattggggagctcaccacagaactcatcgagcagacaaagcgtgtgtacgaccgcgtgggcacccaggagcttcaggatgtatcctacgagaacacgctcaaggcactggctgacgtggaagtgtcctacacagttcagaggaacatccttgacttcccccagcacgtgtctccatgcaaggacatccgcacggccagcacggaggcggacaagaagctgtccgagtttgatgtggagatgagcatgaggcaggatgtgtaccagaggatcgtctggctgcaggagaaggtccagaaggactcactgaggccagaggcggcacggtacctggagcggctgatcaaactgggccggagaaatgggctccacctgcccaaggaaacgcaggagaaaattaagagcatcaaaaagaagctaagcctcctgtgcatcgacttcaacaagaacctgaacgaagacacgacctttctgccggttacacgagaggagctgggagggctccccgaggactttctcaactcgctagagaagacggaggatgagaagctgaaggttaccctcaagtacccacactacttcccccttctgaagaagtgccatgtgccagagaccaggaggaaggtggaggaagccttcaactgtcggtgcaaggaggagaactgtgcgatcctccgggagctggtgaggctgcgggcgcagaaatccagcctgttggggttcagcacccatgctgactacgtgctggagatgaacatggccaagaccagccaggtggtggccactttcctagatgagctggcccagaagctgaagccccttggggagcaggagcgggctgtgatcctggagctgaagaaggccgagtgcaccaagcggggccttgactttgatggccgcatcaacgcctgggacatgcgctactacatgaaccaagtggaggagacacgctaccgtgtggaccagaacctgctcaaggagtacttccccatgcaggtggtcacccgtgggctcctgggcatctaccaggagctgctggggctgaccttccacctggaggagggcgccgctgtgtggcatgaggatgtgatgctgtattctgtcagggatgcagcctcaggcaaagtcatcgggaagttctacctggacctctacccgagggaagggaagtacgggcacgcagcctgctttggcctgcagccaggctgcctgcggcaggacgggagccgccagatcgccatcgcagccatggtggccaacttcaccaagcccacgcctgacgcgccctccctgctgcagcacgatgaggtggagacctacttccatgagtttgggcatgtgatgcaccagctatgctcccaggccgagttcgccatgttcagtgggacacacgtggagcgggacttcgtggaggcaccctcgcagatgctggagaactgggtgtgggaggcagagccgctgctcaggatgtcccagcactaccggacgggcagcgctatcccgcaggagctgctggagaagctcatcaagtcccggcaggccaacacaggcctcttcaacctgcgccagatcgtcctggccaaggtagaccaggccctgcacacgcagacggccgcagacccggctgaggagtacgcccgactctgccaggagatccttggggtcccagccacaccagggaccaacatgcctgcgacctttggccacctggcggggggctacgatgcccagtactacggctacttgtggagtgaggtgtactccgcggacatgttccacacgcgcttcaagcaggagggcatcctgagtggcaaggtgggcatggactacagaagctgtatcctgagacctggcggctccgaggatgccagcgtcatgttgaagctcttcctgggtcgggatcccaagcaggatgccttcctcctgagcaaaggactgcaggttgaaggctgcgagccaccagcttcttga

SEQ ID NO: 98089 - protein, 687 aa, Sus scrofa
MKPPAACAGDALDVAAPCSAVNYLRWDLSAQQIGELTTELIEQTKRVYDRVGTQELQDVSYENTLKALADVEVSYTVQRNILDFPQHVSPCKDIRTASTEADKKLSEFDVEMSMRQDVYQRIVWLQEKVQKDSLRPEAARYLERLIKLGRRNGLHLPKETQEKIKSIKKKLSLLCIDFNKNLNEDTTFLPVTREELGGLPEDFLNSLEKTEDEKLKVTLKYPHYFPLLKKCHVPETRRKVEEAFNCRCKEENCAILRELVRLRAQKSSLLGFSTHADYVLEMNMAKTSQVVATFLDELAQKLKPLGEQERAVILELKKAECTKRGLDFDGRINAWDMRYYMNQVEETRYRVDQNLLKEYFPMQVVTRGLLGIYQELLGLTFHLEEGAAVWHEDVMLYSVRDAASGKVIGKFYLDLYPREGKYGHAACFGLQPGCLRQDGSRQIAIAAMVANFTKPTPDAPSLLQHDEVETYFHEFGHVMHQLCSQAEFAMFSGTHVERDFVEAPSQMLENWVWEAEPLLRMSQHYRTGSAIPQELLEKLIKSRQANTGLFNLRQIVLAKVDQALHTQTAADPAEEYARLCQEILGVPATPGTNMPATFGHLAGGYDAQYYGYLWSEVYSADMFHTRFKQEGILSGKVGMDYRSCILRPGGSEDASVMLKLFLGRDPKQDAFLLSKGLQVEGCEPPAS

SEQ ID NO: 98090 - DNA, 2202 bp, Neurospora crassa
  CDS (1)..(2202)
atgacaggaatgtacgacaacccaccccagcccccagggctccgaaaccataccccagaaagcgttactgccgccttcgaagcatgggccgacaaacaccgtgctgcgctagatgcgatcgtagccgatgtcaacctgagtgacccgcagactgtcacatttgagaacgtcatgcgcccccaactcgagtttgagaatcaaaagttctcgcacaacttgcgcttttaccagcacgtttctgagaacagcgatttgcgggagaccactcgcaaaatggcaaaatggtacgataacatctggacggacatgaacatgcgcggggacgtcttccgtgcgagagaagtcctgtatcacaaatctggtctcgcggcaagtaggaaacagaattccgctcggtacataaccgaggacattgcaaagaatgcaggttttgaggatgctgagagtgctatcgctctggaggaagagtggaaagaggcaatcaggttaggattgggtttaccgtccaaaccccagcgtgatcgcttcaatcaaattcaaaagcgcgtggaggcaatcaagagcgagttcaagaaccaccacgcttctgataaaggctgcaactggtttacccctgcagagttggatggcatggacaacgatattattgaccagttggcgaagggaacgggcgagaatgaaggcagacttaaggtcaccttcgaccccagtcattacgacatctttctcagagacgtcaagaactcggaggctcgaaagcgcatgtggactgccatggagaacaaatgcccagaaaacgtcccgctctttaaagaagccatgcttctccgagacgaggctgctcgcctcttgggttacccagatcatgccacattgaggattgaaagccgaatggcgaagacacctagggctgtcaacaacttgctgaatgacttacgaacccgccttgcaccccttgccaccaaagagctcaaccaactactacaaactaagaagaaggactgcgagactcgaaacttgccgtttgatggcagtttctatcactgggactgggctttctacgcctcccaaatttccaagcaagaacatgaccttgacaacaagaaggttgccgaatacttcccgatcgattccgcaatcacaggcatgctccgcctctttggggtgctctttggcatcgttttcgttaggttgaccgcagaggatcttgagcgtatctcccctactggcgtcgccgatgatgtcatgtatcacagggacactatcatgtttagtgtgtggaatgacgaatccgagggtaatgactttctgggatacctttacatcgacgcccatccacgcgagggcaaatacagacacgtagcaaatttccccctggaacttgggcaccagagaacggacggtacgaggttttacccatccacggctattgtttgcaacttccctgcgccaaccaaggacaaaccgtcactccttgaccacgaacatattgttgacctatttcatgaattgggacatgggattcactctctggtttcacgcactcgcttctctcgtcatcacgggacagcaggcaagcgagactttgtcgaagcccctagccagatgcttgaacattggacatggagagccgagtatatcaaacgcatcagcaaacattatttaacaggcgagcagatgtctgacgacatggccgagcggattgcggcaagcagacatttccttcaggcgttgaggaacttgtggcagttatcatccgcgatttttgacatggaggttcattcgcccaaatcacgcgctgcccttgaaaacatggactttaccaagcgatacaacgaattgagaaacgaactaacaggaatgaagggacccgaagctattggtgaaccgatttaccattggtctaacacctactcctacgacatgttttacttcgcctttgctaaagatccgatggataaatctcaaggtcaccgattcagacacacggttctcgaaaagggcgcgtcgcaagacgagatgctcatacttgagcagttcctgggtcgcaaaccaaccaccgatgcgttttgcatggagctggggctggttgaacctatggaagaaccgttgttgaagggaagttccttcgctggacgagaccccgtcattgagggcgcctcgagtgaggaggatcctgccattgagcatcaccctttctga

SEQ ID NO: 98091 - protein, 733 aa, Neurospora crassa
MTGMYDNPPQPPGLRNHTPESVTAAFEAWADKHRAALDAIVADVNLSDPQTVTFENVMRPQLEFENQKFSHNLRFYQHVSENSDLRETTRKMAKWYDNIWTDMNMRGDVFRAREVLYHKSGLAASRKQNSARYITEDIAKNAGFEDAESAIALEEEWKEAIRLGLGLPSKPQRDRFNQIQKRVEAIKSEFKNHHASDKGCNWFTPAELDGMDNDIIDQLAKGTGENEGRLKVTFDPSHYDIFLRDVKNSEARKRMWTAMENKCPENVPLFKEAMLLRDEAARLLGYPDHATLRIESRMAKTPRAVNNLLNDLRTRLAPLATKELNQLLQTKKKDCETRNLPFDGSFYHWDWAFYASQISKQEHDLDNKKVAEYFPIDSAITGMLRLFGVLFGIVFVRLTAEDLERISPTGVADDVMYHRDTIMFSVWNDESEGNDFLGYLYIDAHPREGKYRHVANFPLELGHQRTDGTRFYPSTAIVCNFPAPTKDKPSLLDHEHIVDLFHELGHGIHSLVSRTRFSRHHGTAGKRDFVEAPSQMLEHWTWRAEYIKRISKHYLTGEQMSDDMAERIAASRHFLQALRNLWQLSSAIFDMEVHSPKSRAALENMDFTKRYNELRNELTGMKGPEAIGEPIYHWSNTYSYDMFYFAFAKDPMDKSQGHRFRHTVLEKGASQDEMLILEQFLGRKPTTDAFCMELGLVEPMEEPLLKGSSFAGRDPVIEGASSEEDPAIEHHPF

SEQ ID NO: 98092 - DNA, 2418 bp, Neurospora crassa
  CDS (1)..(2418)
atgatacaacctctggttaaagccagtaggccccggctgtgggtctgctccgactgccttctccgacgcactctctctcctctgctcagacagcaacgacgacgattcacaggctttactgcgcatgctcccaagaccttgacgggcaccatccccgtcacccacaagaacggcgacacaaaacacgatgactctcttctacgatccatcttcgactcgcccgaaacatggaagcagttctccggcgacaagcatggccgaaacgtcggcctcttccgcaacgcatacctcaccagcccccatggcttcctcgactttgcccatgtgagcttgggaaaggctcgtgccctggtcgacaaggtcctcaacgcccaatctctcgacgaataccgcgccattgtccgccatctcgaccgcctaagcgatatcctgtgtcgcgtcttggacatggccgactttgtgcgcgtcacccatcctgaccagcaaatccagcggaccgcctcgatggcctgggacatgatgtacgagtacatgaaccagctcaacaccatgacgggcttgtacgaccagttggtccaggcaatggacaacccacaggttagcaccacctggtctgaggaggagaggatggtggccgaggtcctcaagctcgacttcgccaagtccgccgttcacctgcccaaggacgcccgggacaagtttgtacacctgtcgtcggcaattagccagacgggaaccaactttatccagcacatggaacccaagatcccatacaccactgttgaaaagtcccggatgatgggcatggatcccgtagaggtcaagaggatggcttccatgggcaaagtgtacgtccaaactctgagtccccaggcctcaatagcactccgtactgtacgcgatgaccacgcccgacaccaactattcatggcttctcgcaccgcttcccgcaggactgtccataccttggaggagctcatgttgttgcgtggtgagtcggccaagctctcgggtttcgagagttatggccacctcgtcctccacgaccgtatgatggccagcacccccgagtctgtgagacagtttctccaagctttgtccgaaaacaccagacctcaagctcaacaggaggtggctgatctcacagcagccaagagggcgcacaagggcggcgatgcaaccctcgagccctgggacaaggacttttacgccgagtccatccgtcaggccatcaagtcccggcagaagcgtgaagacctgtcctcttacttctccctcggcaccgttatgcaaggcctttccaggatattcacgcgcctctacggtattcgcttcgttccccgcgagcccatgcccggtgagacctggcaccctgacgtgcgtcggttagatgttgtctcggatgttgaaggccatgtcgccgtcctatactgcgatctattttaccgccccctcaagtcgcccaacccagctcactttactctccgctgctctcgtgagctgtcgccccacgagattgctgaaactgcccatacccaagccgagaacccacatgtgttgattccctccttcgagtctgccgagtttgctgccaatgatgggatggcctactctcgctcccaggatggtgctatcaagcaactccccaccattgctcttgtgtgtgactttccccagcaatcccacaaccggcccgcccttctgtctttctttcagcttgaaacgcttttccacgagatgggtcacgcgattcactccatcctggcccgaacctccttccagaacgttagtggtacccgatgcgccactgatctcgccgagcttccttctactttgatggaatactttgctgctgacccgtctgttctcgccctattcgcacgccactacgagactgacaacccccttccctatgagtgggtcgacaacaagatccgcgaggcccgtcgcttcgaggcgctggatactgaaaatcaaatcatccttgccatgctcgaccaggaattgcactcgtccaaggcggtgcaaggccacattgactccaccgaaatctttcacagccttcagagacagttcagcaccgccccgccggacccccaaggaacggcatggcagggctttttcggccacttggtcggatacggcagcacatattacagttacctctttgaccgggtcttggctcagagggtatggaatgtcgtattcaacagtggacaaggcggagcagcactgcagagagaaaacggagagaggttgaaggaaaacctgctcaagtggggaggtagcaaggacccttggaagtgccttgcgggtgcattgaaggatgagaggttagagggaggtggagagaaggcaatgaagttggttggaagctggggaggtcagcgggggacaaagagcgaccaagcagtatag

SEQ ID NO: 98093 - protein, 805 aa, Neurospora crassa
MIQPLVKASRPRLWVCSDCLLRRTLSPLLRQQRRRFTGFTAHAPKTLTGTIPVTHKNGDTKHDDSLLRSIFDSPETWKQFSGDKHGRNVGLFRNAYLTSPHGFLDFAHVSLGKARALVDKVLNAQSLDEYRAIVRHLDRLSDILCRVLDMADFVRVTHPDQQIQRTASMAWDMMYEYMNQLNTMTGLYDQLVQAMDNPQVSTTWSEEERMVAEVLKLDFAKSAVHLPKDARDKFVHLSSAISQTGTNFIQHMEPKIPYTTVEKSRMMGMDPVEVKRMASMGKVYVQTLSPQASIALRTVRDDHARHQLFMASRTASRRTVHTLEELMLLRGESAKLSGFESYGHLVLHDRMMASTPESVRQFLQALSENTRPQAQQEVADLTAAKRAHKGGDATLEPWDKDFYAESIRQAIKSRQKREDLSSYFSLGTVMQGLSRIFTRLYGIRFVPREPMPGETWHPDVRRLDVVSDVEGHVAVLYCDLFYRPLKSPNPAHFTLRCSRELSPHEIAETAHTQAENPHVLIPSFESAEFAANDGMAYSRSQDGAIKQLPTIALVCDFPQQSHNRPALLSFFQLETLFHEMGHAIHSILARTSFQNVSGTRCATDLAELPSTLMEYFAADPSVLALFARHYETDNPLPYEWVDNKIREARRFEALDTENQIILAMLDQELHSSKAVQGHIDSTEIFHSLQRQFSTAPPDPQGTAWQGFFGHLVGYGSTYYSYLFDRVLAQRVWNVVFNSGQGGAALQRENGERLKENLLKWGGSKDPWKCLAGALKDERLEGGGEKAMKLVGSWGGQRGTKSDQAV

SEQ ID NO: 98094 - DNA, 2346 bp, Magnaporthe grisea 70-15
  CDS (1)..(2346)
atgctggcggccccacgattatcccctcgcatctcgctgttcttatcgaacatccgaaacaatccgccgtacaatctcgcagctcacaagagcagcagcccgacttccaacttcgcaacatcctccagactatccctaccctcgacggctactagtcccacacgaacctacaaaccaattctcgctcatccacccggaatggtgatggacaagtacaagtcgccgccccaggcgcccccaaccttcacaggcaccaaggagagcatcgttggcgatgccaaggccctctgtgacacaacccgccagctgctggacaagctggtagccgagatccccgcggatgacaagtctaagacgacatttgagaccgtcatggagccacaggcagccgatgagaaccagaatgcactgtcgtccaggattctgggtttctaccaatacgtcagcggggatgcctccctccgcgatgccagcaccgaggctgagcggatcatggacgaattcgggatcgaatgcgggatgcgcgaggacgtttacaagctcgtggacgccaccttcaacgtctacggtggcaaggacggcatcgccaaggcctctggcattgatggcgagcaggcgaggatgctcgagaaggacgtcaagggctacatcaagaacggactgggtctcccggctggtccccagcgcgatcgcttcaaggagatcaagaagcgtctcagcgagctgaccatccaattcaccaagaacctcaacgaggagaacggcggagtgtggttctcaccctctgagctcgatggtgtccccgaggacactatctcgacgctcgagaagggcactggtgagaacgagggcaagctgaaggtctcgttcaagtaccccgagctgtggccgactctcaaatacgccaagaacgccgagacgagaaggaagatgtttgtcgcgaacgagaacaagtgcggatccaacgttgatctgttccgcgaggttattatactgcgagatgaggctgcgcgtcttatcagctaccccaaccacgcaactgtgcgcattgaggacaagatggccaagacgcccaagactgtgaaggatttcctcaacgaccttcgcacccgccttgctgatggtggtaagaaggagatcgaacatcttcttgagatcaagaagcaggattctcaggcgcgtggtgccgagtttgacggcaactactacctttgggaccacagatattacgacaggttgatgataatgcaggaatacggcatcgatggaaacaagattgccgagtacttccccctcagcaacacaatcgccggcatgctcaagatctttgagcacctctttggtctcgtctttgttgagcttacccccgaagatcgtgcgcgcatcagccccaccggaaaggcagaggatattgcatggcacgacgacgtcattatcttcagcgtctggaacgatgcttcggaaggtgacgattttgttggctacctgtacttggatctgcaccctcgccagggcaaatacggccatgctgccaacttcaacctccagcctggcttcctcaaggccgacggatctcgcaggtatccagctactgcacttgtctgcaacttttctaaaccgaccccgaacaagcccagtctgctgaagcatgaggaagtggtcaccttgttccacgagctcggccatggtattcatgaccttaccggccgtacgcgttacagccgcttccatggaacctcaacggttagggactttgttgaggccccaagccagctgcttgaggaatggtgctggacccctgaacagctcaaagcgctgtcgtcgcattaccagactggagagccgattccggaggacctgaccaaggctctaatcaagacgaagcacatcaacggagcactgttcaatctcagacaactgcactttggtatctttgatatgacgattcacactcctgagtcgcatgaggagctgaagaagatggatttctctgctgtgtacaacgaccttcgggccgacatcagcggcatcaaaggcccagaggcattgggtgagccgagcaactggggcaatggccaagcttgcttcggtcatctcatcggtggatatgatgctggctactacggctacctttcgtctcttgtgtacgccaccgatatgttcttcagcgttttccgcaaggaccccatggacggcaaggagggcaggcggtaccgccacactgttctgcagagaggtggatcacaggacgagatggaaaccctcaagcaattcttgggtcgtgagccgagcacagaggccttttaccaggagttgggtctgggtcagaagcaagagaagctctag

SEQ ID NO: 98095 - protein, 781 aa, Magnaporthe grisea 70-15
MLAAPRLSPRISLFLSNIRNNPPYNLAAHKSSSPTSNFATSSRLSLPSTATSPTRTYKPILAHPPGMVMDKYKSPPQAPPTFTGTKESIVGDAKALCDTTRQLLDKLVAEIPADDKSKTTFETVMEPQAADENQNALSSRILGFYQYVSGDASLRDASTEAERIMDEFGIECGMREDVYKLVDATFNVYGGKDGIAKASGIDGEQARMLEKDVKGYIKNGLGLPAGPQRDRFKEIKKRLSELTIQFTKNLNEENGGVWFSPSELDGVPEDTISTLEKGTGENEGKLKVSFKYPELWPTLKYAKNAETRRKMFVANENKCGSNVDLFREVIILRDEAARLISYPNHATVRIEDKMAKTPKTVKDFLNDLRTRLADGGKKEIEHLLEIKKQDSQARGAEFDGNYYLWDHRYYDRLMIMQEYGIDGNKIAEYFPLSNTIAGMLKIFEHLFGLVFVELTPEDRARISPTGKAEDIAWHDDVIIFSVWNDASEGDDFVGYLYLDLHPRQGKYGHAANFNLQPGFLKADGSRRYPATALVCNFSKPTPNKPSLLKHEEVVTLFHELGHGIHDLTGRTRYSRFHGTSTVRDFVEAPSQLLEEWCWTPEQLKALSSHYQTGEPIPEDLTKALIKTKHINGALFNLRQLHFGIFDMTIHTPESHEELKKMDFSAVYNDLRADISGIKGPEALGEPSNWGNGQACFGHLIGGYDAGYYGYLSSLVYATDMFFSVFRKDPMDGKEGRRYRHTVLQRGGSQDEMETLKQFLGREPSTEAFYQELGLGQKQEKL

SEQ ID NO: 98096 - DNA, 2439 bp, Magnaporthe grisea 70-15
  CDS (1)..(2439)
atgcttaagctcctccgccctcgaccatgggtttgcaacagctgccttaaccgagtggcatttccaaaaccataccccgtcggcagtcgtagcacaagatggctgtctacggcgcaaagtgctgctccagcggtttcgattccccccgtcaacccggtccccgctgaccacactaccagcggcactcacgacgacgccctcctcggcaagatctttgactgctcttcagcatggcgagacttctcagcgaggtcggccaagttccccacggagaacgcaggcctcttccggaacgcatatctcaccagcccagatggtttcctcacgtttgcgcagtcgtccctctccaaggcctctgccattgtgaatcgagtgctgggcgcatcgactattgaagagtacaagaccatagtcagggacttagacaggctcagcgatcttctttgtcgcgtcatagatctctcagactttgtgagggtcactcatcccgacgtgcgcatccagagggccgcttccgaggcgtggtacatggtgtatcagtacatgaaccagctcaacaccatgacggggctcaacgatcagctggggaaggccatggagaactccgacgtgaccaagacctggtccgaagaggagatggccgtggctcagctactcaaattggactttatgaaatcggccgtcaaccttccgcaagccgctcgggacaggttcgtcgatctgtcgcagagaataagcgagatcgggtccgactttgtcaatgagatggcccctgagcaacgccgtgtggttctcccgagcagcaagttccagggaatggatccacaaatcgcgcgcaggttcactaaacatggctatatgcagctgcccacgatgagcggtgaagcagccgccgccttgcgtactgttcacgacgaggagaccaggaaggccgtttatcttgccatcaggacggcatcaagccggtctgtcggtctgttggaggcgctgctgaagcacagagccgaactggccgatctcgctggatttgaaagctacggccacatgaccctccgagataggatgatggccaagactccggaatcaatcaacaaattccttgttgaactttccaagaacaacgcgcccagggtcctgcaggaggttgatagcctgttgcaggagaagaagactcttctcgcgtctccatcggcgacgctcaacccatgggacagagaatattatattcaacgtataagaaacgcccagggcaaaaatgtgaagcacgataacttctttgcttcatacttttccgtgggccgtgtcatgcagggcctttcgagactcttcactcgtctatacggcattcgctttgtgccgcgagagacgctgccgggtgagaaatggcaccccgatgtccgtcgcttggacgtcgtgtcagacacagacgggcacgtagctgtgctgtactgcgatttgttttatcgtgaagacaagtcacctaaccctgctcactttaccatccgctgttctcgcgctatatctgaggatgagatctcagaagcagccgtcagcaccagcgaaggtggccccgcctttgggtcacccgagtcggcagcgaacgacggcatggctgcatcgcgcggagccagtggaggcccgctgaagcagctgccgaccatcgcgctggtgtgcgacttcccccagcgcgacaatccccttagcggctccaagagcaagccagcatccctgacttttgcatcacttgagactcttttccacgagatgggacacgccatccactccgttttagcgcggacctcgttccagaacgtagcgggcactcgatgcgcgacagacttggccgaacttccatccaccctaatggaatatttcgcatcggacccgtcagtgttgtcgctattcgcccggcacgccgagacggacgagccgttagactatgacctcttggccgagcgtgtccgctctagaggccgattcgagggctgcgacacggactaccaaataattctggctatgctggatcaggcgtaccactcgccccttgcctcgtcagaatctttcgacacgacacgcgcctaccacgatttgcagcgcgagcacagccctctgggaccagatccttcgtcgacgcgctggcagggcttcttcggtcacctgtttggctacgggagcacctactacagctacctgtttgaccaggtgctcgccgagcgggcgtggaagaaggtcttctcgtcgggccaggacggtgccgcgctgagcagggaagctggtgagcacctcaaggagagcctgctgaagtggggcggcagccgcgagccgtggcgctgcgtttcggacgttctcagggacgagaggatagctggcggcggcgaggaggccatggctctggttggcagctgggggaccagcaacaagtcaaccatgaagcactaa

SEQ ID NO: 98097 - protein, 812 aa, Magnaporthe grisea 70-15
MLKLLRPRPWVCNSCLNRVAFPKPYPVGSRSTRWLSTAQSAAPAVSIPPVNPVPADHTTSGTHDDALLGKIFDCSSAWRDFSARSAKFPTENAGLFRNAYLTSPDGFLTFAQSSLSKASAIVNRVLGASTIEEYKTIVRDLDRLSDLLCRVIDLSDFVRVTHPDVRIQRAASEAWYMVYQYMNQLNTMTGLNDQLGKAMENSDVTKTWSEEEMAVAQLLKLDFMKSAVNLPQAARDRFVDLSQRISEIGSDFVNEMAPEQRRVVLPSSKFQGMDPQIARRFTKHGYMQLPTMSGEAAAALRTVHDEETRKAVYLAIRTASSRSVGLLEALLKHRAELADLAGFESYGHMTLRDRMMAKTPESINKFLVELSKNNAPRVLQEVDSLLQEKKTLLASPSATLNPWDREYYIQRIRNAQGKNVKHDNFFASYFSVGRVMQGLSRLFTRLYGIRFVPRETLPGEKWHPDVRRLDVVSDTDGHVAVLYCDLFYREDKSPNPAHFTIRCSRAISEDEISEAAVSTSEGGPAFGSPESAANDGMAASRGASGGPLKQLPTIALVCDFPQRDNPLSGSKSKPASLTFASLETLFHEMGHAIHSVLARTSFQNVAGTRCATDLAELPSTLMEYFASDPSVLSLFARHAETDEPLDYDLLAERVRSRGRFEGCDTDYQIILAMLDQAYHSPLASSESFDTTRAYHDLQREHSPLGPDPSSTRWQGFFGHLFGYGSTYYSYLFDQVLAERAWKKVFSSGQDGAALSREAGEHLKESLLKWGGSREPWRCVSDVLRDERIAGGGEEAMALVGSWGTSNKSTMKH

SEQ ID NO: 98098 - DNA, 2118 bp, Gibberella zeae PH-1
  CDS (1)..(2118)
atggctcccgacaagtatcgtaaccctcctcaggcgccgcctctgttcaccgccacccccgagtcgatcgcagccgacaccaagaagctctgcgatgctaccaaggatgtgctggactctgtcgcagccaatgtcaccgcagacaaggcctctttcgccaatgtccttgagcccatcctcatagatgagaacctggctgccactcagcgtcgcatcttgaccttctaccaccatgtttccaccaacaaggagctccgtgacgcttccaccgagtccgaaagagtctttaatgacttcggtatcgagtgtaacatgcgagaggacatcttcaacgctgtggatgcggctttcgccaaccgagaatcacaggatctcaccaaggagcaggcacacgttctcgagaaggagagaaataagtttatccgaaacgggcttcgtctgcctgctggccccaagcgagaccgattcaaggagatacagaagcgcctgagcgaactcgagattcagggccagaccaacctcaacgaagagaagggagccatctggttcactcccgaggagctcaagggagttcccagtgacgacattgacgtcgactcgctcgagaagggcactggtgagaacgaaggcaaggttaaactctcgttcaagtacaaccattacttccctcttattaaatatgcgattgacgccgacacccgccgcaagtacactgttgctgaatccaacaaggccaatgtcaatgtccctctcttccaggagatcattaccctccgtgacgaagctgcacgacttttgggttacgacaaccacgcagccctgcgcattgaggagaaaatggccaagagccccgctgccgttcgatctttcctggatgaccttcgaacccgacttaccgagggtggcgccaaggagattggcgccctcaaggagtacaagaagaaggattacgaggaacgcggcctatcatttgacgacagcttctacatgtgggacacatccttttactcccgaatccagaaggagaaggagtacagtgttgacgaggcaaagatctctcagtacttccctgtcgactcaacctttgccggcatgctgaagatctttgaggagatctttggattcgtctttgttgagcttacgcccgaagagagagccagactgagccccactggcaaggccgaggacatcgtgtggcacgaggatgttctgatttacagcgtctgggatgacgaggcctcgggttcaagcttcaacggctacctgtaccttgaccttcacccccgtgacaacaagtatggccacaacgccaacttcaacctggagcctggttatgtcactgaggatggcaagaagcactaccccgttactgctctggtctgcaattttagcaagccaactcccaagaagccatctctgctgaagcaccacgaggttgtgaccctgttccacgagctgggtcatggtatccacgacttggctggtcgcacccgctacagctacttccacggaacttccacagtgctcgactttgtcgaggctccatcccagatgctcgagaattggtgctggactcccagcgtactcaagtcactttctaagcactgggaaacaaaggagcaaatccccgatgagcttatcgaaaagcttgtttcaaccaagcgtctcaactcagcaattggcgctcttggacagctcgttattggcttgtttgacatgactgtgcacactcctgagtctcacgaggctgttaagaagctcaacgctggtcgaacctggaacgagcttcgacatgacatctctggtaccaagggtcctgaggaccttggagagggactggaatggggcaaccgacatgctgggatcggccacttcattggtggatacgatgctggatactacggctacctctactccgaggtgttctcgctggacatgttccactcgttcttcgccaagaacccaatggacagtaaggaaggtcgacgttaccgccataccgtgctagagcgaggaggaagtatccctgagatggagttcttgaaggagttccttggccgggagcctagctcggaagctttctacaaggagcttgggctttcgtcatctacttcctag

SEQ ID NO: 98099 - protein, 705 aa, Gibberella zeae PH-1
MAPDKYRNPPQAPPLFTATPESIAADTKKLCDATKDVLDSVAANVTADKASFANVLEPILIDENLAATQRRILTFYHHVSTNKELRDASTESERVFNDFGIECNMREDIFNAVDAAFANRESQDLTKEQAHVLEKERNKFIRNGLRLPAGPKRDRFKEIQKRLSELEIQGQTNLNEEKGAIWFTPEELKGVPSDDIDVDSLEKGTGENEGKVKLSFKYNHYFPLIKYAIDADTRRKYTVAESNKANVNVPLFQEIITLRDEAARLLGYDNHAALRIEEKMAKSPAAVRSFLDDLRTRLTEGGAKEIGALKEYKKKDYEERGLSFDDSFYMWDTSFYSRIQKEKEYSVDEAKISQYFPVDSTFAGMLKIFEEIFGFVFVELTPEERARLSPTGKAEDIVWHEDVLIYSVWDDEASGSSFNGYLYLDLHPRDNKYGHNANFNLEPGYVTEDGKKHYPVTALVCNFSKPTPKKPSLLKHHEVVTLFHELGHGIHDLAGRTRYSYFHGTSTVLDFVEAPSQMLENWCWTPSVLKSLSKHWETKEQIPDELIEKLVSTKRLNSAIGALGQLVIGLFDMTVHTPESHEAVKKLNAGRTWNELRHDISGTKGPEDLGEGLEWGNRHAGIGHFIGGYDAGYYGYLYSEVFSLDMFHSFFAKNPMDSKEGRRYRHTVLERGGSIPEMEFLKEFLGREPSSEAFYKELGLSSSTS

SEQ ID NO: 98100 - DNA, 2364 bp, Gibberella zeae PH-1
  CDS (1)..(2364)
atgctgaaatcgagaggcaaccgcctctggatatgcaatagatgtattcagcacacgacaaaacctccgcaacggagatggcaatctatcgcttccgcagtcgctcaagcagtctctccaagcaatccagtcgaccatgccgcaagctcgagccacgatgatgccgtcctgcgcaatttgttcgacgctcccgccggaagatctttccctaagttcagcttgaagaagagccagggtttattcaagaatcgatatctcacaagcccgaacggcttccaccacttcgcacagaaaaacctcgagcgagccacaaagattgttcgaaaggtcctcagtgcttcctcaatagaagagtaccaggcggtcgttcgcgatcttgaccggctcagcgatttattatgtcgtgtactcgatctctcggacttcgtccgcatgacgcatccggatgctcggttccaagaagccgctgctgatgcctgggggatggtttatcaatatatgaatcaactcaataccatgactgggttgagtgatcaattgagccaggctttatcgatgcccgaagttacaaaagtgtggtcggaagaagagaggacagttgctgaacagctcaagttggactttacgaaatcggcagtcaatctaccaaaggcctcacgggacagattcgtggatttgtcttcacgcattagtgaaatagggtcggcttttgcacaggggatgcaaccggcgaaaaagtcattgactttaccggcttacaagttttacggcctttaccctggaattgcagcgactctcaaagttcgacaaaatatcgtgctccccactctcagctcagacgcgataggagcgctccagagcgtacacgatgaggatactcgtagagagatctacctggcccaacgaacggcgtccaaagacaccatcatgtatctcgaagctatgcttaagcttaggggcgagcttgcggagcttgcaggttttgaaagctatggccatatggctctcaaggaccgtatgatggccaagacaccctcatctgtgatggaattcttgcttgctttgagagacaacaacactcccataatccaagccgaattacaagagcttattgcgaagaagcgagacaggctcaacctcccagacgtccagcttcaagcctgggataaggacttttatatggaaaagacccgagtcgatctaagatctcggcaacggcgagaagaccaactcaacgcattcttttccgtcggaacagtgatacagggcttatcacggctgtttgatcgattgtacggcatccgtctcgttctacgggaaactttgtcaggagagacttggcaccccgaagttaaacgacttgatgtcgttaccgataaaggcgaattgatcgccgttctctactgcgatctgttccatcgtccacaaaagtcaggcaaccctgctcactttacggtgagatgctctcgagagatcttgcccgatgaagttgcagagattgctgctgaccagggcaatgggccaagctttgagtcaccagaactggcagctaatgatggtatggaggtttcgacgaaagacggggtgctaaagcaactgcctactatcgcactggtgtgcgatttccttcccagcgaaaattccaaggaaccatccttgctctcttatcaatctgtcgagactctgttccacgaaatgggacacgctattcattctatccttgcacgaaccagctttcaaaatgtctctggtactcgttgtgctactgatttcgcagagttaccatcaacgcttatggagcacttcgccgctgaccctactgttctgtccctatttgcgcgccattggaagacagaccgagccttgccttacgagcttgttgctgagaggatcggcttgacaaagcgtttcgagggtatggaaacggagaaccaaatcatacttgcaatggtggaccaggcatatcactcgtcaagtattaaaaatgcaggctttgatacgacctctatctttcatgatatcaaggctcgctttgcccacggtcctcgagatccgccaagtacctgctggcagggcttctttggtcacttgcatagttacggtagtacctactatagctatctctttgaccgtgttctcgctgagcgtgtctggcgcgttgtcttcaaagcgggcgagaatggcggtgccattaaccgtgagaacggagagcggctgaaagagaatctcctaaaatggggaggtggccgagatccttggacttgtttgtctgatacccttcaagatgagagactcgcacctggtgacgagaagtccatggcattagtgggaagttggggaatcaaggacgaccaccacccgtga

SEQ ID NO: 98101 - protein, 787 aa, Gibberella zeae PH-1
MLKSRGNRLWICNRCIQHTTKPPQRRWQSIASAVAQAVSPSNPVDHAASSSHDDAVLRNLFDAPAGRSFPKFSLKKSQGLFKNRYLTSPNGFHHFAQKNLERATKIVRKVLSASSIEEYQAVVRDLDRLSDLLCRVLDLSDFVRMTHPDARFQEAAADAWGMVYQYMNQLNTMTGLSDQLSQALSMPEVTKVWSEEERTVAEQLKLDFTKSAVNLPKASRDRFVDLSSRISEIGSAFAQGMQPAKKSLTLPAYKFYGLYPGIAATLKVRQNIVLPTLSSDAIGALQSVHDEDTRREIYLAQRTASKDTIMYLEAMLKLRGELAELAGFESYGHMALKDRMMAKTPSSVMEFLLALRDNNTPIIQAELQELIAKKRDRLNLPDVQLQAWDKDFYMEKTRVDLRSRQRREDQLNAFFSVGTVIQGLSRLFDRLYGIRLVLRETLSGETWHPEVKRLDVVTDKGELIAVLYCDLFHRPQKSGNPAHFTVRCSREILPDEVAEIAADQGNGPSFESPELAANDGMEVSTKDGVLKQLPTIALVCDFLPSENSKEPSLLSYQSVETLFHEMGHAIHSILARTSFQNVSGTRCATDFAELPSTLMEHFAADPTVLSLFARHWKTDRALPYELVAERIGLTKRFEGMETENQIILAMVDQAYHSSSIKNAGFDTTSIFHDIKARFAHGPRDPPSTCWQGFFGHLHSYGSTYYSYLFDRVLAERVWRVVFKAGENGGAINRENGERLKENLLKWGGGRDPWTCLSDTLQDERLAPGDEKSMALVGSWGIKDDHHP

SEQ ID NO: 98102 - DNA, 2103 bp, Gibberella zeae PH-1
  CDS (1)..(2103)
atgtcatccaatacacccccgcaacctcccccctcattcaccaccaacccctccgaaatcctcagccaaacaacgaatctcatctcctccacaacagccctcgaagactccctcgtctcttccctcacgccctcaaccgctactttctcaagtcttctcacgccaattctaaaagatgaccacgcagtttccaagaagaccctcctaattcgcctctttagctccgtctccgaagacaaagaccttcgcgatgcatcccgcacagcagaagaaatgcttctcaaagctaattcagcagcgctcatgcgcaaagacgtcgcagctctcgtaaaagctgtctacgaaaagagtcagcgtggcgaagagaaactttgtgaagaagatgcgtatatgttgttcaagacacacagagcgtatcagaacacaggcgctggtatcgaagacgaagcgctgcgagagaaatacaaagctgctgtacaagagcgaaatgaagtcctcatcgcagcaaaaaagaccatcagtgaatccgacgatggcatttatttcacccgctctcaactcagcggcgtgccctcctcagtcctcgacgccatgaaagtcaacgacaaaggcgagcttaaagcaacctttaaaaaaggccatctcatctccataatgaaacacaccaccagcgccagtacacgaaaggcatatcacatcgccaaagaaagccggttccccgagaacgtgggccgtctggaacgagcagtcgagctgcgaaacagcacggcgcgaatgctcggcttcaaaacacacgcggagctcaaaatggaggataaaatggcaaagagtgttgagagcgttgtaacaatgcttaataagctgcgagtacaattgaagcctcttgctgacgaggagatgaagacgctgttcgagataaagaaggcgtatgtgcaggaacacggtactgatgaggcagagcaggatttggataggatgaatgcttgggactgggcattttatgcgcggatccttgagaaggagagatattctgttgattcgcttcttatatcggagtattttgaggtcaaccatagtcttgaaggcatgcttcgtatctttgaggagatctttggtatggtatttatcttgactgatgcaccagtttggcagaaggatgtcaccgtttacgaagcttggaactcggaggatcaaggtggtgagttcttggggtacctctacctcgacctttatgcgcgagagggcaaatatgctggcgcgcacagctctcttatccaacctggcttcataactccagacaacaaacgccactacccttcttcatctctagtaacatccctcctccacacccccggccatccaaccctccttctacactccgagctcaaaacaatgttccacgaactcggccacgcaatccacaagctcgtaacccacacaaaacaccaacacggctgctctcgcgactttgtcgaaatccccagcattctccttgagaactggatatgggtaccttccgtgctgcgccgtctcggaaaacactacagttatttgaacgacgagtacctaagcttctggaaggttcagaaaggtgatgtgaatacaagaccagaggaggagttacctgagaagttgacgcttgatcttgcaaagactaagcatgttaacggtgcgcatgcgatgctgcatcaggtttttctcgctttgtttgatctgacgatccataacgcagatgaggctcatcctgtggataccaccaaactttggaacgagagtaaatctgaaatcatgggtcttggacgagcggatagtattggacaagcatcattcgcccatcctttccgcggatatgacgctgcgtatttcacatatgcattatcgaaagtttacgcgaccgacctgtgggttagccacttcaaagccgacccaatggacaagaagacgggattgcggtatcgacagcatgtgttgcagccgggaggaagtcagcctgaactcaagagccttagtaacttcctaggtcgcgaaccaaatgacgaggcatactattcggaagttaccagcacgtcggggcctgaagcacaaaagtctgcctctttgtaa

SEQ ID NO: 98103 - protein, 700 aa, Gibberella zeae PH-1
MSSNTPPQPPPSFTTNPSEILSQTTNLISSTTALEDSLVSSLTPSTATFSSLLTPILKDDHAVSKKTLLIRLFSSVSEDKDLRDASRTAEEMLLKANSAALMRKDVAALVKAVYEKSQRGEEKLCEEDAYMLFKTHRAYQNTGAGIEDEALREKYKAAVQERNEVLIAAKKTISESDDGIYFTRSQLSGVPSSVLDAMKVNDKGELKATFKKGHLISIMKHTTSASTRKAYHIAKESRFPENVGRLERAVELRNSTARMLGFKTHAELKMEDKMAKSVESVVTMLNKLRVQLKPLADEEMKTLFEIKKAYVQEHGTDEAEQDLDRMNAWDWAFYARILEKERYSVDSLLISEYFEVNHSLEGMLRIFEEIFGMVFILTDAPVWQKDVTVYEAWNSEDQGGEFLGYLYLDLYAREGKYAGAHSSLIQPGFITPDNKRHYPSSSLVTSLLHTPGHPTLLLHSELKTMFHELGHAIHKLVTHTKHQHGCSRDFVEIPSILLENWIWVPSVLRRLGKHYSYLNDEYLSFWKVQKGDVNTRPEEELPEKLTLDLAKTKHVNGAHAMLHQVFLALFDLTIHNADEAHPVDTTKLWNESKSEIMGLGRADSIGQASFAHPFRGYDAAYFTYALSKVYATDLWVSHFKADPMDKKTGLRYRQHVLQPGGSQPELKSLSNFLGREPNDEAYYSEVTSTSGPEAQKSASL

SEQ ID NO: 98104 - DNA, 1911 bp, Gibberella zeae PH-1
  CDS (1)..(1911)
atgacttctcgaggagctatccctccccctccatcttttgagaatctcaagcctgatggggtactggccgagacccaagatatactcaactctacttcaaccctgcatgacactctatccgctacattcacaggcgcaaccgcagattttgcctgtgtaatccgccctattgtggacgatgccaaccgcgcagcatgtcgcttacgcattttgacgaccctactgggtcagttgtcaccggatcgggaactgcgacatgccgcccaacaggccgaaatccgtgccgctgcagctcaagccaacattctcatgcgcagtgacattgcatccctggttgcagcggtatacgagaaagacaagatcgtgccggatggaaaccttgatgagcaagatcgccatttacttgctcatatgcatgacgagtacgtacgttctggggcgtgtctaccaagtgacgacaagcgggaagaacttcgcgttgcgctcgaggagataaatgctcttcgatgcgaagcacaagtcgccttcacagaagaagaggacggtatctggttccagcgttcagacttggcgggcgtaccggagaacgcgctaaaatcaatgactcaagagggatctcggatccgggtaacatatcgcaatgaccatgtgacggctgtaatgcgacatgccctcagtagcgagatgcgtcgaaaattcgcactcgctcagcaaaatcgtcttcccgataatgtagtacgtttagccaagctagtcgctttacgcgatcatgttgcacggctcttggggtttgaacaccatgcggcttttaaaataacggacaagatggcacccagcgttgcctacgttgagcatcagttaaacgaccttcaccagaggctaaatccaattgcaatagctgaaatcaagaaactgcttcgtctcaaagagatggattctggtgctggggagctatattcgtgggacagggcgtattatcttcacaagcaaaaccaggagaatctctctgcagaccatgctcttttagcagaatactttgaagtcactcacacccttcaagggatgctcaacgtttttaatgagctttttggtatcaagtttatgcgcatcaagacctcagtatggcacgatagtgtcgtggcatatgaagcctgggatacacctgacgagggaggaaatttcctgggacatttgtacttggatatatttgagagaaaagggaaatatcacggcgcgcagcacgtcatgattcagccgggcttcactttggcgaataatgacaaacactacccggtgtcagcgttagtgtgtagcttccgcaactcagcgccttcccacccatctctacttcagcacagtgaggtgaaaaccatgtttcatgagcttggacatgctattcacaacattgttgccagaaccaagtattccatccctcattcgcgagactttatagagattccgagcatcatgttagagaactggatctggctccccgatatactcgttcggctgggtcgtcactatgagacctacaaggccctaccacgggacctagcagaagggatcgcacgcactagaaacgcaaacagggctagcaacatccttgctcaggttcagccagccttattcgaccttgccatccatacacctccaactcataaagatgcattagaaatggacacaaccgcaatttggaatttaacgaagagagacatactaccgtatagctttgggccaaccccgcaagatttaggggctggacaggcgcgattcgcacacatgtttcgcaagaacgacgggggttacttcgcttatcccttatctatggtctatgcggcagacatattcgcatgcgcattttcacgagacccaatggatccgaaaagccagggtctagtcgtgcagagatag

SEQ ID NO: 98105 - protein, 636 aa, Gibberella zeae PH-1
MTSRGAIPPPPSFENLKPDGVLAETQDILNSTSTLHDTLSATFTGATADFACVIRPIVDDANRAACRLRILTTLLGQLSPDRELRHAAQQAEIRAAAAQANILMRSDIASLVAAVYEKDKIVPDGNLDEQDRHLLAHMHDEYVRSGACLPSDDKREELRVALEEINALRCEAQVAFTEEEDGIWFQRSDLAGVPENALKSMTQEGSRIRVTYRNDHVTAVMRHALSSEMRRKFALAQQNRLPDNVVRLAKLVALRDHVARLLGFEHHAAFKITDKMAPSVAYVEHQLNDLHQRLNPIAIAEIKKLLRLKEMDSGAGELYSWDRAYYLHKQNQENLSADHALLAEYFEVTHTLQGMLNVFNELFGIKFMRIKTSVWHDSVVAYEAWDTPDEGGNFLGHLYLDIFERKGKYHGAQHVMIQPGFTLANNDKHYPVSALVCSFRNSAPSHPSLLQHSEVKTMFHELGHAIHNIVARTKYSIPHSRDFIEIPSIMLENWIWLPDILVRLGRHYETYKALPRDLAEGIARTRNANRASNILAQVQPALFDLAIHTPPTHKDALEMDTTAIWNLTKRDILPYSFGPTPQDLGAGQARFAHMFRKNDGGYFAYPLSMVYAADIFACAFSRDPMDPKSQGLVVQR

SEQ ID NO: 98106 - DNA, 2211 bp, Apis mellifera
  CDS (1)..(2211)
atgtttttaaaaaatataaaagtgacctcattttatagtaaaaaaattattttatctcagaacagtctcctaaaaattccgagacgtaatggttatttgattcttgttccagaaattggagaagatttaccaggaaaatatcctttattaaaggaagataaaagtccggaatttacaaatattacgatagaaaaatgtattgctgttattggaagacaagcattagaatttgaagaaacaattaaaactttagaaaaacaaatagaaaaggaaatgtatacttctttgaatattacatggggcatttcaaaaacattatatttaggaaaccagagtttaatgcctacacaatattatataaatattgatggacgtgctagaagagcttctgcttctaaatatattagtacaccaatatatcaagcatgtaaaaatgttttcaataacagtcatagcaaattaagtgatgaacaaaaaaaagttttaacaaaatatatattggaaggaaaattaaatggattagaattatctgaaaagaaaaaggaacaattttcagcattaagattgtggttatgtgataaaattaaagaatattcacaaaaattagagactgctataaatcatcttagttttactataagagatcctatactaatgaaagattttcctgaagagttattaaaatctattgcaccagattctacaaaatttcttgttggaccatggataataactttaactccagaagttgtagaaccatttatagaacattgtcctgatcgtacattaagatgtaaagtgtgggaaacaaatgttattaaagcatctgtattacatgataaatcagtacaaacaagcacaactttggaagatattagacaaaagagaaatcaagaagctaatttgctaggatacaaatcatttgctgatttaagtatggaaactaaaatggcagctagtgtgaaaaatgtttatcatatattgaatactttattagctacagctcgtcctgctcaagaatatgaaattaaagaacttcaagcatttgcaagtaaagaaggtcttgaaggtacacttcaactttgggatatatcatattggggtagactacaattacgaactgtatatgaatataaggaagaggatttaaataattattttcttctaccaaaagtattaaatggtttatttgaactaattgaaattttatttgatgtaaaaattattgaaaccaaaaaaacagatctttggcataaagatgttcgattttttgatgtttttgatatgaagaaatcaagcactgatccattaggcagtttttacttagatccatatgcaagaagagatgaaaaaattagagtatcacaaaattcaggatatacagtctcaatacaaaataaaagtaaaatatgtaatataaaaccattagttgcattaatattcaattttcaaccacctgtcaatgagaaaccttctttgctttcattcaaagatctccaaacgctatttcgacagtttggacatgcattgcattatttaataacaaaagtggaatacacagatattgctggactttcatttgtggaatgggatgcattatttatttctgattattttcttgaaaattggttatatgaaccattatttttgcaaagaatttcatgtcatcaaattacaggagaatcattaccattaagtatgattgataagttaaaaaatgcaaaaacgcatttatcaggttataatttatgtaaagaattatatttatcacaatttgatttagaattatattctggcaaagaattttggaataatataatgactcgtttatggaaaaaatattttgtacttcctcctaataaaaaagacagtcatatatgttcttttgaacctatatttagtggaagttgggcagctgcttattacagtcatatttggtcaaaaatgattgctgctgatttatatagtgcttttcaagatatctcttatgagaacaaagaatcattaaaagcactcggtaatagatatcgcgaatcatttttagttgtaggtggcacttattctacacgggaaaatttcagaaaattcagtggaagagatcctaatccaaaagcacttttgaaaacgcttaacttagatataaagagtaatatgttagaaactaataccggaatatctcaaaaaaataaaataatgaacagtgaaatataa

SEQ ID NO: 98107 - protein, 736 aa, Apis mellifera
MFLKNIKVTSFYSKKIILSQNSLLKIPRRNGYLILVPEIGEDLPGKYPLLKEDKSPEFTNITIEKCIAVIGRQALEFEETIKTLEKQIEKEMYTSLNITWGISKTLYLGNQSLMPTQYYINIDGRARRASASKYISTPIYQACKNVFNNSHSKLSDEQKKVLTKYILEGKLNGLELSEKKKEQFSALRLWLCDKIKEYSQKLETAINHLSFTIRDPILMKDFPEELLKSIAPDSTKFLVGPWIITLTPEVVEPFIEHCPDRTLRCKVWETNVIKASVLHDKSVQTSTTLEDIRQKRNQEANLLGYKSFADLSMETKMAASVKNVYHILNTLLATARPAQEYEIKELQAFASKEGLEGTLQLWDISYWGRLQLRTVYEYKEEDLNNYFLLPKVLNGLFELIEILFDVKIIETKKTDLWHKDVRFFDVFDMKKSSTDPLGSFYLDPYARRDEKIRVSQNSGYTVSIQNKSKICNIKPLVALIFNFQPPVNEKPSLLSFKDLQTLFRQFGHALHYLITKVEYTDIAGLSFVEWDALFISDYFLENWLYEPLFLQRISCHQITGESLPLSMIDKLKNAKTHLSGYNLCKELYLSQFDLELYSGKEFWNNIMTRLWKKYFVLPPNKKDSHICSFEPIFSGSWAAAYYSHIWSKMIAADLYSAFQDISYENKESLKALGNRYRESFLVVGGTYSTRENFRKFSGRDPNPKALLKTLNLDIKSNMLETNTGISQKNKIMNSEI

SEQ ID NO: 98108 - DNA, 2670 bp, Ustilago maydis 521
  CDS (1)..(2670)
atggcgtccacgtcgaagaacgcacagcgcgctgctgcttcggtagctcactcatatcacgtttgtctagcacggcgtatgtcgcggctgccgacactgctctccaacatcagcgcaccagctgcctcgaaggcattggatcgatatgaaagcaaacgcattcatagtagatccttcagctcatctctagcggcgcaaagagtccagcgacccacatctgctggtccaatactcaccaatcccatctcggaccacgaaaaggacaacgacgaactgcgctccctgttcgacgcaccaccaacttcctcttccgcgaaccatcttagatcatctggcccctcaacaggactgttcgagatcccttcactcacatcgccacaaaattttctcgtcctagcgcagcagacgcttgcgcgtgcccagctgctcgtagaccggatcgaccgggctggttccgcggacgccagcacagctcaaggcatcaaggagctcaaagaagtggttcgaaacctcgataggcttagcgaccttctctgcggagtcattgatatggccgaactggtgcgcaatgctcatcctgacccggagtgggccgaagcagccaatgcggcatacgaatatctgtgcggctacatgaacgttctcaacacacacactgggctgtacagtgtactcaagaacattctctctattaaagaggtagcagagacgctatcaaaggaagccacggctgtagcacaggtgtttttacgcgactttgaaaagtcgggcatccatctaccaccagctgagcgcgaacgattcgtgcagctctcggacgaaattttggttctcggtcgcggattcttgcaagacatcgctgggaatgatgcttcagacgactttgctcgcatagcaagtgcacaagcggatgcggacaaatcagacatggttgggctgccaacgcattggttggaagacgtcaatccgacgatactgaaagcggtgcgagcgagcgcgattactgacaccgatggcttgctcaccttttccgccgccgaccaaccatgggtatttcaaacactactcaagtacgcgccggatgaacgtgctcggaaggtcgccttccgcgctgcgaactacggcagccaggctcaggtgcaacgtctggaacggctgctgaaagcgcgtgctgaacttgccactctcacgggcgccagttcgtacgctgaaatggctttgggagacaaaatggccaaagagccgcagaacgtcgaagaatttctgcgtgcgctaacgaaacatcatcgtccgcgagcctcgcacgacctcgacaagcttcggcgactcaaacacaatgccaccgtctcagagcctgcccaaaacacacggcaatcgacgttcaacacaaattcgacgctgcccgagttcgcaccgtgggatagggatatgtacaccgaacaacattttcgttcggcatcgctcagcaacgttcagcctctctcgccgtatttgagtgtcggatccgtgttcgccgggctttctcggttgttttctgcattgtacggcatacgcttccgagccagtatggtggctcccggcgaagtttggagcgaaggagcaggtgatgtgatgaaggtcgaggtgctggatgaatccgaaggtgcgcgtggcaccagtggctctgctgagggcttgatcgggaccatctacgcggatctttggagtcgagaggggaagcctggcggagcagcgcactacactgttcgttgctccaggagggtggacaaggacgatgaagcaggagattttacttatggacgagccgaggatgggcgggtggtgagacctcaagatctgggaggggaagggtgtgggaacccactacaagcgccaacgttcgaacagcgcgagcgtcctggaaggtaccagttacctgtcgtagtcttgatgtgcgactttgctcgtccgggaaacgcgaatcaagggccgtgtctgctgggttggcatgaggtcgaaacgttgtttcacgaaatgggccatgcgatccattcgatgattggacgaacttcgtaccacaacgtatctggtacacgctgcgcgaccgactttgtcgaactaccgtcgatcctgatggaacattttgtctcttctcctcaagtggttcacctgctcgcacgccatcattctaccggggcaagtttaccgttcgaacacctctcatcgcatctcgccgcaagtaaatcactggaaggcttggatacataccaccagatcctgctcgcgcgtctggaccagctctaccactcacagctagctgcgtctccctcgttctcgtctaccacgacctactcggatctggatcgtcaaatgcatctcccgggagctcccaacctgtcgtatacagaaggcgctcatccacaagtacgcttcggccacctgttcggttacggcagcacgtactactcgtacctgttggatcgggtgatcgcgagcaaagtgtggaaccatcttttcgccaataacccactcgacaggtacgctggccaagtattcaagaaccaatgcttaaagtacggcggtggcaaagacccctggcacatcctcgccgacgtgctcaacgaagactctgtcaggcaaggcgattctcgcgccatgcaacaggtcggaaagtggggcatcgagtgctaa

SEQ ID NO: 98109 - protein, 889 aa, Ustilago maydis 521
MASTSKNAQRAAASVAHSYHVCLARRMSRLPTLLSNISAPAASKALDRYESKRIHSRSFSSSLAAQRVQRPTSAGPILTNPISDHEKDNDELRSLFDAPPTSSSANHLRSSGPSTGLFEIPSLTSPQNFLVLAQQTLARAQLLVDRIDRAGSADASTAQGIKELKEVVRNLDRLSDLLCGVIDMAELVRNAHPDPEWAEAANAAYEYLCGYMNVLNTHTGLYSVLKNILSIKEVAETLSKEATAVAQVFLRDFEKSGIHLPPAERERFVQLSDEILVLGRGFLQDIAGNDASDDFARIASAQADADKSDMVGLPTHWLEDVNPTILKAVRASAITDTDGLLTFSAADQPWVFQTLLKYAPDERARKVAFRAANYGSQAQVQRLERLLKARAELATLTGASSYAEMALGDKMAKEPQNVEEFLRALTKHHRPRASHDLDKLRRLKHNATVSEPAQNTRQSTFNTNSTLPEFAPWDRDMYTEQHFRSASLSNVQPLSPYLSVGSVFAGLSRLFSALYGIRFRASMVAPGEVWSEGAGDVMKVEVLDESEGARGTSGSAEGLIGTIYADLWSREGKPGGAAHYTVRCSRRVDKDDEAGDFTYGRAEDGRVVRPQDLGGEGCGNPLQAPTFEQRERPGRYQLPVVVLMCDFARPGNANQGPCLLGWHEVETLFHEMGHAIHSMIGRTSYHNVSGTRCATDFVELPSILMEHFVSSPQVVHLLARHHSTGASLPFEHLSSHLAASKSLEGLDTYHQILLARLDQLYHSQLAASPSFSSTTTYSDLDRQMHLPGAPNLSYTEGAHPQVRFGHLFGYGSTYYSYLLDRVIASKVWNHLFANNPLDRYAGQVFKNQCLKYGGGKDPWHILADVLNEDSVRQGDSRAMQQVGKWGIEC

SEQ ID NO: 98110 - DNA, 3330 bp, Gallus gallus
  CDS (1)..(3330)
atgaagcagctcctattcagcacagaagaagcacaaaagcaggatatctgtacacaggcatatcctggcattcccggcaatcctggacacaatggcatacctggtcgtgatggacgtgatggctcaaaaggcgacaagggggacacaggtgaggcgggacttcctggcattccagggaaagatggtgcacatggagaaaaaggccaaaaaggagccaatggaactgttgaagagaaggggaacaaaggagataaaggagaaagaggacgacctggaaaactaggaccaaaaggaattatagggtcagtgggttacaaaggtcagaagggagagctgggactgcaaggacaaaaggggttaaaaggagacattgggcccttaggtccaaaagggacgaagggtgaaattggccatcctggaataattggtttgccagggccagttggccccattggtaatccaggtcctaaaggtaatactggagatctggggccaccaggtagtccaggaattcagggggaaagaggcttgaaaggagacagaggagacaaggggaacacaggtgccccagcagttctgccaaggagcgctttcagtgtaggccttacagctgccaccaaatttcctccccacagtcacccgatcaagttcgataaggtgctttataatggcctaagtgactataatccagttacaggcaaattcacctgcaaattctctggtgtttactacttcacctaccatatcactgtctactcgaggaatgtccgagtagctctagtcaaaaatgggatcaagatgttgcacaccatggatggataccagggtgctgaggaccaggcgtcaggagctgccatccttcaactacgggcaggagatgaggtgtggctgcaggctcatcgaggagagaccttcaatgggctgtttgcagatgctgatgatgataccaccttcactgggttcctcctctccaccgcacggccgcgaggaggcagcgcggggccggccgggctgaggggaggcaccgctcccgcccagcttcccgctcgcgagcgccgctccccgcctcaggccgggacgcgcagaggtcgcggccgtgcccggaaccgggctcccgcggagcttctaggcgcgttgccggcgttaccgcgctccgccatgctggccggctgccggagagcgctgcccgcggctctgggccttgcgctgcggggccgggcggccgggaggccgggacggcgggccgtcagcaccagctggtgccccgtgggtgccgccttcgatgtgaagcagcagcgcaacagcgcggcgggcagggaaacgggtctgtttggtgttccagagctgagttgtccagaaggatttcaagaagcacaggacaaagcattgcaagaatctgaacagctagttcagaaggcatgttcaacaccacctgggcctgagattgtaatgatctttgatcagctttcagatgctttgtgcagagtagcagatttggctgattttgtgaaaattgcccatcctgactttgcattcagagaggctgccgaagaagcttgccggaatatcagtactatggttgaaaaattaaatacagatgttgaactgtgccagagtttgagacggttgttagctgataaagttgttatggattcacttgatccagaaaccaggcgagtggcagaactttttatgtttgattttgagatcagtggcattcatttggatgaagaaaagcgtaaaaaggcagtcaacctcaacgtcagaatattggatttatgtaatgaatttctcacaggaactcaccttcccaacaagattgacaaacgtgttttgccagagcatattcagtctaattttacgactgaaggcaattacttagaagttgctggtctgcatgctgactgtcccaatgatctggtacgagaagctgcttacaagatttttctttacccaaatgctgagcagctaagctgtctagaagaattgcttgctagccgaaacagtctggcacagttggttgggtatgacacctttgcccacagggctcttcagggaacaatggccaaaaatccagagacagtaacacagtttctagagaagctttctgaccagctgtctgaaagaactcaaaaagattttgaaatgatgacaacgatgaaaatgaagcttaacccccagaattcaaaattgatgccgtgggatcatccttactacagtggcgtccttcgtgctgagaggtacaacattgatcctggcttgtactgtccgttcttctctctcggggcctgcatggaaggtttgaattctttgttcagtcagctcctagggatctccctgtatgctgaacaaacacagagaggagaggtttggtctgaagatgttagaaagctggctgttgttcatgaaaatgaaggtttgctgggatacatctactgtgacttctttcaacgaccagataaaccacatcaggattgtcacttcacagttcgtggaggcaggctaaaggaaaatggagagtaccagctgcctgtagttgttcttatgcttagcctacctcattcaacaaggaatgcaccaacactactaagtcctggcatgatggagaacctcttccatgaaatggggcatgctatgcattctatgctgggacgtactcggtaccaacatgtcactggaaccagatgtcctactgattttgctgaagttccctccattctgatggagtactttgcgaatgactaccgagtggttaaacaattcgcaaggcattataaaactggacagccactaccgaaaaacatggtgtcaagactgtgtgagtccaaaaaggtgtgtgctgcagctgatatgcaactccagtgtggtgctggtttttctctggatagtgttgactgtgcaggcagtgtgagcctggaggtcttttatgctgccttggaccaaatctaccacgggaaacatcctctacagaaatcaaccacagaaattttaaaggaaacacaggagacagtttatggcttgccacatgtacctaatacggcctggcagctgagatttagtcatcttgtgggctatggtgccaaatattactcctacctcatgtccagggccgttgcctccatggtgtggaaacagtgttttgctcacaatccatttgatagggcaatgggtgaacgttaccggagagagatgctggcacatggtggtggaaaagagcccattcttatggttgaaggtatgcttcagaaatcgccttcagttgaagattttgtggatgcccttgtttcagacttagaccaggacttcgaaacctttatcacggactcatga

SEQ ID NO: 98111 - protein, 1109 aa, Gallus gallus
MKQLLFSTEEAQKQDICTQAYPGIPGNPGHNGIPGRDGRDGSKGDKGDTGEAGLPGIPGKDGAHGEKGQKGANGTVEEKGNKGDKGERGRPGKLGPKGIIGSVGYKGQKGELGLQGQKGLKGDIGPLGPKGTKGEIGHPGIIGLPGPVGPIGNPGPKGNTGDLGPPGSPGIQGERGLKGDRGDKGNTGAPAVLPRSAFSVGLTAATKFPPHSHPIKFDKVLYNGLSDYNPVTGKFTCKFSGVYYFTYHITVYSRNVRVALVKNGIKMLHTMDGYQGAEDQASGAAILQLRAGDEVWLQAHRGETFNGLFADADDDTTFTGFLLSTARPRGGSAGPAGLRGGTAPAQLPARERRSPPQAGTRRGRGRARNRAPAELLGALPALPRSAMLAGCRRALPAALGLALRGRAAGRPGRRAVSTSWCPVGAAFDVKQQRNSAAGRETGLFGVPELSCPEGFQEAQDKALQESEQLVQKACSTPPGPEIVMIFDQLSDALCRVADLADFVKIAHPDFAFREAAEEACRNISTMVEKLNTDVELCQSLRRLLADKVVMDSLDPETRRVAELFMFDFEISGIHLDEEKRKKAVNLNVRILDLCNEFLTGTHLPNKIDKRVLPEHIQSNFTTEGNYLEVAGLHADCPNDLVREAAYKIFLYPNAEQLSCLEELLASRNSLAQLVGYDTFAHRALQGTMAKNPETVTQFLEKLSDQLSERTQKDFEMMTTMKMKLNPQNSKLMPWDHPYYSGVLRAERYNIDPGLYCPFFSLGACMEGLNSLFSQLLGISLYAEQTQRGEVWSEDVRKLAVVHENEGLLGYIYCDFFQRPDKPHQDCHFTVRGGRLKENGEYQLPVVVLMLSLPHSTRNAPTLLSPGMMENLFHEMGHAMHSMLGRTRYQHVTGTRCPTDFAEVPSILMEYFANDYRVVKQFARHYKTGQPLPKNMVSRLCESKKVCAAADMQLQCGAGFSLDSVDCAGSVSLEVFYAALDQIYHGKHPLQKSTTEILKETQETVYGLPHVPNTAWQLRFSHLVGYGAKYYSYLMSRAVASMVWKQCFAHNPFDRAMGERYRREMLAHGGGKEPILMVEGMLQKSPSVEDFVDALVSDLDQDFETFITDS

SEQ ID NO: 98112 - DNA, 2193 bp, Gallus gallus
  CDS (1)..(2193)
atgctccccggggccggctgtgctgcgcggggccgggcagacaatagggccggggctggacggcgtgcccaggtgacgcccttggctcctgcggctcgcccgccttccggagacgaccggcgtgcaggtctgcatttttcttcagttgatacgacgtaccttttccagttactttgctgttgttggtgtaacttccatggaagaaaccagtccattgggcctcggcttttgttgagaatgacattaggagcagaaatcactaatcagctcaaggcttcttcatacatagcaccaggccgaaaccttttgagatgggacctgtcgccagagcaaattagaacaagaacagaagaactaatcaggaagacaaaacatgtgtatgatatcgttgggaagcttaatattgaagaagtgacacatgaaaatactgtacgggccttggcagatatagaagtggaatatgcagtggaaagaagcatgttggattttccccagcatgtctcacctgacaaagaggtacgcttagcaagtacagaagctgacaaaaagctttccaattttgatgtggagatgagcatgagagaagatgtgtttcagaagattgtttatttgcagcaaacctgcaatcttgaaaatataaagcctgaaactaagcggtacctagacaaatcagttcaagtgggaaaaagaaatggactccatcttcctaaagaagtacaacacatttcgtatttgtttgaaggcctgcctgatgactttattaagagtttagagaagactgaggaggacaaatataagataacgttaaaatatcctcactattttcctgttatgaagaagtgctgcatttcagaaaccaggagaaaaatggaatcagcctttaacacaagatgcaaagaggagaacaccaaaattcttcagcagttgcttccactaagggcaaaagtagcagagctgcttggctataatacacatgccaactttgttctggaggtaaacactgcaaagagcacagaaaacgtaacaaccttcttagatgatttgagtaagaagctcaagccattggttgagaaggagagagaattcattctagatttgaagaaaaaggagtgtcaagagagaaactgtgattatgatggaagaatcaatgcatgggatcttcattattatatgaacaaaacagaagagctgaagtactccatagatcaagaaaagctgaaggagtacttcccgattgaggctgttacagaaggcttattgagtatttaccagaagctgcttggacttgtatttgagcaagtagaaagtgctcatgtttggcatgacagtgttactctttatacagtaaaggacaattcaacaggagaaacattaaggcagttctatttggacctttaccctcgagagggaaagtatgggcatgcagcatgctttggtctccagcctggctgtcttctctctgatggcagcagaatgatgtctgtagctgctctggtaaccaatttcacaaaaccaggatcagatcgcccatcattgctgcgacacgatgaagtaaagacatacttccatgagtttggccacgtaatgcatcagatatgtgcacagactgattttgccaggtttagtggaactaatgtggaaacagacttcgtagaggtaccttcacaaatgtttgagaactgggtgtgggaaaaagaaccactacagcaaatgtcaagacattacaaagatgagagccatgttgcagatgctctccttgagaaactagctgcctctagactggctaatacaggtcttttaaccctccgccagatcgttttgagcaaggttgaccaggcactccatacaaagccatctgttgacccaggagatgaatatgccaaatactgtatggagatcctaggaattcctgcaaccccaggaacaaacatgccagctacctttgggcatctggcaggtggttatgatggacagtattatggatacctctggagcgaagtgttttccatggacatcttttatagctgctttaagcgagaaggcataatgaatccgaaggctgggatgaaatacagaaatcttattttgaaacccggaggatctttggatgggatggatatgcttcaaaatttcttggagcgtaaaccaagccagagagctttcctactgagtaaaggactatgtgttcagtaa

SEQ ID NO: 98113 - protein, 730 aa, Gallus gallus
MLPGAGCAARGRADNRAGAGRRAQVTPLAPAARPPSGDDRRAGLHFSSVDTTYLFQLLCCCWCNFHGRNQSIGPRLLLRMTLGAEITNQLKASSYIAPGRNLLRWDLSPEQIRTRTEELIRKTKHVYDIVGKLNIEEVTHENTVRALADIEVEYAVERSMLDFPQHVSPDKEVRLASTEADKKLSNFDVEMSMREDVFQKIVYLQQTCNLENIKPETKRYLDKSVQVGKRNGLHLPKEVQHISYLFEGLPDDFIKSLEKTEEDKYKITLKYPHYFPVMKKCCISETRRKMESAFNTRCKEENTKILQQLLPLRAKVAELLGYNTHANFVLEVNTAKSTENVTTFLDDLSKKLKPLVEKEREFILDLKKKECQERNCDYDGRINAWDLHYYMNKTEELKYSIDQEKLKEYFPIEAVTEGLLSIYQKLLGLVFEQVESAHVWHDSVTLYTVKDNSTGETLRQFYLDLYPREGKYGHAACFGLQPGCLLSDGSRMMSVAALVTNFTKPGSDRPSLLRHDEVKTYFHEFGHVMHQICAQTDFARFSGTNVETDFVEVPSQMFENWVWEKEPLQQMSRHYKDESHVADALLEKLAASRLANTGLLTLRQIVLSKVDQALHTKPSVDPGDEYAKYCMEILGIPATPGTNMPATFGHLAGGYDGQYYGYLWSEVFSMDIFYSCFKREGIMNPKAGMKYRNLILKPGGSLDGMDMLQNFLERKPSQRAFLLSKGLCVQ

SEQ ID NO: 98114 - DNA, 2232 bp, Candida glabrata CBS138
  CDS (1)..(2232)
atgttttctaggagcttatccattattggaaggagagttggaaacacactatttaggagcaagaaaactacctttgccttaattgcactgccattatttgtcagctatagagggattcatttgaataatacttacactagtagcattagaaactacagtcaattagcaaatactaggttcactaacatgccgagcttgacgccaccacagtatccacctagctgggagttcaagccagaagatattctatcacaaactaaagaatttattgctaacactaaattgttctatgacgatttagtcgccattgataatcctactattgaaaacctaattgtaccttacatcaaccatgaaaatgaaaacgaactattgataaatcagctcacctttttacaacatgtttcggaagataaaacaattagagatgcgtctatggaggctaccatgctattgcaagatttcgagatcgaatctggctctagagttgatttatttaaacaattcgatctgatctggaatcaaatcaaggataagaaggatgaatttgaagatttcgaaatttggcgatttgttgaaaaatgtcataaggactatgttagggctggtttaaatttgcctgccgataagctggaaaaggtcaaagaaataaaaaagaaaatagccgacaattgtttaaaattctctaaaaacttaggagaacagaaggaatatatattgtttaccgctgaagagttgaagggtgttccagaaagtgtcattgaacaatttgaaaaagttaacgatgagtttggaattcaaaaattaaaagttacttacaagtatcctgatatttttcctgtgttgaagaatgctcaaaatcctgaaaccaggatgaaggcattcatgggtgatcagaataaggttcccgaaaacgagcatttgtttaaagatactttgaaattgagaaatgaacttgccttagtcctaggatatgatacgtatgctaactataacttggatattaaaatggcaaaaaatgcggatacggtgctgtcctttgtgaatgatctgattgtgaaacttcaagacccagccaagaaggaactggatatcttaaagaacttgaaaaaacaagaatttgaaaatgaattcaacatggtatatgatggtgattattatatttgggatcacagatactatgacaacaaatatctaaaagagaatttcaatgtcgatgaggaaaaaattgctgaatactatcccttggaatccacaattgatggtatgttgaaaatttacgagacgcttttgaagctaaaatttgttgaagtcaaggaaaacaagaaaacttggcatgatgatgtcaaacaattagcagtatggaagttagatactcctgaaaacccagaatttgttggttggatcttcttcgatttacatccaagagacggtaaatatgggcatgcagcaaactttggtttgtcatcctcatatataagtgcaaatggtactaggtcatatcctattaccgctttggtatgtaacttttccaagtctaccaaagataaaccatcattgttgaagcatagcgaaattactacctttttccatgaattagggcatggtattcatgacttagttggaaacaatagaataggtagattcaatggtccaggtgctgtaccttgggattttgttgaagctccctctcaaatgctagaattttggacttggaatacaaaagagctactatcattatcacaaaattataaggataacgcaaaaattgataccaagctgttagagtcgttgattaaaaccaagcatgtcaatggggctttgtttgctttgagacagctacattttggcctattcgatatgaaggttcacatgatgagtgctgaagagttagacaaattggacatcaaaaaattgtggaatgaccttagagaaaagatctgtctaatttctaacggtgaccagccaaccaccggctataactcgtttggtcatataatgtctggctcgtacagtgcaggttactatggttatatgtgggcggaagtttttgctactgacatgtactacacaaaattcaaagcagacccattgaatccggaggttggtgtcaagtatagggatattgttctagcgcgtggtggtttatacgagattgacgataacttggaggagttcttgggtagaaagcctgcaaaggatgcattcctggaagaattgggtttacattag

SEQ ID NO: 98115 - protein, 743 aa, Candida glabrata CBS138
MFSRSLSIIGRRVGNTLFRSKKTTFALIALPLFVSYRGIHLNNTYTSSIRNYSQLANTRFTNMPSLTPPQYPPSWEFKPEDILSQTKEFIANTKLFYDDLVAIDNPTIENLIVPYINHENENELLINQLTFLQHVSEDKTIRDASMEATMLLQDFEIESGSRVDLFKQFDLIWNQIKDKKDEFEDFEIWRFVEKCHKDYVRAGLNLPADKLEKVKEIKKKIADNCLKFSKNLGEQKEYILFTAEELKGVPESVIEQFEKVNDEFGIQKLKVTYKYPDIFPVLKNAQNPETRMKAFMGDQNKVPENEHLFKDTLKLRNELALVLGYDTYANYNLDIKMAKNADTVLSFVNDLIVKLQDPAKKELDILKNLKKQEFENEFNMVYDGDYYIWDHRYYDNKYLKENFNVDEEKIAEYYPLESTIDGMLKIYETLLKLKFVEVKENKKTWHDDVKQLAVWKLDTPENPEFVGWIFFDLHPRDGKYGHAANFGLSSSYISANGTRSYPITALVCNFSKSTKDKPSLLKHSEITTFFHELGHGIHDLVGNNRIGRFNGPGAVPWDFVEAPSQMLEFWTWNTKELLSLSQNYKDNAKIDTKLLESLIKTKHVNGALFALRQLHFGLFDMKVHMMSAEELDKLDIKKLWNDLREKICLISNGDQPTTGYNSFGHIMSGSYSAGYYGYMWAEVFATDMYYTKFKADPLNPEVGVKYRDIVLARGGLYEIDDNLEEFLGRKPAKDAFLEELGLH

SEQ ID NO: 98116 - DNA, 2286 bp, Candida glabrata CBS138
  CDS (1)..(2286)
atgttaatccaaaagatactgttaaacaaagaaatctcgagactaccgagaatcctcagtatattaaactatacagggctgagatggctgtccggttcatctgggagaaatactacagagctccaacgaatattcgatgactcaaaatattggcaatccctaagcgaaaatactactcaatatacaaaagaaacaggtttattcaagaatccgtatctgacttctactgatggtttgagacagttcagtcacgattctttgcataaagcccacaaacttgctgagattctaagaaatagcgtcagtaaggaagagaaagtacattatattatgaatttggatcaattaagtgatacattgtgccgtgttattgatttgtgtgagttcttaagatctgcccatcctgatcaaagctatgtggaagcagctcagatgtgtcacgaggagatgtttgaatttatgaatgttctgaatacagatgttgtcctttgtaataaattgaaggaagtccttgaagaccccgagatattgaaagttttatctgaggaagaaaggaaagttggtgaaattcttctagatgatttcgaaaagtctggtatatatatgaaagctggtattagagagcaatttatcgagctttctcaacagatcagtgttattgggcaagagtttataaataacaccgattatgtggctaaagagtttattaaagttaaaagagatgaaatggacaagagtggtattagtcctctactgactgcaagattgaatagagatttaacgggaaaatactataagatcccaacatatggtcaaataccattacagattttaaaatcttgtcctgatgaagacatcagaaaagaagtttgggcagccttacataattgccctaaagctcaaattcaacgtttgaaccaattagtgagattaagagtaatattatcgaatttattggggaagcagagctattcggattaccagttggacaataaaatggctggttcaccagaaaatgtaaagggttttatcaaaactttaatgaatgtcactaagcctttggctgcaagagagctggagtttattgcaagagataagttgaatgcacctgattcaaggcatatgtcagataatgaaatcttgtcaattgttaaaccatgggacaaaaattatttttcatccaagtatgattccgataatgagatggctatgatacgtgatgaacaactgcgctattatttctcattagggaatgtaatcaacggtctctctgaattgtttaagaggatatatggtatcaccttacaaccatcaagaactgaaaacggggaaacatggtcaccagatgttcgtagactcgatgtcataagcgaggaagagggattggttggtgttatttattgtgatctgtttgaacgcgttggaaagatatcaaatcctgctcatttcacggtatgctgttcaagacaagtgtacccggatgaaaatgactttacgaccatacagacagggcaaaattccgatggtactgtatttcagctacctgtgatttcattagtatgcaactttagtacagtcgctttgccaaatggtaatagaacatgttttctacatatgaatgaaattgagacactatttcatgaaatggggcatgctatgcattcaatgcttggtagaacaaggttgcaaaatattagtgggacacgttgcgctacagattttgttgaattgcctagcatattgatggagcactttgctcgtgatatcagagttctaagaaccattggaagtcattacgaaacatcagaacctgctccggaggcattattgaacgactatcttgataaaactcaatttttgcaacactgtgaaacatattcacaagccaagatggctatgcttgatcaaaaattgcacggttctttttctctttcagatattgaacgcattgatagtgcaaagatttatcagaaactagaaacgagactacaagttcttgctgatgatgagagcaactggtgtggtcgctttggtcacttgtttggatatggtgcgacttactatagttatttatttgatagagccatagcctcaaaagtttgggacagtctttttaaagacgatccattcaacagaactggaggtgagaaattcaaagaaagggtattaaaatggggtggactgaaaaacccttggagttgtattgcagatgtacttgaaaagcctgatttagccaaaggtggcgctgaggctatgacatatattggtgactctgaagatttatag

SEQ ID NO: 98117 - protein, 761 aa, Candida glabrata CBS138
MLIQKILLNKEISRLPRILSILNYTGLRWLSGSSGRNTTELQRIFDDSKYWQSLSENTTQYTKETGLFKNPYLTSTDGLRQFSHDSLHKAHKLAEILRNSVSKEEKVHYIMNLDQLSDTLCRVIDLCEFLRSAHPDQSYVEAAQMCHEEMFEFMNVLNTDVVLCNKLKEVLEDPEILKVLSEEERKVGEILLDDFEKSGIYMKAGIREQFIELSQQISVIGQEFINNTDYVAKEFIKVKRDEMDKSGISPLLTARLNRDLTGKYYKIPTYGQIPLQILKSCPDEDIRKEVWAALHNCPKAQIQRLNQLVRLRVILSNLLGKQSYSDYQLDNKMAGSPENVKGFIKTLMNVTKPLAARELEFIARDKLNAPDSRHMSDNEILSIVKPWDKNYFSSKYDSDNEMAMIRDEQLRYYFSLGNVINGLSELFKRIYGITLQPSRTENGETWSPDVRRLDVISEEEGLVGVIYCDLFERVGKISNPAHFTVCCSRQVYPDENDFTTIQTGQNSDGTVFQLPVISLVCNFSTVALPNGNRTCFLHMNEIETLFHEMGHAMHSMLGRTRLQNISGTRCATDFVELPSILMEHFARDIRVLRTIGSHYETSEPAPEALLNDYLDKTQFLQHCETYSQAKMAMLDQKLHGSFSLSDIERIDSAKIYQKLETRLQVLADDESNWCGRFGHLFGYGATYYSYLFDRAIASKVWDSLFKDDPFNRTGGEKFKERVLKWGGLKNPWSCIADVLEKPDLAKGGAEAMTYIGDSEDL

SEQ ID NO: 98118 - DNA, 2340 bp, Kluyveromyces lactis NRRL Y-1140
  CDS (1)..(2340)
atgctacgaacagttagtgttgggagacagtatgtgcagcgatattttggtcattgtttgattgtaaactccgttcgtcattccagttctgcaacagtaaacaggttaaagcaaccactacgccgtgtatttgatgacgattcgcactggagagctcttaatcactccaactataagcttaatgagagcaaaggtagaaagtttggtttaagatctacttcggaccttgaaacaggcctattccagaactcatatttaaaatctgccaatgggttagtggagtttacacagcattcgtttgagaaagctaaagagctggtgcagaagattcattctattgagacgcaagatgaaatgaaatattatattaaggacttggaccaattgagtgatgtattgtgccgcgtcatcgatttatgtgaattcattagagccactcatccagataagaagtttgtacagacagcgcagcaatgccatgagaaaatgtttgagatcatgaatatattaaatactgatgtcagactatgtgatctcttgacgcaatgtctacgcgaaagcgatgtcttaggacttgacagtgaggagatcagaacagggaagatcttactagaggactttgagaaatccggaatatacatgaagccagagatcagagaaaagttcatccaactgagtcaagagataagtgtcattgggcaagattttatcaataatacagaatatgtcaggtctaattatatcaaaattagctgtgaactgatggatgctcacgtcaataaaatggtttgttctcaaatgaagaaagatataactggagaatactataaggtacccacctacggatatataccgcacacgttattacgtacctgcagcgatgaagtgattagaatgaagatatggacagagatgcacagttgttcagatgcacaaattgaacgtttaactaaactaataagcctaagggttgaattggctaaactcttaggttcccaaaacttcgctcaataccagttacacggtaagatggccaagacgccagaaaatgttagtggttttctagagtctctagttcactctactagaatcaaagctgcatcagaacttaaacctttggctgtcctaaaatcagagttaactggaacccaaactccacatacttcagaggaagttttagagttaatgaaaccgtgggatagagattattacggatcaatacaggcccttgcacagcgtcgatcatcatcattagataatggagaatcaatctcctcgtcattttcgttaggtgttgtgatgcaaggtctttcagatctattcgagaaaatatatggaatcaaattagtgccagccactcccaagaccggagaaacttggtcacctgatgtgcggagaatcgatgtagtagatgagcacgatggtttgattggtgttatgtactgtgatttatttgaaagagagggcaagaccccaaatccggctcatttcacggtatgttgttcaagaaacatgtatctaaatgaggcagacacttcaacaattcaggtgggcgttaatagcaacggccaaaaattccagttacctgtcatttcacttgtatgtgacttccgatgggttgaagtcaatatgggcgatgggaaacaccaacaaatgtgtctcttgcaattgaatgagattgaaactttattccatgagatgggacatgcaatgcactcaatgttgggaagaactcaattacaaaatgtcagcgggactcgttgtgccactgattttgttgaattacctagtattttaatggaacattttgcccgtgacaccagagttctatcatccatttcatcacattacaagactggtaaatcattggacgtcgaagtgttgaagaatcatcaattggaaaaccagtttttacagaactgtgaaacgttctcccaaatcaagatgtcattcttagatcaagaattgcacaacttggatcacaccacagatggttctatcgatgtaattgctatctatcacagattagaacgtcgtctagcagtattaccagatgatcagagcaactggtgtggtaaatttggtcatctttttggatacggtgcttcatattacagttatctcttcgacagagccattgcatctaagatctgggatcacttgtttgaacaagatccattcaatagaaccaatggtacgaagtttaaagaaggtttactacagtggggaggttctcgtgatccatggtaccttttaagtcaagttcttgatgagccacgactagccaagggtgacgaatggggtatgagatacatcggtgatgttaagactggtatgtga

SEQ ID NO: 98119 - protein, 779 aa, Kluyveromyces lactis NRRL Y-1140
MLRTVSVGRQYVQRYFGHCLIVNSVRHSSSATVNRLKQPLRRVFDDDSHWRALNHSNYKLNESKGRKFGLRSTSDLETGLFQNSYLKSANGLVEFTQHSFEKAKELVQKIHSIETQDEMKYYIKDLDQLSDVLCRVIDLCEFIRATHPDKKFVQTAQQCHEKMFEIMNILNTDVRLCDLLTQCLRESDVLGLDSEEIRTGKILLEDFEKSGIYMKPEIREKFIQLSQEISVIGQDFINNTEYVRSNYIKISCELMDAHVNKMVCSQMKKDITGEYYKVPTYGYIPHTLLRTCSDEVIRMKIWTEMHSCSDAQIERLTKLISLRVELAKLLGSQNFAQYQLHGKMAKTPENVSGFLESLVHSTRIKAASELKPLAVLKSELTGTQTPHTSEEVLELMKPWDRDYYGSIQALAQRRSSSLDNGESISSSFSLGVVMQGLSDLFEKIYGIKLVPATPKTGETWSPDVRRIDVVDEHDGLIGVMYCDLFEREGKTPNPAHFTVCCSRNMYLNEADTSTIQVGVNSNGQKFQLPVISLVCDFRWVEVNMGDGKHQQMCLLQLNEIETLFHEMGHAMHSMLGRTQLQNVSGTRCATDFVELPSILMEHFARDTRVLSSISSHYKTGKSLDVEVLKNHQLENQFLQNCETFSQIKMSFLDQELHNLDHTTDGSIDVIAIYHRLERRLAVLPDDQSNWCGKFGHLFGYGASYYSYLFDRAIASKIWDHLFEQDPFNRTNGTKFKEGLLQWGGSRDPWYLLSQVLDEPRLAKGDEWGMRYIGDVKTGM

SEQ ID NO: 98120 - DNA, 2139 bp, Kluyveromyces lactis NRRL Y-1140
  CDS (1)..(2139)
atgcgtaacgtattagccaacttgcgttttaagtcagctacttcgttagttgttataccgacgttagcgtttgccagtttccaatttaacgctataaggagcataatgacgaaaactgattttgttgttccacaagccgctccatcctggaactatactacggaagagcttttgaaacagactcatgaggcaattgattcttcaaacgaactattggatagtttggaatctatttccaacccttcagtggagaactttgtaacgccgtatctacatcatgaaaacacaatctcccctctttttaaccagctgacatttttacaacatgtgtcttctgacaaagaattgagagatacgtcaacaaaggtgacagaactgattgaaaactttggaattgaatcttccttgaggttcaagcttttcaggcagtttgacatagtgtggaaccaattgaaggacgacgctcaattcaaaaaggaccattttgagatctataagtttgtagagaaatgtcataaggactttttgagatctgggttgaacttacctgaagaacaaagagataaggtcaaagaaatcaagaaaaagatatcgaataactccttgcaattttcgaagaatttgggtgaacaaaatgaattcataacattcacaaaagaagaacttattggggtgtctgaaaacgtgatgaaacaattcgagacagttgacgaggatggtatcacaaaatataaggtcacattcaagtaccccgatattttcccggtgctaaagtctgctaagaatgctgagaccaggaagagagccttcattggtgatcaaaacaaagtaccacaaaatgaggccttgtttctggaaactttgcagttaagaaatgatttggctgagcttcttaactacgactcgtatgcagattataaccttgacattaaaatggcgaagaaggaggaggctgtcttgacatttttgaatgacttgaagaataagttgaaaccattaggtgaaaaggaacttacaaaattgaaaaatttgaaggaagaggaatgtaaagagctaaatactccatacgatagaagatactatatttgggataatcgttactatgataatcaatacttgaagaaaaacttccaaatcgacgaggaaaaaattgcagaatatttcccattagaatccactattaagggtatgctacaaatctacgagacggttttgaaattaaaattcattgaggaggacaatggggacacatggcatccagatgtaaaaaagctttccgtgtggaagatggacgataactttccatcatttgtaggctggatttacttcgatttacatccaagagaaggaaaatacggacatgccgccaatttcggaatcagttcttccttcctcaaatctgacgggtctaggtcttaccctgtaactgctctagtgtgcaacttctcgaagccaaccaaagataaaccagctctattaaaacatagcgaattgacaactttcttccatgaactaggtcacggtattcacgatcttgtggggggaaacgatattggtaggtttaatggaccaagtgcaactccatgggatttcgtggaagctccatctcaaatgttagaattctggacctggaataaaaaagaacttaaatccttatccaaacattatcaaacagaagagaagatcccggactctcttttagactctttagtccgtacaaagcatatcaatggtgctctctttgcgttaaggcaattgcattttggtttatttgacatgaaagttcacactactaaagacatctctaagttaaacgtcactgaattatggaattctttaagagaagagatttgcctaattgataatggggatattcaaacgaagggtttcaattctttcggacatataatgtctgattcttactccgctgggtactatggatacatgtgggcggatgtttttgcgtcagatatgtactataccaaatttttggaggacccgttgaatagcgatgtgggcgttcagtacagggatataatcttggcacgcggcgggctatacgaaatcgaagataatctcacggaatttttgggcagaaagccaaacaacaaagcattcttaaaggaattaggtttgtaa

SEQ ID NO: 98121 - protein, 712 aa, Kluyveromyces lactis NRRL Y-1140
MRNVLANLRFKSATSLVVIPTLAFASFQFNAIRSIMTKTDFVVPQAAPSWNYTTEELLKQTHEAIDSSNELLDSLESISNPSVENFVTPYLHHENTISPLFNQLTFLQHVSSDKELRDTSTKVTELIENFGIESSLRFKLFRQFDIVWNQLKDDAQFKKDHFEIYKFVEKCHKDFLRSGLNLPEEQRDKVKEIKKKISNNSLQFSKNLGEQNEFITFTKEELIGVSENVMKQFETVDEDGITKYKVTFKYPDIFPVLKSAKNAETRKRAFIGDQNKVPQNEALFLETLQLRNDLAELLNYDSYADYNLDIKMAKKEEAVLTFLNDLKNKLKPLGEKELTKLKNLKEEECKELNTPYDRRYYIWDNRYYDNQYLKKNFQIDEEKIAEYFPLESTIKGMLQIYETVLKLKFIEEDNGDTWHPDVKKLSVWKMDDNFPSFVGWIYFDLHPREGKYGHAANFGISSSFLKSDGSRSYPVTALVCNFSKPTKDKPALLKHSELTTFFHELGHGIHDLVGGNDIGRFNGPSATPWDFVEAPSQMLEFWTWNKKELKSLSKHYQTEEKIPDSLLDSLVRTKHINGALFALRQLHFGLFDMKVHTTKDISKLNVTELWNSLREEICLIDNGDIQTKGFNSFGHIMSDSYSAGYYGYMWADVFASDMYYTKFLEDPLNSDVGVQYRDIILARGGLYEIEDNLTEFLGRKPNNKAFLKELGL

SEQ ID NO: 98122 - DNA, 2385 bp, Debaryomyces hansenii CBS767
  CDS (1)..(2385)
atgagagttacaagtctgcgattactacaaggagggctgttagtgctgcgggtgctaaaaagaagactaaataatgcgagtcggacgaagaaggggtggttttccactcgtacgctagccgattcgaacgagcacttgagacgagtgtttgacgaccaagcatactttgataatttcacgaaaagtggagctcctgaaggagctatgaactcgttattcgggggaaacggagttgggctttttaggaacagagccttgatttcgccccaggggctagttgatttttcagaagagtctcttgagagggcaaagatgttggtttccaatatgatggctgaagtgaagactagcgagcaaggacgtttagagtacataaagaagcttgaccagttgagtgatgtattatgtcgtgttattgatgtagccgaattcattcgggtatcccacccgagccagaagtgggtggatgcagcacagaggacccacgaaatcatgtttgaatacatgaaccagttgaacactaatgtggaattatacgagagtttgagagatttgttgatagaccctgctataactacaaagttaagcaaagaagaaatcgaggttggagaatacttgagacaggattttgaacggtctggtatccatatggatccaaacactagaaataattttgttgcaattactcaagaaatttctcttttgggatctcattttaataacgatattcacagtttagaaagctattggtgtaatatttccaggtctgaatttgataaaataagcgatacggttgtcaagagcgaaatttacggatatcagtcgagctctcctgcgagccaaaacaaggattctggaaatatatatataccgttggccggtcatattccctacacaattctttcaaaatgtgaggttgagtcagtaagaagaaaagtatggatatctttgcacaactctcctaaagagcaaattgatacattaaatgcattcgtgaaataccgtgccttactagccaaaatgttgggctataaatcatttgcacattaccagttagaacataaaatggccaaaaacccagagaatgtgctaactttacttaggaatttgcaacaaggattgatcagtaaggaatacggtgtttgcgaagaagttaaaaaattgcattcattcaaaaatggagacgatgctgtgatgactgacgaagaaatattagaggatgtcaaaccctgggatcgtgaatacttattagcacaattgcaatctcagactttgaaagatgaggagccattggaagacatatcagagtatttttcagttggaaccattgtttctggattatctaaattgttttatagtatttacaatgtcaatttgatcccagaagcaacgttaaagggggaaacatgggattcaaatcaagttcggaaattaaatgtttttgatgtgacatctaataaaaagcttggctatttgtatttagatttttggtcccctaaagtcttaccatcgcattttactattgtttgcctgagaaagttgaacactgatatcggtagcgagtcgagggatgaaatgagagaaatggttcaattggatgaaaatgaacaacaccaattgccggtgatttcgttggtatgtaatcttctgaaaccacaagggactggagttggtaggttcaccggaatggatagtcgtaagccaactttactatccttggaccaagtcgatactatcttccatgaaatgggacatgcaatgcattctatgattggtaagacggatttgcataacttgtcaggaactaggtgtgtcacagactttgttgagttgccatcggtgctcatggaatcattcagtaaagatccccgtgtattatgcaagatcgcaaaacattatcgtacgaaggaacccttatccaaggaaaccttggctaaacatcaatcccatagagtcttactagaggaaagtgaaaccttcatgcaatctaaaatggcaatgttagatcaagtcttacataacgaggatatcataaattgtggtattaaggattttgattcgactgccgtatatcatcatttggagagccaattgaaggtatttgctgataaatggtctacatggcacggaaaatttcctcatttgttttcttacggagcagtatactactcatatcttttagatagagcaattgcagagaagatttggcatggtcttttcaaggatgatccttggagtcgtgaagcaggtcaaaagtataaggatagtattcttaaatggggtggcacaagagatccatgggtctgtttggccgatgccctaggtgatgaaagattaggcaaaggtgattcaaaggccatggagataataggccaaaaagtatag

SEQ ID NO: 98123 - protein, 794 aa, Debaryomyces hansenii CBS767
MRVTSLRLLQGGLLVLRVLKRRLNNASRTKKGWFSTRTLADSNEHLRRVFDDQAYFDNFTKSGAPEGAMNSLFGGNGVGLFRNRALISPQGLVDFSEESLERAKMLVSNMMAEVKTSEQGRLEYIKKLDQLSDVLCRVIDVAEFIRVSHPSQKWVDAAQRTHEIMFEYMNQLNTNVELYESLRDLLIDPAITTKLSKEEIEVGEYLRQDFERSGIHMDPNTRNNFVAITQEISLLGSHFNNDIHSLESYWCNISRSEFDKISDTVVKSEIYGYQSSSPASQNKDSGNIYIPLAGHIPYTILSKCEVESVRRKVWISLHNSPKEQIDTLNAFVKYRALLAKMLGYKSFAHYQLEHKMAKNPENVLTLLRNLQQGLISKEYGVCEEVKKLHSFKNGDDAVMTDEEILEDVKPWDREYLLAQLQSQTLKDEEPLEDISEYFSVGTIVSGLSKLFYSIYNVNLIPEATLKGETWDSNQVRKLNVFDVTSNKKLGYLYLDFWSPKVLPSHFTIVCLRKLNTDIGSESRDEMREMVQLDENEQHQLPVISLVCNLLKPQGTGVGRFTGMDSRKPTLLSLDQVDTIFHEMGHAMHSMIGKTDLHNLSGTRCVTDFVELPSVLMESFSKDPRVLCKIAKHYRTKEPLSKETLAKHQSHRVLLEESETFMQSKMAMLDQVLHNEDIINCGIKDFDSTAVYHHLESQLKVFADKWSTWHGKFPHLFSYGAVYYSYLLDRAIAEKIWHGLFKDDPWSREAGQKYKDSILKWGGTRDPWVCLADALGDERLGKGDSKAMEIIGQKV

SEQ ID NO: 98124 - DNA, 2313 bp, Oryza sativa (japonica cultivar-group)
  CDS (1)..(2313)
atggtgtttctcatcgtctcggcttcctccttcctcatccgtctcccacttgtcgctcgagctcgcctcccaaaccctacctcctcctcatatacctctaggtctaggtctagggccctcctcctcctccccgcctcctcccctcttcgcgccttctgccccgcctcccgccgcccctcgcccgccacctgctccgccgcctacgcctcctcctccatggccaccgacgacaacccgctcctcgccgacttcgacttcccgcccttcgaccgcgtcgagcccatccacgtccgccccgccgtccgcacgctcctcgcccgcctcgagggcgagctcaccgacctcgagaagggcgtgcagcccacctgggggaagctggtcgagccgctcgagcggatcgtcgacagcctcgaggtcgtctggggcaccgtcgaccacctcaaggccgtcaaggactcttccgacctccgcgccgccgtcgaggacgttcagcctgacaaagtcaaattccaactaaggctgggccagagcaagcctatataccaagctttcaacgccataaggaattcttcagactgggaaaccctcagtgaggctcgcaagcgtatagtagaagcccaaatcaaggaagccgttctaagtggagtcgcacttgaggatgaacagagggagaaatttaatcaaatcgagcaggagcttgagaagttaacacaaaagttcagtgaaaatgtgctggatgcaactaagaaatttgagaaattaattactgataagaatgaaattgatgggttacctgccacagcacttggcttagcagcacagactgccgcgtcaaagggtcatgaaaatgcttcggctgaaaacggaccatggatcatcacattggatgcgccaagctatattgctgttatgcagcatgcacggaacagagcacttcgtgaagaagtttatcgtgcttacctaacccgtgcctctagtggcgaccttgataacaccaatatcatcagtcaaattctaaagttgaggctggagaaggctaagctactcggctacaagaactatgctgaggtaagcatggctcagaaaatggcaactgttgaccgtgtagaagagcttcttgagaaactccgtgctgcctcctgggatcatgctgttaaagatatggaagatctaaaagcctttgctaaagagtctgcttctccagaagccaatgacctggctcactgggacctaagcttctggagtgaacgactccgggaatctaaatatgatatcaacgaggaagatttgcgtccttactttgcactacccaaggttatggatggcctcttcagtctcgcaaataggctctttggtgttagcgtagagcctgcagatggactggctcctgtttggaatagtgatgtcaaattttactgtgtcaaagattcttcgaatagccctgttgcttatttctacttcgatccatattcaagaccatctgagaagcgtggaggggcttggatgaatgtggttttttctcgcagtcgtgtgcttgctcgcaatggttcacctgtcaggcttcctgttgcccatatggtgtgtaatcagaccccaccagttggtgataaacccagtcttatgaccttccgtgaggttgaaactgtgttccatgaatttggtcatgcgctgcagcacatgcttaccaaacaagatgaaggatttgtttctggtattcgtggagtagaatgggatgctgtagagctgccctctcagttcatggagaactggtgctaccacaagaatactcttttgagcattgcaaagcattatgaaacaggcgaacttcttccagaggaaatttatgcaaagcttgtcgctgcaaagaatttccgtgctggcaccttcagtttacgtcagatacgttttgctagtgtggacatggagctgcatacgacttacgatccaaatggttcattgtccatatatgatgtcgaccgaagagttgctgagcgaacacaggttcttgctcctcttccggaggataaattcctgtgcagctttagccatatatttgcaggaggctatgcagctggatactacagttacaagtgggctgaagtattgtcagctgatgcattctcagcatttgaagacgttggtttggacaatgagaaggcaattgaggaaactggcagacgattcagagaaacagtccttgcgcttggaggtggaaaatctccactcgaggtgtttgtgtctttccgcggacgggagccatcaccggaagctctgctcaggcacaacggcttgctacctgttgctgcattgtga

SEQ ID NO: 98125 - protein, 770 aa, Oryza sativa (japonica cultivar-group)
MVFLIVSASSFLIRLPLVARARLPNPTSSSYTSRSRSRALLLLPASSPLRAFCPASRRPSPATCSAAYASSSMATDDNPLLADFDFPPFDRVEPIHVRPAVRTLLARLEGELTDLEKGVQPTWGKLVEPLERIVDSLEVVWGTVDHLKAVKDSSDLRAAVEDVQPDKVKFQLRLGQSKPIYQAFNAIRNSSDWETLSEARKRIVEAQIKEAVLSGVALEDEQREKFNQIEQELEKLTQKFSENVLDATKKFEKLITDKNEIDGLPATALGLAAQTAASKGHENASAENGPWIITLDAPSYIAVMQHARNRALREEVYRAYLTRASSGDLDNTNIISQILKLRLEKAKLLGYKNYAEVSMAQKMATVDRVEELLEKLRAASWDHAVKDMEDLKAFAKESASPEANDLAHWDLSFWSERLRESKYDINEEDLRPYFALPKVMDGLFSLANRLFGVSVEPADGLAPVWNSDVKFYCVKDSSNSPVAYFYFDPYSRPSEKRGGAWMNVVFSRSRVLARNGSPVRLPVAHMVCNQTPPVGDKPSLMTFREVETVFHEFGHALQHMLTKQDEGFVSGIRGVEWDAVELPSQFMENWCYHKNTLLSIAKHYETGELLPEEIYAKLVAAKNFRAGTFSLRQIRFASVDMELHTTYDPNGSLSIYDVDRRVAERTQVLAPLPEDKFLCSFSHIFAGGYAAGYYSYKWAEVLSADAFSAFEDVGLDNEKAIEETGRRFRETVLALGGGKSPLEVFVSFRGREPSPEALLRHNGLLPVAAL

SEQ ID NO: 98126 - DNA, 2331 bp, Yarrowia lipolytica CLIB99
  CDS (1)..(2331)
atgagacgattttcgaccttgtcgcgtcgccttcaaagggttgtaccggcatcttcagcctcgaccgccaatacaagtccttctcctgcactctacactggtctagagcccaagatcaaggagtcacaagattcgctaattcgggcggtttttgataacggcgatgtgtggcaggatttctcgcaaaagtctgtggcaaagcccaagcaatctcgtagcattacgggatttatcaactacctgaccaacgaatctgattacgaaacggggctatttatgaacgatttcctcaagacccccgcgggatttcagaagtacactgcagcctcaatcgaagaggcgggccagttgattcagcagcttctaggagcgcttacccagcgagacaagctgcgacacgccattaccacatttgacagactatccgacgttttgtgtcaagttatcgatctggctgagttcattcgcgcagctcatccggaacagcattttgtgcaagctgctcaggaggcacacgaacaaatgtacgagtacatgaacgtcctcaacacttctgtggagctgtacactgtactcgacatggtcttcaaagattccgagattgtcaatcagctcacccatgaggaaaaggtagtaggaactctcctactggaggatttcaagaaaagtggagtaaccctggacgacgctggacgggaaaacttcgtttcattaactactaagatctcattacttggtcgggacttcatctcctccaaccatcctaaggaggattacatcactctcacccagggtgaggcccaggggctggacccacaacttgcacagcagttatcccaggggaactccgtttacgttcctactggtggtgttcccgggcaactggctctgagaggcatgaaaaacgaaaattcgcgaaaattgctttggtctaaaatgagggagtcgtcagacaaatctattgaatcgttggaagacttacttgttagccgcctggaactggccaatctaatgggaaaggaatcgtacgctgattatctgctttcagacaaaatggctggtaatcctgaaaatgtgatgagatttcttaacggcctcctagataagacacttcctggcgccaaaaaagagctctctgtgcttgagcaaatcaaaaagcaggcgactgggaaccccaaaagcatcctgcaggcatgggacaagtcttattacgcctcccagctactctaccaaaagagaaacaagacgaagacagcccacatgctaagtgaatacttttccgtgggaactgtggttcaaggccttagtcggatctttgacaagatttatggtatcaggtttgtaccgactgagaccaaaacaggcgaaacatggcatcacgatgtccgacgactcgacgtggtatctgaaacagagggtctgatcggcatcatgtacgctgatttgttccagcgggagggtaaatctcccaatcctgcacactttactgttcgttgttcgcgcgagatctacccggacgagttggcccacatgagcagtagtcctattgccaaggttccaacactgaatctcaatggcaaggtgttccaaattccaaccatcgctctcatttgtgatttcactactccccatgacctctacccttcgttgctgtcgtatcaggaggttgagacactattccacgaaatgggacatgccattcattctatgctggggcgcacatcgctccacaatgtgtgtggaactcggtgtgccaccgactttgttgagcttccttctgtcttcatggagaacttcgcatctaaccctgagtcacttgcgctctttgcacgacactattcttcagatagccctcttccttaccaacagctggagcgccatttgaacgaacagtcgtattttaaggacgttgagcagtatacccaaattaagatggctatgttggatcaggtgttgcatggaaatattttaaagagtatcacaaatggacacttcaactcacaaaagctatacgacaatcttgagaaggatagaccgctatttcctccttccccatcctcttggcacggatcgttcggtcatctttttggttacggtgcgtcctactactgttatctgcttgaccgtcaaatggctgacatcgtctggaagaagctgttctcaaagaacccgctatctcgtgacgcgggatccagaatgaaaaacgaagttctgcagtggggaggatctcgagatccttgggagtgtattgctggtgttcttgaagatcccgaactagcaaagggtggctcgcaagcgatggagaagattggaaattacgacaaacattga

SEQ ID NO: 98127 - protein, 776 aa, Yarrowia lipolytica CLIB99
MRRFSTLSRRLQRVVPASSASTANTSPSPALYTGLEPKIKESQDSLIRAVFDNGDVWQDFSQKSVAKPKQSRSITGFINYLTNESDYETGLFMNDFLKTPAGFQKYTAASIEEAGQLIQQLLGALTQRDKLRHAITTFDRLSDVLCQVIDLAEFIRAAHPEQHFVQAAQEAHEQMYEYMNVLNTSVELYTVLDMVFKDSEIVNQLTHEEKVVGTLLLEDFKKSGVTLDDAGRENFVSLTTKISLLGRDFISSNHPKEDYITLTQGEAQGLDPQLAQQLSQGNSVYVPTGGVPGQLALRGMKNENSRKLLWSKMRESSDKSIESLEDLLVSRLELANLMGKESYADYLLSDKMAGNPENVMRFLNGLLDKTLPGAKKELSVLEQIKKQATGNPKSILQAWDKSYYASQLLYQKRNKTKTAHMLSEYFSVGTVVQGLSRIFDKIYGIRFVPTETKTGETWHHDVRRLDVVSETEGLIGIMYADLFQREGKSPNPAHFTVRCSREIYPDELAHMSSSPIAKVPTLNLNGKVFQIPTIALICDFTTPHDLYPSLLSYQEVETLFHEMGHAIHSMLGRTSLHNVCGTRCATDFVELPSVFMENFASNPESLALFARHYSSDSPLPYQQLERHLNEQSYFKDVEQYTQIKMAMLDQVLHGNILKSITNGHFNSQKLYDNLEKDRPLFPPSPSSWHGSFGHLFGYGASYYCYLLDRQMADIVWKKLFSKNPLSRDAGSRMKNEVLQWGGSRDPWECIAGVLEDPELAKGGSQAMEKIGNYDKH

SEQ ID NO: 98128 - DNA, 2034 bp, Yarrowia lipolytica CLIB99
  CDS (1)..(2034)
atggcttccactctgcctcctcctccgacctggaactacactcctgatgaggtgtcttctctgacgcagactgccattgacaacatcaagaagctggatgaccagattgctgccattccgatcgagcaggccacctgggaaaacaccgtggagcccatgatcgagcaggaaaacgaagacaagctgtcgtccaaattctatctgctcaaggagacctcgcccaacaaggaactacgagaagcatgcaacgctgccgtcaaagacgtccagaaggcatctattgattccagcatgcgacacgacgtctacctgcgtgtccagcacgtgttcaacaacctggagaagatcaagaaggaaaagaagctgtctcccgagctggttcgatacctggaaaagtcagagcagggctaccgacgaagcggactggctctcgacgaggctactcgagacaaggtgtctgagctcaagaagcgaatggcagacctcaccctggcattctccaagaacctggctgacgacgaggcctttattcccttcaccgaggaggagctcgagggcgtgcccaaggaggtgtacagcgagtttgccaagaccgatgacggtaagttcaaaatgtctttcaagtaccccgagatgttccctgtcttggaatacgccaagagccctgcggtccgaaagcaggtgtttgtggagaacgagaaccgggctgctgatctcaacactcccctgatggaggagactattgctattcgatctcagctggcaaaacttctgggctacagacaccactctgactttgttctggacattcgaatggccaagaagtttgagactgtgcgcgatttcctcgaggacctcaaggttaagctgcgagttctcggtgagaaggactacaagtcgctgctggctctcaagaagcaggagtgcaaggagaatgactgggactttgacggcaagctccacatctgggacgtcaagtactacaacactatgcagatcaagaacgacctgcaggtggaccaacacaagatctcccagtacttccctctgagccgaatcttgtcccaggccatggccttttacgagaatctcttttctctgcgattcgaggaggttgccaacgtcgaggcctggcatgaggacgtcaagctgtatcgagtgtataagcgagatggcccctctgagcagtttgccggttacatttacctggacctgcaccctagacccaacaagtatggccacgctgccaactttgggttctctcctggctactacactaaggacggtaagcgagtgcctccctgcactgctctggtttgcaacttcaccaagcccacggccactaagccttctctgatgaagcacaatgaggtgaccacctttttccacgagcttggtcatggaattcactccattgttgccgacactcagaccactcggttccacggcactgcggtggctcgagattttgttgagtgcccctctcagattctcgagttctggacctgggagcctgtgcagatcaaggagatttcccagcactacgagaccggcgagaagctggacgacgctctgatcgactcactgatccgatccaagcatgtcaacgatggtcttttctatctgcgacaggtacatttcgcctcgtttgatctggctgttcactctcgaaccgaagagtctcctgagctcgatctgcagaacctgtggaacggaatgcgagaggagatttccctggttggaggcgacaacgagaagatggcgggatacgccaagtttgcccacattatgggcggctacgactccggctactacggctacctgtggtccgaggtgtttgctgctgacatctactacactcggttcaaggccgatcccatgaaccccaaggctggtcttgagtaccgacagagcattttggaccgaggaggatctcgagatgagatggagggtctgcgagaggttcttggccgagaccccaacaacgatgctttcctgcaggagctgggtgtctctgatcgtgcaaacctgtag

SEQ ID NO: 98129 - protein, 677 aa, Yarrowia lipolytica CLIB99
MASTLPPPPTWNYTPDEVSSLTQTAIDNIKKLDDQIAAIPIEQATWENTVEPMIEQENEDKLSSKFYLLKETSPNKELREACNAAVKDVQKASIDSSMRHDVYLRVQHVFNNLEKIKKEKKLSPELVRYLEKSEQGYRRSGLALDEATRDKVSELKKRMADLTLAFSKNLADDEAFIPFTEEELEGVPKEVYSEFAKTDDGKFKMSFKYPEMFPVLEYAKSPAVRKQVFVENENRAADLNTPLMEETIAIRSQLAKLLGYRHHSDFVLDIRMAKKFETVRDFLEDLKVKLRVLGEKDYKSLLALKKQECKENDWDFDGKLHIWDVKYYNTMQIKNDLQVDQHKISQYFPLSRILSQAMAFYENLFSLRFEEVANVEAWHEDVKLYRVYKRDGPSEQFAGYIYLDLHPRPNKYGHAANFGFSPGYYTKDGKRVPPCTALVCNFTKPTATKPSLMKHNEVTTFFHELGHGIHSIVADTQTTRFHGTAVARDFVECPSQILEFWTWEPVQIKEISQHYETGEKLDDALIDSLIRSKHVNDGLFYLRQVHFASFDLAVHSRTEESPELDLQNLWNGMREEISLVGGDNEKMAGYAKFAHIMGGYDSGYYGYLWSEVFAADIYYTRFKADPMNPKAGLEYRQSILDRGGSRDEMEGLREVLGRDPNNDAFLQELGVSDRANL

SEQ ID NO: 98130 - DNA, 2274 bp, Yarrowia lipolytica CLIB99
  CDS (1)..(2274)
atgctaagacacggcactcgcgtgaatcttatcttgcgacactccccgcatttgccacctcgaaccgcaccaactctacacaggtatataaccactagagtgtccgttcaagcccccgcaaaggtcaattgtactcgtcccaccaccaccaccacgtcgcgagtccccaagtttgcttcccgaactcttgcaactaccagcactcctcctgacctcgcctctgtcatcgccgccgtgaaaatgtccacacctccccagcagccccccaactggaagtacactcccgaggaggttaagaaatccgccaatgacatggctgcttctttcaagaagctggatgaccagattggagccatccccatcgaggaggccacctatgagaacacaattgtgccccagctggagctcgaaaacaccacagctctgccccgaaaccagctgaccttcttccagcatgtttctgccgacaaggaactccgagaggcctctgccgaggctgagaagattctcatggacgcctctgtcgagtccactatgcgacacgacgtcttccagcgagttgaggctgtccacaagcagcttgacgagctcaagaagaccctcgaccccgagtacatccgagctattgagaagatgtacaagggctatgtgcgatccggtctgggtctgcccgaagagacccgaaaggaggtcgaggctctcaacaagcgaaagggagagcttgccatcaagttctccaacaacctgtctaacgacacgtccttcctagcattcactgctgaggagcttgagggagtccccaaggacgttaccgacggctttgagaagaccgaggacggcaagctgaagatgactttccagtaccccgatttgtttcccgtgctgcgatccgctaagaaccctgaagtccgaaagaaagccttccttggcgaccagaaccgagtcaaggacctcaacactcctcttctcaaggagaccgtcgaaatccgaaccaaactagcaaacctgctcgggtaccgacaccactgtgactatgtgcttgaggaccgaatggccaagaagtacgagaacgtcatgcctttcctggaggacctcaaggagcgaatcaagccccagggagagaaggacattgctgagctgctgcctatcaagaaggctgactacgaagcccagggcaagtctgccgactacaaggacgtcctttatgtgtgggagacccgatactacctcaacaagcttctggaggaccaattcaagatcgaccaggagaagattgccgaatacttccctctgcagaatgttctcgacaaatctctggccttctttgagaacctattctctctcaagttcgtcgagacacccaaggaccaggcctccacctggcatgaggatgtcaagcagtacgctgtgtggaagtacgacactgctgagcctgtcttcgtcggatggttctatcttgatctgcaccctcgacccaacaagtacggccatgctgccaattttggcattggtcccggtttcaccgacctgaaggatggttctcgaacctatcccgccacctctctggtctgcaacttcaccaaacccaccgctgagaagccctctcttctcaagcactccgaggtgactaccttcttccacgagcttggccacggtatccacgatctcatgggcaccaccaaactgtctcgattccacggtacctcagtctcatgggactttgtcgagtgtccttctcagatgctcgagttctggacctgggagcctgagcagatcaagcacttttccgctcactacaaggacggctccaagatgtctgacgagacaatcaaatctctggttgccaccaagcacgtctgtgacggcctgcactacctgcgacaggtccattttgccatgttcgactttggtcttcacaacaagggtatcaaggatactcctgccgatctggacaagacctggaacgacatgcgagaggaaattgctctggtcaagaacgatggtgagtccatggcaggctactctactttcggccatattatgggcggttatgactctggttactacggttacctgtggtctgaagtctttgctgccgacatctactacactcggttcaaggacgaccccatgagcaccaagagtggtcttgactacagaaaggctattcttgaccgaggtggatctcgggacgagattgagggtctcaaggaggttcttggacgagagcccaacaatgatgctttcctcaaggagctcggtattgccgcctaa

SEQ ID NO: 98131 - protein, 757 aa, Yarrowia lipolytica CLIB99
MLRHGTRVNLILRHSPHLPPRTAPTLHRYITTRVSVQAPAKVNCTRPTTTTTSRVPKFASRTLATTSTPPDLASVIAAVKMSTPPQQPPNWKYTPEEVKKSANDMAASFKKLDDQIGAIPIEEATYENTIVPQLELENTTALPRNQLTFFQHVSADKELREASAEAEKILMDASVESTMRHDVFQRVEAVHKQLDELKKTLDPEYIRAIEKMYKGYVRSGLGLPEETRKEVEALNKRKGELAIKFSNNLSNDTSFLAFTAEELEGVPKDVTDGFEKTEDGKLKMTFQYPDLFPVLRSAKNPEVRKKAFLGDQNRVKDLNTPLLKETVEIRTKLANLLGYRHHCDYVLEDRMAKKYENVMPFLEDLKERIKPQGEKDIAELLPIKKADYEAQGKSADYKDVLYVWETRYYLNKLLEDQFKIDQEKIAEYFPLQNVLDKSLAFFENLFSLKFVETPKDQASTWHEDVKQYAVWKYDTAEPVFVGWFYLDLHPRPNKYGHAANFGIGPGFTDLKDGSRTYPATSLVCNFTKPTAEKPSLLKHSEVTTFFHELGHGIHDLMGTTKLSRFHGTSVSWDFVECPSQMLEFWTWEPEQIKHFSAHYKDGSKMSDETIKSLVATKHVCDGLHYLRQVHFAMFDFGLHNKGIKDTPADLDKTWNDMREEIALVKNDGESMAGYSTFGHIMGGYDSGYYGYLWSEVFAADIYYTRFKDDPMSTKSGLDYRKAILDRGGSRDEIEGLKEVLGREPNNDAFLKELGIAA

SEQ ID NO: 98132 - DNA, 2673 bp, Canis familiaris
  CDS (1)..(2673)
atgatcgcccggtgccttccggctgtgcgaggcctccacaggtacctcccgcgcgcgagctcgcgcagaccttggggccgggcgtggtgctcggcctccccggggcgcgccggtcgcacgtccccgcggcccgcgccctaccctgagcgacacctgccgcgggccctcggggccaccttgccccctccgctccctcgggagggcgtccgttcccctttgtttggggctgcggctgcacacaggccggcccagaatgagcgcggaaggagggtgcggacaagaaaatcagttggtggttccaagattttattcatgactttaggaagagaagtgaggtctcctcttcaagccatgtcttcctatactgtggctggcagaaatgttttaagatgggatctttcaccagagcaaattaaaacaagaactgaggagctcattgtgcaaaccaaacaggtgtacgatgctattggaatgcttgacattgaggaagtaacttatgagaactgtttgcaggccttggcagatgtagaggtgaagtacatagtggagcgaaccatgctagactttcctcagcatgtctcttctgacaaagaagtgcgggcagcaagtacagaagcagacaaaagactttctcgttttgatattgagatgagcatgagagaagatatatttctgagaattgttcatttacaggaggagaataggaagaaactaaatctcctcaccacagagattaaagtaaatccgagcctctactggagtcggtcgtttttacccagtcaagaccaggagtttgagtttactctgccgagtatgcttctaggctttttgaaggaccagctctgtgctcccgagatacagcggggccgggcactcctagcatgtgagcccttcctgaccgagcatagcaaagagggagaaatctgctcacggcagctggtgggcctcgcagaaacatctgatctgagtaagataaaacctgaagccaggagatacttggaaaagtcaattaaaatgggaaaaaggaatgggctccatcttccagaacaagttcaaaatgaaatcaaagcaatgaagaaaagagtgagtgagctatgtattgacttcaacaaaaacctcaatgaggatgataccttccttgtattttccaaggctgaacttggagccttccccacagttacccgcagaagtaccagaatagtgaggatggggaaggaggaggactgggacagtgctcctgaaaggcaagccccacagcgccagacctcccatagaccaagttcccacttgactatgggcagcaaccactcttccaaccctcgcccgcagggagaagcactggagggctctgaccagcggacaggagagcaaggcagaccagaaaataccgtaatcctgcagcagctactcccactgcgggccagagtagccaaactccttggctatagcacacatgccgactttgtccttgaaatgaacactgcaaagagtaccagccacgtaacagcctttctagatgacttaagccagaaattaaaaccgttgggtgaggcagagcgagaatttattttgaatttgaagaaaaaggaatgtgaagagagaggttttgaatatgatgggaaaatcaatgcctgggatctccattactacatgactcagacagaagaactcaagtactccatcgatcaagagagcctcaaggaatacttcccaattgaagtggtcactgaaggcttgctgaacatctaccaggagttgttggggctttcattcgagcaggtggcagatgctcatgtgtggcataaaagtgtgacactttacactgtgaaggacaaagccacaggagaagttttgggacagttctacttggacctctatccaagggaaggaaagtacaaccacgcagcctgctttggtctccagcctggctgcctcctgcctgatgggagccgcatgatgtccgtggctgcccttgtggtgaacttctcgcagccaacagcagctcgtccctctctcctgaggcatgatgaggtgcggacttacttccacgaatttggtcatgtcatgcatcagatttgtgcacagactgattttgcacgatttagcggaacaaatgtggaaaccgactttgtagaggtgccatcacaaatgcttgagaactgggtatgggacatggattccctccgaagattgtcaaaacattataaagatggaagccctatcatggatgatctgcttgaaaagcttgttgattccagactggtcaacacaggtcttctgaccttacgtcagattgttttgagcaaagttgatcagtctctccataccaacgcatcgctggacgccgcaagtgaatatgccaaatactgcacagaggttttaggtgttgcagccaccccaggcacaaatatgccagctacttttggacatttggcagggggatacgatggccaatattatggatacctttggagtgaagtattttccatggacatgttttacagctgttttaaaaaaaaaggaataatgaatccagaggttggaatgaaatacagaaacctaatcctgaaacctgggggatctctggacggcatggacatgctccagaatttcttgaaacgtgagccaaaccagaaagcgttcctaatgagtagaggcctgcatgctccttaa

SEQ ID NO: 98133 - protein, 890 aa, Canis familiaris
MIARCLPAVRGLHRYLPRASSRRPWGRAWCSASPGRAGRTSPRPAPYPERHLPRALGATLPPPLPREGVRSPLFGAAAAHRPAQNERGRRVRTRKSVGGSKILFMTLGREVRSPLQAMSSYTVAGRNVLRWDLSPEQIKTRTEELIVQTKQVYDAIGMLDIEEVTYENCLQALADVEVKYIVERTMLDFPQHVSSDKEVRAASTEADKRLSRFDIEMSMREDIFLRIVHLQEENRKKLNLLTTEIKVNPSLYWSRSFLPSQDQEFEFTLPSMLLGFLKDQLCAPEIQRGRALLACEPFLTEHSKEGEICSRQLVGLAETSDLSKIKPEARRYLEKSIKMGKRNGLHLPEQVQNEIKAMKKRVSELCIDFNKNLNEDDTFLVFSKAELGAFPTVTRRSTRIVRMGKEEDWDSAPERQAPQRQTSHRPSSHLTMGSNHSSNPRPQGEALEGSDQRTGEQGRPENTVILQQLLPLRARVAKLLGYSTHADFVLEMNTAKSTSHVTAFLDDLSQKLKPLGEAEREFILNLKKKECEERGFEYDGKINAWDLHYYMTQTEELKYSIDQESLKEYFPIEVVTEGLLNIYQELLGLSFEQVADAHVWHKSVTLYTVKDKATGEVLGQFYLDLYPREGKYNHAACFGLQPGCLLPDGSRMMSVAALVVNFSQPTAARPSLLRHDEVRTYFHEFGHVMHQICAQTDFARFSGTNVETDFVEVPSQMLENWVWDMDSLRRLSKHYKDGSPIMDDLLEKLVDSRLVNTGLLTLRQIVLSKVDQSLHTNASLDAASEYAKYCTEVLGVAATPGTNMPATFGHLAGGYDGQYYGYLWSEVFSMDMFYSCFKKKGIMNPEVGMKYRNLILKPGGSLDGMDMLQNFLKREPNQKAFLMSRGLHAP

SEQ ID NO: 98134 - DNA, 2148 bp, Cryptococcus neoformans var. neoformans JEC21
  CDS (1)..(2148)
atgcgcctgacagatcgtactctgattcaggcctcagcgatcgtccaacgcatcgtcgtggctccccaggatcccactggtcgagaactaaggcttgtggtgaagaacctagataggctgagcgatatactttgcggagtgattgatatgtgcgaactcattcggaatgtccatccccaccaagactgggtgaatcagagcgatcggacccaccagatactatgtagcttcatgaacgagctcaatgcaacccggggtctttacgagtcacttgcaaaggcgattgcgcatcctttcaatgacccattgactacttcagagcttagggttgcccgtattttcctcacagatttcgagcgatcaggtatacatcttccgccctctgttcgcgaaaggtttgtgaagcactcggacgctttactcttcctcggtcgttccttcctctcttccgcatcatcgggcccatccacagttccccatatagaaatccccgatcctcatcgcttacttacgggactgggtcgccagtttgttgattcattaccacgaacaggtcgaaatggacaggctgttatcgaacctggaagctgggaggcacaaatgatcctgaggtacgcaagagagggccgggcgcgagagctggtgtacgtcggcggaatgagggccgacaaaaagagaattagcgtgctggaagcgatgttgaaggaaagagctgaactagccagcgtccttgggaagaacaattgggcggaggttgttctagtcgataagatgacaaaaacaccggaaaatgtgatgcgcttcttgacctccctcgctcagcaccatcaacccgttgctagagcagaagtggatatgttaagaagaatgaaagctactgctctgactggaaattactttgacccacgaaattctcggacacgacatcttcccctgttccatgcctgggatagggattattatagcgacaagtaccttacatccctcattcctacaggttcgccgccttctatttctccttatctttcaactggcacagtgatgtcaggcctttcccgcatcttctcaagactttacggtatctccttcaaaccagctgtcgtctcacctggagaagtttggcatccttctgtccggcggctggatgtagtgcacgaagaagaagggctcattggtgtcatatattgtgactttttttctcgcattggaaaatcttctggagcagcccattacactgtgagatgctcaagaagggtggatgatgacgatatagatggtgatgggttaccagaagactgggataaaccatatggccctggattagaagctgataaggagtctttatcaggcaagccaggaaaataccaactgcctatcatcgcattgtcaatggatgtcggtacagtgaatgaaggaagacctgcgctcttgaattggcaggaattggagactttgtttcatgaaatgggacatgcaatccattccatgattggtcggacagagtaccacaatgtttctggaacaagatgtgccacggattttgtggagcttccttcaatactgatggagcattttgtttcatcaccagaagtcctcagcactttggcgttccatcatgccaccggcgaacctctacctatccccgttatcgaggcccatctagctctcaatcagtccctaagcgccctcgagactcatggacagatcgcaatggctcttttggatcagaaatatcatacgctacgtcatggacaggattcttttgattctactgctatttggttccaacttcagcaagaaataggagtcatccaaccagtgcccggaacagcttggcaaatgcagtttggtcatctgtacggatatggagcgacgtattactcttatctatttgaccgcgccattgcgggtaagatatggtccaccttgtttcatcgctcggggacctcccaagcttatgaccgaaaggctgaaggaatactgagtagggagggaggagaattgttaaaagagaaagtcctaaaatggggtggaggtagggatccatgggagatggtaggcgacgtgattgggggcgtagaaggtgatgagttaagtaaaggagatgagagggcattggcactggttggaagctggagtgtcgtatga

SEQ ID NO: 98135 - protein, 715 aa, Cryptococcus neoformans var. neoformans JEC21
MRLTDRTLIQASAIVQRIVVAPQDPTGRELRLVVKNLDRLSDILCGVIDMCELIRNVHPHQDWVNQSDRTHQILCSFMNELNATRGLYESLAKAIAHPFNDPLTTSELRVARIFLTDFERSGIHLPPSVRERFVKHSDALLFLGRSFLSSASSGPSTVPHIEIPDPHRLLTGLGRQFVDSLPRTGRNGQAVIEPGSWEAQMILRYAREGRARELVYVGGMRADKKRISVLEAMLKERAELASVLGKNNWAEVVLVDKMTKTPENVMRFLTSLAQHHQPVARAEVDMLRRMKATALTGNYFDPRNSRTRHLPLFHAWDRDYYSDKYLTSLIPTGSPPSISPYLSTGTVMSGLSRIFSRLYGISFKPAVVSPGEVWHPSVRRLDVVHEEEGLIGVIYCDFFSRIGKSSGAAHYTVRCSRRVDDDDIDGDGLPEDWDKPYGPGLEADKESLSGKPGKYQLPIIALSMDVGTVNEGRPALLNWQELETLFHEMGHAIHSMIGRTEYHNVSGTRCATDFVELPSILMEHFVSSPEVLSTLAFHHATGEPLPIPVIEAHLALNQSLSALETHGQIAMALLDQKYHTLRHGQDSFDSTAIWFQLQQEIGVIQPVPGTAWQMQFGHLYGYGATYYSYLFDRAIAGKIWSTLFHRSGTSQAYDRKAEGILSREGGELLKEKVLKWGGGRDPWEMVGDVIGGVEGDELSKGDERALALVGSWSVV

SEQ ID NO: 98136 - DNA, 2286 bp, Cryptococcus neoformans var. neoformans JEC21
  CDS (1)..(2286)
atgctccgtctcccccgcatcacacgccgcgccctctcctctggcgcccttgcgccccactttgaccgcccgctcccgcccccgccgcccgcgccccctgcgcccctctgcgccctcccgccgctcaccgcgcccgacgccctcgcgcccctcacccgccgcaccgtccgccacgccgacgccctcgtcgcccgcatcgccgcagcgcccgcacacccagaccccgcagagctccgccgcgtcgtcaagaacctcgaccgcctcagcgatgtcctctgcggcgtcatcgacatgtgcgagctcgtgcgcaacgtccatccggacccccgctgggtcgcggccgccgagaagacgtacgagacgctgtgcagcttcatgaaccagctcaataccagcacgggcctctatgacgcactcgtcgcaaccgtctcccacacgttccccggcaaccccctctcgccggccgagctcagagtcgcccagacctttctctcagactttgagcgctcgggcatacagctgccccccggcgtccgtgccaaattcgtccgccactcggacaacatcctctccctcggccgtacctttctgtcctttgccgccgctgggccctcggcggacacgcccatcgaaataccagagccagaagtgctgctcgccgggctcagctcgaaattcgtggcgtccttgccgcggaaaaagcgcaagggtcccgcactccttgcgcctggctcctgggaagcgcagatgatcgggagatatgcagacaatgaggaggctcggcgcctggtgtatatcggctccatgcgagaagacaaggacagggtctacgtgctcgagacaatgctgaaagaacgggcagagctcgctcacgtgcttggaaaggaaacatgggccgatgtcgccctgtccgacaagatggccaagacaccccaaaacgttttacagttcctcacgtcgctggcgacacaccaccgtccatcggcagccgcagacgttgccgccctccaacgcctcaaggccctttccacagtctcccgcacctcctctcaattgcccaccgtgcacgcttgggatagagatcattatgcagagcaatatgctgcatcgttattacccaacggatccctaccgtccatcacaccctacttctccgtgggcacagccatgtctggcctttcacacatgctctcccgcctctatggtatctccttcaagcccgtgtctgtcgcacatggcgaagtctggcacccctcggtcaggcggttggacgtgatggacgaacacggcaaaagaataggagtgatctactgcgatttgttttcacgacccggtaagccatcagccggcgcagcacactataccgtccgctgctcgagaagggtggacgatgatccttccgaaggcgatggcctgcctcccggatgggatcaacatctcggtaaaggaatggaagtgcaaggtgaagcgttgcatggaaaagagggcaaataccaacttcccatcgttgtgctgactacagactttggaacggttgaagaaagcggcccggcattgcttgggtggaatgatctcgagactctgttccacgagatggggcatgctatccactcaatgattggccaaacagagtttcacaacgtgtccggtactcggtgcgccaccgactttgtcgagctcccttccatcctcatggagcactttatctcttccccagctgtcctcagcacattcgccacccactataccaccaacgaacctttaccgatccccctcatccaagcgcatctgcaactcgaccagtccctcaaagccctcgaaacacattcccaaatcctgatggcactgcttgaccaaaagtaccactcgatcaagcatggcgaacaactcgactctacccgagtctggaacgagctgcaaagccaagtgggggtgatcccacccgtgcgagggacggcgtggcaaacgcagttcggacacttgtacggctacggcgcgacgtattattcctatctgtttgatcgcgcaatcgcgggcaagatctggtcatcactgtttgcgcgggggcgtaccgggcccgccgccgctaatcatgatccggcggcggcggaagacatactctccagggaaggaggtgaagcgttcaaagaaaaagtcttgaaatggggcggtgggagagatccttgggagatggtcggagacgtgattggaggtgcagagggcgagcaagtagccaagggagatgaaaaggccatggaactggtcggtagatggatgatcaagtag

SEQ ID NO: 98137 - protein, 761 aa, Cryptococcus neoformans var. neoformans JEC21
MLRLPRITRRALSSGALAPHFDRPLPPPPPAPPAPLCALPPLTAPDALAPLTRRTVRHADALVARIAAAPAHPDPAELRRVVKNLDRLSDVLCGVIDMCELVRNVHPDPRWVAAAEKTYETLCSFMNQLNTSTGLYDALVATVSHTFPGNPLSPAELRVAQTFLSDFERSGIQLPPGVRAKFVRHSDNILSLGRTFLSFAAAGPSADTPIEIPEPEVLLAGLSSKFVASLPRKKRKGPALLAPGSWEAQMIGRYADNEEARRLVYIGSMREDKDRVYVLETMLKERAELAHVLGKETWADVALSDKMAKTPQNVLQFLTSLATHHRPSAAADVAALQRLKALSTVSRTSSQLPTVHAWDRDHYAEQYAASLLPNGSLPSITPYFSVGTAMSGLSHMLSRLYGISFKPVSVAHGEVWHPSVRRLDVMDEHGKRIGVIYCDLFSRPGKPSAGAAHYTVRCSRRVDDDPSEGDGLPPGWDQHLGKGMEVQGEALHGKEGKYQLPIVVLTTDFGTVEESGPALLGWNDLETLFHEMGHAIHSMIGQTEFHNVSGTRCATDFVELPSILMEHFISSPAVLSTFATHYTTNEPLPIPLIQAHLQLDQSLKALETHSQILMALLDQKYHSIKHGEQLDSTRVWNELQSQVGVIPPVRGTAWQTQFGHLYGYGATYYSYLFDRAIAGKIWSSLFARGRTGPAAANHDPAAAEDILSREGGEAFKEKVLKWGGGRDPWEMVGDVIGGAEGEQVAKGDEKAMELVGRWMIK

SEQ ID NO: 98138 - DNA, 2025 bp, Bartonella henselae str. Houston-1
  CDS (1)..(2025): transl_table=11
atgacaaaagcagcactgttggactggaagggattttcaggacttcctgattttttttcaataagtgatgaagattttaagcccacttttgaacaagcgcttaaagaagcagaggaagaaatcgagacgattgcaatggtgcaagagccaccaacgcttgagagttttttgcaaccttttgaactttctggaaaaaggcttgatcgtgtatgttcaatatttttcttgcgttcaggtgctcatagtaatgcgttgattcaacagttagaacaagaatttgttgtaaagctttctcgttattcttcgaaaattatgatggatgtacggatatttgcgaaaataaacgcgctttataaacagtcgcagcaaggtgtgtatgataatgaaacaacgcgtgtccttgaattatggtggaaaaagtttgtttgtaatggtgcaaaacttgatgaaaaaagcaagaaaaggctcgttgaaattaatgaaaagcttgcttttttaaatgctacttttggtcaacatgtcttaaaagatgaagctgaatggattttatttttagaacaaacagatttgtctggtttaccagatgatcttattgcttcaatgaaagaaattgcgtgcgaaaggggacatgagggcgcttatgctttaacattggcacgctcaattgttgaaccatttttaaaattttctcatcgtcgtgatttgcgtgaaaaagcatttcaagcttggtctaagcgcggtgaaaataataacgagaatgataatcgtgcaattcttttagagattgttgcacttcgaaatgaaaaggctaaattattagggtataagtctttcgcagatttgaaacttgataatactatggcgaaaagcattgatgcagttatgggattgctcacacctgtatgggaacgtgcaagagctaaggctgcaagcgaacagattgaattgcaaaattttgcaaataatcggggcagcaatgaatctttagcagcttgggattggcgttattatgctgaaaaacttcgtgctgaaaaattttctttcgatggcgctgaaattaaatattattttcagcttgatcgcataattgaagcggcttttgctgtagcaaaaaaactttttgggatttcatttgaagaaaaaaatgctgttgcactttggcatcctgatgcacgtttatgggaagtaaagaaatctgatggaagttttcttgggcattttattggtgattattttgcacgctcttcaaagcgatctggagcatggatgaatagtctacaagtgcagcataaattggatggtgggcaaaagcctattatctacaatatttgtaattttgcaaagccacccaaaggcgagattgctcttttatcacttgatgatgcacaaacactttttcatgaatttggacatgcattgcacggtttgctttctgatgtaacgtggccatctgtagcgtgcacatcggtttcgcgggattttgttgaacttccttctcaactttacgagcattggttaaccgtaccagagatcttaaaatcgtatgctacacatgcaaagacggggcttcctataccacaagcattgatggataaaattgtatcagcacagacatttgatgctggtttttctgcggtagaatttatctcatcagctttagtggatatggctattcatcagagagaaacgatatctgatccaacaatgtttgagcatcaggaattggagaagttgcaaatgcctaatacaattataatgcgtcatcgtcctccacattttacgcatatattttcaagtgatggttatgcagctggttattattcttatttatggtcagaagtgctagatgccgatgcttttcaggcttttgaagaaaccggtgatgtttttaattcacagctcgctgatcggttaaaacgttttatctattctgctggagggagccgggatccagaggagctctataaggcttttcggggacgtttgccttcaccagaggcgatgattaaaaaacgtggattataa

SEQ ID NO: 98139 - protein, 674 aa, Bartonella henselae str. Houston-1
MTKAALLDWKGFSGLPDFFSISDEDFKPTFEQALKEAEEEIETIAMVQEPPTLESFLQPFELSGKRLDRVCSIFFLRSGAHSNALIQQLEQEFVVKLSRYSSKIMMDVRIFAKINALYKQSQQGVYDNETTRVLELWWKKFVCNGAKLDEKSKKRLVEINEKLAFLNATFGQHVLKDEAEWILFLEQTDLSGLPDDLIASMKEIACERGHEGAYALTLARSIVEPFLKFSHRRDLREKAFQAWSKRGENNNENDNRAILLEIVALRNEKAKLLGYKSFADLKLDNTMAKSIDAVMGLLTPVWERARAKAASEQIELQNFANNRGSNESLAAWDWRYYAEKLRAEKFSFDGAEIKYYFQLDRIIEAAFAVAKKLFGISFEEKNAVALWHPDARLWEVKKSDGSFLGHFIGDYFARSSKRSGAWMNSLQVQHKLDGGQKPIIYNICNFAKPPKGEIALLSLDDAQTLFHEFGHALHGLLSDVTWPSVACTSVSRDFVELPSQLYEHWLTVPEILKSYATHAKTGLPIPQALMDKIVSAQTFDAGFSAVEFISSALVDMAIHQRETISDPTMFEHQELEKLQMPNTIIMRHRPPHFTHIFSSDGYAAGYYSYLWSEVLDADAFQAFEETGDVFNSQLADRLKRFIYSAGGSRDPEELYKAFRGRLPSPEAMIKKRGL

SEQ ID NO: 98140 - DNA, 2055 bp, Acinetobacter sp. ADP1
  CDS (1)..(2055): transl_table=11
ttgatgacaagcacaatgaccttagaaaaagcaaccttacctgttccacagtttgatcagattcagcttgatcaacttaaacaggacatcgagaaaagtattcatgcaggtcaagcatttctcaatcacttagaacaagctccgcaagatttcgcttcacagcgcaaaaccattgaacagcttgatacgcttgaaaaccagatgagtgaatcttggggggtactttcacatttaaatgcagtcatgaataatccccaaacacgtgaagtgtatcaggagttattacctcacctaagcgcctactatacgcaacttgggcaacataccccgctttatcaaacttatcagcaaattcatgatagtaccgaattttcaagcttatcggctgcacaacaaagtgccattcgtttagctttgcgtgattttaaactttcgggtgtggcacttgaaggcgatgcaaaaaaacgttatgccgaaatttcagcgcgtttatcacagttgtcttcagacttttctaatcacgtactcgatgccacacaagcttatttcaagccattaagtgaagatcaactcaaaggcttgccacagagcagtatcgaactgttaaaacaatatggtcaacaacgtgaactggatcagcccgttgcaacactagatattcctgcttatctggcaattatgacctacgcagaaaatcgtgagctacgtgagacactctataaagcatataccacacgtgcttccgatgagtctgaccacaaagaatatgacaacacggcgatcatggaagaaattctaagcctgcgccaagaaatggctcagctccttggatttgataattttgccgaatattctcttgccagtaaaatggctccagatgttcaaactgtacatgattttctggtcgatctggcagaacacgcacgtacgccagcattaaaggaaatcaatgaactgaaattgattgcccaacaagatggtgttgagcaactacaaccgtgggatagtggttattattcagaaaagctcaaacagcaacaatttaatctgtcacaggaagcattaaaaccttacttccctgcacctaaaattattcagggtctattccagatcgttgatcgcttatatggtgttcagattgtagaacgtgaagcaccgctctggcaccctgatgttcattattatgaacttgaagatcaaggaaaagtcattgcaggattctactttgatttgtatgcacgtagtggaaaacgtggtggagcatggatgagcggtttccgttcacgcatgcaaacggcacaaggcctacaaaaaccaatttgctatatggtatgtaactttaccccgcctgtcggtcaacaacctgctttgctcacacatgatgaagtcaatactttattccatgaatttggtcatggcttacatcatatgctgaccgaagtggataatatttcagttgcaggaacacatggcgtggcatgggatgccgtcgagttgccaagtcagtttatggagttctggacatgggataaagacagtctcgacctcttaagcgaacatatcgagacgcatgtacacctaccagaagagttacttaacgctttacttaatgcacgttttttccagtctggtatgcaaaccttacgtcaaattgaatttgcattatttgatctcactattcacgccaaaaacccagcattgaacagtagtggcattcagaatgttttaaatgatatccgcacacagtttgcagtattgccaaccgcaacatataaccgtttccaacatagttttagccatatttttgcagggggctatgcagcaggttactactcttacaagtgggcagaagtattggcaagtgatgcttttgatcgctttgaagcagaaggtatttttaatacacaaactggtgctgagttccgcaaggcaattttagccgtaggaggtaaagatactgcactggatgccttcgtcaacttccgtggtcgcgaacccaaaattgatgccttgttgcgtcatcagggttggacgaatgaccatcaaaacgcttag

SEQ ID NO: 98141 - protein, 684 aa, Acinetobacter sp. ADP1
MMTSTMTLEKATLPVPQFDQIQLDQLKQDIEKSIHAGQAFLNHLEQAPQDFASQRKTIEQLDTLENQMSESWGVLSHLNAVMNNPQTREVYQELLPHLSAYYTQLGQHTPLYQTYQQIHDSTEFSSLSAAQQSAIRLALRDFKLSGVALEGDAKKRYAEISARLSQLSSDFSNHVLDATQAYFKPLSEDQLKGLPQSSIELLKQYGQQRELDQPVATLDIPAYLAIMTYAENRELRETLYKAYTTRASDESDHKEYDNTAIMEEILSLRQEMAQLLGFDNFAEYSLASKMAPDVQTVHDFLVDLAEHARTPALKEINELKLIAQQDGVEQLQPWDSGYYSEKLKQQQFNLSQEALKPYFPAPKIIQGLFQIVDRLYGVQIVEREAPLWHPDVHYYELEDQGKVIAGFYFDLYARSGKRGGAWMSGFRSRMQTAQGLQKPICYMVCNFTPPVGQQPALLTHDEVNTLFHEFGHGLHHMLTEVDNISVAGTHGVAWDAVELPSQFMEFWTWDKDSLDLLSEHIETHVHLPEELLNALLNARFFQSGMQTLRQIEFALFDLTIHAKNPALNSSGIQNVLNDIRTQFAVLPTATYNRFQHSFSHIFAGGYAAGYYSYKWAEVLASDAFDRFEAEGIFNTQTGAEFRKAILAVGGKDTALDAFVNFRGREPKIDALLRHQGWTNDHQNA

SEQ ID NO: 98142 - DNA, 2043 bp, Erwinia carotovora subsp. atroseptica SCRI1043
  CDS (1)..(2043)
atgacgaatccattactgacctcatttaccctgcccccgttctccagcattaaaacggaagatattgtcccagccgttaaatctacgctggatgaatgccgcgagacggtagaacgtgtggtcgcgcaagcggggccgttcacatgggataatctgtgtcagacactggcggacagcgatgatcgtcttggccgtattttttcccctatcagccatctgaacgccgtgaagaacagcccagagctgcgcggtgcttatgaacaatgcctgccgctgctgtccgagtacagcacttgggttggccaacatgccgggctatatcaggcctatcgcagcctgcgtgacggcgagcactacaccacgctgagcctggcgcagaagaaatccgttgataacgcgctgcgcgattttgaactgtccggcatcggcctgtcgccggaaaaacagaaacgctacggcgaaatttccgctcgtctgtctgaactcggctcgcagtacagcaacaacgtgctggatgccacgatgggctggagcaaactgattaccgacgtcgccgagctggatggcatgccggaaagcgcgctggcagcagccaaagcgcaggcagaagccaaagagcaggatggctggctgttgacgctggatatcccgagttacctgccggtgctgacctactgcaccaatcaagcgctacgtgaagagatgtaccgcgcgttcggcacccgcgcatccgatcaggggccgaacgcaggcaagtgggacaacagcgaaattatggcggaagagttggcactgcgtcacgaactggcacagttgctgggcttcgatagctacgcgcataagtcgctggcgaccaaaatggcggaaaacccgcagcaggtgatcgatttcctgaccgatttggcgaaacgtgcccgcccgcaggctgaagaagaactcgcccaactgcgcgccttcgccaaagaacacttcggcgtggatgaattgcaggcctgggatatcacctactacagcgagcagcagaagcagcacctgtattccatcagcgatgagcagctgcgaccgtacttcccggaaaaccgcgcggtaaacgggctgtttgaagtagttaaacgcatttacggtatcacggccaaagagcgtaacgatgtggacgtgtggcacccggatgttcgcttcttcgatctgttcgatgaaagcggcgaactgcgcggcagcttctacctcgatttgtacgcccgtgaatacaagcgtggcggtgcctggatggacgactgcgcgggtaaactgcgtaaaggcaacggcgagctgcaaaaaccggtcgcctatctggtctgtaactttaaccgaccagtcaacggcaaaccggccctgttcacacacgatgaagtcaccaccctcttccacgagttcggtcacggcctgcaccatatgctgacccagatcgataccgccggtgtctcgggtatcaacggcgtaccgtgggatgcagtcgaactgccgagtcagttcatggaaaactggtgctgggaacctgaagcgctggcctttatttccggccatcatgaaaccggtgaaccgctgccgcaggaactgttggataaaatgctggcagcgaagaactaccaagccgcgctattcattctgcgtcagttggagttaggcctgttcgatttccgcctgcatgccgagtttgaccctgcgaaaggcgcccagattctgccaacgctgacggagatcaaagcgcaggtagccgtggtgccaagcccaagctggggtcgttacccgcacgcattcagccatatcttcgcaggcggttatgcagcaggctactacagctatctgtgggccgacgtgctggcagccgatgcctattcccgctttgaagaagaaggtattttcaatcgagaaaccggtcaatcgttcctggataacatcctgacccgcggcggctccgaagaaccgatggagctgttcaaacgcttccgtggccgtgaacctcagttagatgccatgctcgcgcattacggcatcaaaggatga

SEQ ID NO: 98143 - protein, 680 aa, Erwinia carotovora subsp. atroseptica SCRI1043
MTNPLLTSFTLPPFSSIKTEDIVPAVKSTLDECRETVERVVAQAGPFTWDNLCQTLADSDDRLGRIFSPISHLNAVKNSPELRGAYEQCLPLLSEYSTWVGQHAGLYQAYRSLRDGEHYTTLSLAQKKSVDNALRDFELSGIGLSPEKQKRYGEISARLSELGSQYSNNVLDATMGWSKLITDVAELDGMPESALAAAKAQAEAKEQDGWLLTLDIPSYLPVLTYCTNQALREEMYRAFGTRASDQGPNAGKWDNSEIMAEELALRHELAQLLGFDSYAHKSLATKMAENPQQVIDFLTDLAKRARPQAEEELAQLRAFAKEHFGVDELQAWDITYYSEQQKQHLYSISDEQLRPYFPENRAVNGLFEVVKRIYGITAKERNDVDVWHPDVRFFDLFDESGELRGSFYLDLYAREYKRGGAWMDDCAGKLRKGNGELQKPVAYLVCNFNRPVNGKPALFTHDEVTTLFHEFGHGLHHMLTQIDTAGVSGINGVPWDAVELPSQFMENWCWEPEALAFISGHHETGEPLPQELLDKMLAAKNYQAALFILRQLELGLFDFRLHAEFDPAKGAQILPTLTEIKAQVAVVPSPSWGRYPHAFSHIFAGGYAAGYYSYLWADVLAADAYSRFEEEGIFNRETGQSFLDNILTRGGSEEPMELFKRFRGREPQLDAMLAHYGIKG

SEQ ID NO: 98144 - DNA, 2040 bp, Mannheimia succiniciproducens MBEL55E
  CDS (1)..(2040): transl_table=11
atgtcaaacccgttactggaaaacaccccgttaccgcaattttcgaaaattaaaccggagcatattcaaccggctatcgaacaactcattcaagattgccgcataactacagaaaatctgttaaaacaaccgcagttgagttgggataatttctgccaacccctttcggaagtgaatgatcgtttaagcaaagcctggtcgccggtaagtcatttgaattcggtaaaaaacagcaatgaattacgtgatgcttatcaggcctgtttgcctatgctgtctgaatacggtacctgggtcggacaacatcagggtttgtacaacgcttatgtacaattaaaaaacagcccggaattcgccggttacagcccggctcaaaagaaagccgttgaaaacagcttacgcgattttaaattatccgggatttctttagcgccggaacaacaaaaacgctacggtgaaattgtcagccgtttatcggagttgagttcgcaattcagcaataacgtattagatgcgacaatgggctgggataaagtcattaccgacgaagaacaactcaaaggcttgccggaaagcgcattgcaagcggcaaaacagtcggcacaaaacaaaggcgtggaaggttaccgttttaccttagaattcccaagctatattccggttatgacttactgcgaaaaccgtgaattgcgtgaagaaatgtatcgcgcttttgttacccgagcttcggatcaaggcccgaatgcgggtaaatgggataatagcgcaattatggaagagattcttacgttgcgtgtcgaactggcgaaattgctgggcttcaatagttataccgagctttctttagctaccaaaatggcggaaacaccggcgcaggtattaagctttttagacgatttggcaatgcgttccaaacctcagggagaaaaagaattagcggatctttatgctttctgtgaaaaagaattcgctatcaccgaattggaaccatgggatatttcttattacagcgaaaaagaaaagcaagcgctttatgctattaatgatgaagaattgcgcccttattttccggaacaacgcgttatttccggtttatttgagctgattaagcgtattttcaatattcgggcggtagaacgccaaggggttgattgctggcataaagatgtccgtttctttgatttaattgatgaaaccgatgaagttcgcggtagcttttatttagatctttatgcacgcgagcataaacgcggcggtgcctggatggatgattgtatcggacgtaaaattaaagcggacggggcgcttcaaaaaccggtagcatatttgacctgtaatttcaatgcgccggtaggcgataaaccggcattattcactcatgatgaagtcactacgttgttccatgaattcgggcatggtattcatcatatgttaaccaaagtcgatatcggtgatgtttccggtatcaacggtgtaccctgggatgcggtagagctgccgagtcagtttatggaaaattggtgttgggaagaagaggcattagcctttatttccggtcattaccaaacgggcgaacctttgccgaaagagaaactaactcaattattaaaagcaaaaaatttccatgcggctatgtttgtacttcgtcagttagaattcggtatttttgatttccgtttgcatgacaattacaaaccgggcaaagcaaaccaaattttagatacattaaatgcggtaaaagatcaggtttccgtggtaaaggccgttgactgggcgagaacgcctcatagtttcgggcatattttctccggcggttacgcagcgggctattacagctacttatgggcggaagtactttcagccgatgctttctcccgttttgaagaggagggaatttttaatgccgttaccggcaaatcttatttagacgaaattctgaccaaaggcggatcggaagaaccgatggttctcttcgaacgtttccgcggacgcaaaccgacactagacgctttattacgccacaagggtattgctaactaa

SEQ ID NO: 98145 - protein, 679 aa, Mannheimia succiniciproducens MBEL55E
MSNPLLENTPLPQFSKIKPEHIQPAIEQLIQDCRITTENLLKQPQLSWDNFCQPLSEVNDRLSKAWSPVSHLNSVKNSNELRDAYQACLPMLSEYGTWVGQHQGLYNAYVQLKNSPEFAGYSPAQKKAVENSLRDFKLSGISLAPEQQKRYGEIVSRLSELSSQFSNNVLDATMGWDKVITDEEQLKGLPESALQAAKQSAQNKGVEGYRFTLEFPSYIPVMTYCENRELREEMYRAFVTRASDQGPNAGKWDNSAIMEEILTLRVELAKLLGFNSYTELSLATKMAETPAQVLSFLDDLAMRSKPQGEKELADLYAFCEKEFAITELEPWDISYYSEKEKQALYAINDEELRPYFPEQRVISGLFELIKRIFNIRAVERQGVDCWHKDVRFFDLIDETDEVRGSFYLDLYAREHKRGGAWMDDCIGRKIKADGALQKPVAYLTCNFNAPVGDKPALFTHDEVTTLFHEFGHGIHHMLTKVDIGDVSGINGVPWDAVELPSQFMENWCWEEEALAFISGHYQTGEPLPKEKLTQLLKAKNFHAAMFVLRQLEFGIFDFRLHDNYKPGKANQILDTLNAVKDQVSVVKAVDWARTPHSFGHIFSGGYAAGYYSYLWAEVLSADAFSRFEEEGIFNAVTGKSYLDEILTKGGSEEPMVLFERFRGRKPTLDALLRHKGIAN

SEQ ID NO: 98146 - DNA, 2058 bp, Bacteroides fragilis YCH46
  CDS (1)..(2058): transl_table=11
atgacaaatatagcaaatgcacaaaatccattttttgagaaatatacaactccgtatggcactgttccttttgacaaaataaaaaatgaacattacgaacccgccattcgtgaaggtatcagtcgccaggcagcagaaatagatgccatcgtcaacaacccggaggctcccacattcgctaacacaattcttgcttatgaaaaatcaggagagttactcgatcgggttaccaccgtattcggcaatttgcgcagtgctgaaaccaatgatgacctgcagaagattgcccaggagatgattcctttgttaagcgaacacagcaataacatcagcttgaatcaggaactcttcgaacgtatcaaagttgtatacggtcaaaaggattccatagagctgactccggaacaaaccaagcttctggaaaacgcttataacggatttattcgtcgcggagccaacctacagggagaagccaaggagaaatatcgcgagctgacaaagaatcttagtaaactgacattggatttcagtgaaaataacctgaaagaaaccaataactatcagttgactctgaccgatgaagcccagttggccggtctgccggaaagcgccatcgaagccgctgcagaaacagcccgggaaaaaggagtgaatggctgggtgttcacattgcatgcccccagttatattccttttatgacgtatgctgataaccgggatttacgtcgtgaactttacatggcttacaatacaaaatgtacccacgacaacgaatataacaacctggaaattgtgaaaaagatagccaatatccacatggaaatcgcacaattactgggttatgacaattatgcggaatatacactgaaagaacgcatggccgaaaccggtgatgccgtatataaactgctcaaccaattgctggatgcatatacccccaccgcccataaagagtacgaagctgtacaagaattagcccgtacagaacaaggagatgcttttgaagtgatgccttgggattggagctactactccaacaaactgaaagaccggcagttcaatattaacgaagagatgctccgcccctacttcgaactgagcaaagtgaaagcgggagtcttcggactggctaccaaattgtatggcatcacgtttcataagaacccggatatcccggtatatcacaaagatgtggatgcttacgaagtgctggataaagacggaagtttcctcgccgtactgtatacggatttccatccgcgcgaaggtaaacgttccggtgcctggatgacagaattcaaaggacaatggatagaagataccggtgaaaacagccgtccacatgtatcggtagtcatgaatttcaccaaaccgacagaaagcaagccggcactgctgacttatgacgaggtggaaaccttcctccacgaattcgggcatgccttgcatgggatgtttgccaactcaacttatcagagcttgagcggaacgaatgtatactgggactttgtagagctcccgtcccaaatcatggagaacttcgggattgaaaaagaattcctgcatacctttgccaatcattatcagaccggagaaccgttgcctgacgaattgatcagccggctggtagatgcatcaaacttcaatgttgcgtacgcctgtcttcgccaggtcagtttcgggctgttggatatggcctggtatacccgcaatacccccttcgaaggggacgtaaaggcatacgaacgtcaggcatgggctcaagcacagatattgcccacagttttggaaacctgtatgagtacccagttctcacacatctttgccggaggatattcggcaggttactatagctacaagtgggcggaagttctggatgcggatgcattctcactgttcaagcaaaaaggaatcttcaatgaagaggtagccaattccttccgtaacaacatcttgtcgaaaggcggaacagagcacccgatgatactttacaaacgtttcagaggacaagaacctacgattgacgcattactaatcagaaacggaataaaaaaatag

SEQ ID NO: 98147 - protein, 685 aa, Bacteroides fragilis YCH46
MTNIANAQNPFFEKYTTPYGTVPFDKIKNEHYEPAIREGISRQAAEIDAIVNNPEAPTFANTILAYEKSGELLDRVTTVFGNLRSAETNDDLQKIAQEMIPLLSEHSNNISLNQELFERIKVVYGQKDSIELTPEQTKLLENAYNGFIRRGANLQGEAKEKYRELTKNLSKLTLDFSENNLKETNNYQLTLTDEAQLAGLPESAIEAAAETAREKGVNGWVFTLHAPSYIPFMTYADNRDLRRELYMAYNTKCTHDNEYNNLEIVKKIANIHMEIAQLLGYDNYAEYTLKERMAETGDAVYKLLNQLLDAYTPTAHKEYEAVQELARTEQGDAFEVMPWDWSYYSNKLKDRQFNINEEMLRPYFELSKVKAGVFGLATKLYGITFHKNPDIPVYHKDVDAYEVLDKDGSFLAVLYTDFHPREGKRSGAWMTEFKGQWIEDTGENSRPHVSVVMNFTKPTESKPALLTYDEVETFLHEFGHALHGMFANSTYQSLSGTNVYWDFVELPSQIMENFGIEKEFLHTFANHYQTGEPLPDELISRLVDASNFNVAYACLRQVSFGLLDMAWYTRNTPFEGDVKAYERQAWAQAQILPTVLETCMSTQFSHIFAGGYSAGYYSYKWAEVLDADAFSLFKQKGIFNEEVANSFRNNILSKGGTEHPMILYKRFRGQEPTIDALLIRNGIKK

SEQ ID NO: 98148 - DNA, 2112 bp, Bacteroides fragilis YCH46
  CDS (1)..(2112): transl_table=11
atgaagaagatgtttatggctgccggaatggccgccgtgatgactgcttgcggcacagccggacagaaagcagccaccgatgccggaaacccttttctggcagagtattcaactcctttcggtgttccaccgttcgacttgattaaagtagagcattacaaagaagctttcctgaaaggaatggaagaacagaaaaaagaaatagatgctattgtcaatcagcgttcggttcccgatttcgataataccatcgctgcattcgatcagagtggagagttgttaaataaggtgagtactgtgtttagtggtctgaacagttgtaacacgaacgatgaaatgcaggcttttaataaagagattactccgttgctttcggcacatcgggacgatattagtctgaatccggctctttttgcccgtgtgaaagaagtttatgaacgtcgggagaaactgggattggataaggagcagaataagttactggaagaaacttacaagaagtttgttcgtggaggtgccaatcttgattctgtggatcaggcgaagttgcgtcaactcaatagtgagatttcgatgttgcaattgacttttggacagaacctgctgaaagaaaccaacgcttttgagttggtgattgataagaaggaagatctcgccggattacccgaaagtcttgtggcatccgcagccgaagcggctaaaggggcaggtatggaagagaagtggcttttcactttgcacaatccgagtgtaatgcccctcttgcaatatgcagataatcgcgagttacgtgaaaaaatctttaaaggatacatcaatcgcggcaacaatggcaatgaggccgataataatgaaatcgtgaaaaaattggttgctttgcgtctggagaaagccaaattgatgggatatgccgattatgcttctttcattttggaagaccgcatggcaaagaacgaggaaaatgtatatcgtttgctgaatcagatctggactcctgcagtggcgaaagccaaggaggaattgtctgatattcagtctgaaataaagaaggaaggcgctaactttacccccgaaggatgggattggcgctattattttgagaaagcgaagaaagccaagttcagtttagacgagaatgaagtgcgtccttatcttgaattgaataatgtgcgtgaaggtgctttctatgtagctaacagactttatggcattactttcaccgaaattaaagacattccgaaaccgcatgaagaggcacaggcttttgagtgtaaagataaagacggaacccatcttggtgtgctgtatatggactttttccctcgtaatagtaagcggggaggcgcatggtgcggaacttatcgttctcaaacctatcgtgacggtaaacgtttggcgccggtagttacgattgtgtgtaactttaccaagccttcttcgggacagcctgccctgcttagtgccgatgaggccggtactttattccatgaatttggtcatgcactccacaatttgtttaaagatgtacactttcatgccgtatccggtgtaccgcgtgattttgtggaattaccttctcaggttatggagcattgggtattcgaaccggaggtgctgaaaatatatgccaaacattatcggaccggtgaagtgattcctgctgcattgattgagaaactcgataagagtggaaagtatggccaggggtttgccacaaccgaatatcttgccgcttctctgcttgatatggattaccatgtactgaaagagattccccggaatatggatgtcactgaatttgaggctgctgtgctgaaagagcgtggcttgctaagtcagatacctcctcgttatcgtactacatacttcaatcacatcatgaacagcggctatacggctggttattacagttatatttgggccgaagtgttagatagcgatgcttttgaagcatataaggaaaccggtgatctgtttaatcaggaagtggcttcccgtttccgtcgttatattctcactcccggaggcatcgacgatgcgatggatatgtataagaactttcggggtaaagaaccgggcatagaacctttgttgaggaataggggactatag

SEQ ID NO: 98149 - protein, 703 aa, Bacteroides fragilis YCH46
MKKMFMAAGMAAVMTACGTAGQKAATDAGNPFLAEYSTPFGVPPFDLIKVEHYKEAFLKGMEEQKKEIDAIVNQRSVPDFDNTIAAFDQSGELLNKVSTVFSGLNSCNTNDEMQAFNKEITPLLSAHRDDISLNPALFARVKEVYERREKLGLDKEQNKLLEETYKKFVRGGANLDSVDQAKLRQLNSEISMLQLTFGQNLLKETNAFELVIDKKEDLAGLPESLVASAAEAAKGAGMEEKWLFTLHNPSVMPLLQYADNRELREKIFKGYINRGNNGNEADNNEIVKKLVALRLEKAKLMGYADYASFILEDRMAKNEENVYRLLNQIWTPAVAKAKEELSDIQSEIKKEGANFTPEGWDWRYYFEKAKKAKFSLDENEVRPYLELNNVREGAFYVANRLYGITFTEIKDIPKPHEEAQAFECKDKDGTHLGVLYMDFFPRNSKRGGAWCGTYRSQTYRDGKRLAPVVTIVCNFTKPSSGQPALLSADEAGTLFHEFGHALHNLFKDVHFHAVSGVPRDFVELPSQVMEHWVFEPEVLKIYAKHYRTGEVIPAALIEKLDKSGKYGQGFATTEYLAASLLDMDYHVLKEIPRNMDVTEFEAAVLKERGLLSQIPPRYRTTYFNHIMNSGYTAGYYSYIWAEVLDSDAFEAYKETGDLFNQEVASRFRRYILTPGGIDDAMDMYKNFRGKEPGIEPLLRNRGL

SEQ ID NO: 98150 - DNA, 2049 bp, Methylococcus capsulatus str. Bath
  CDS (1)..(2049): transl_table=11
atgaccaaccctttgctggaggaccacgaactaccgccgttctcgcgcatcgaagcgagccatgtgttgccggcggtccgacaaatcctggccgaaagccgggccgcggtggacgccttgctccaacgcggtgggccctatacctgggccgggctggtggaacccctggacgatctcgacgaccgactgaacaaggcctggtcgccggtcgctcatctgaacgccgtgatgaacagcgaggcgttgagggatgcctacaacgccgctctgccgctcttgagcgaatatgccaccgagatgggccagaatgcggggctgtacgccgctttccgggaaatcgccgaaggcatcgagtacgcccgcctggacaccgcccagcgcaagatcgtcgacaatgcgctgcgcgacttccgcctatccggtgtggccctggaagggaagcagagggcgcgtttcaaggaaatcgcccaggagttgtcgcgcttgggcagccggttttcggacaacgtgctcgatgccacccagggctggacgcggcatatcgacgacgaggcactcttggcaggactgcctgaaaccgaccgggcggtggcccgccaggccgcggaagccgaaggcaagagcggctgggtgttcggtctcgctttcccttcctatgtcgccatcatgactcatgccgatgacagggggctgcgggaggagttctatcgggcctacgtgacccgcgcgtccgaaaccggcccccacggcgggcgttgggacaacggcgaagtgatggagaagatcctggctctgcgtcacgaagaggcgaggctcctgggttttgccaattatgccgagctatctctggccaccaagatggcggagagtcccgaacaggtgctgggttttctgaatgatctggcggaaaaggcgctacccgtcgcccgctgcgacctggaggagttgaaggcatttgcatgcgagaaccacgggctcgacgagttgcaggcctgggacgtggcgtactattccgaaaagctccgcgagcacaaatacgcgttttcggaggaggaggtaaaagcctattttcctgcagagcgcgcggtttccggtctgttcgcggtggtgcagcggctgtacggcctggaaatcaggcggcgcgaagacatcgacgtctggcatccggacgtccgctattacgagatattcgaccggaccggcgaacggcggggcggcttctatctggatctctatgcacgccccggcaagcgcagcggcgcctggatggacgaatgcatcagccggcgccgtgtcggcggcgccattcagacgccggtcgcctatctgacctgtaatttcacgccgcccgcgggtgacgagccggcgctgctgcggcacgacgacgtggtgacgctgttccatgaattcggccacggcttgcaccatctgctcaccaaggtcgaacatctcggtgtgtcgggaatccgcggggtggaatgggatgcggtagaactgccgagccagttcatggagaacttctgctgggagcgcgaggcgctggccctgatctccggccattaccggaccggcgagcctctgccggacgaactgctggcccggatgttggcggcgaaaaacttccaggccggcatgcagacggtccgtcaactggagttcgccctgctggatttccgcattcatcacgaatacgatccagcccgaggcgggcgcgtctatgaaatcctcgaggatgtgcggcgacgagtatcggtcatgccgcctccggcgtacaaccgctttccccacagttttcagcacatcttcggcggcggctatgcggccggctattacagttacaagtgggcggaagtcctgtcgagcgatgccttttcgctgttcgaggagcgtggcatcttcgatccggagaccggccatgctttcctgagcaacgtgctggaacagggcggacgtcggagtgccctggagtctttcatcgccttccgcggccgcgaaccggacatcgaggctttgctgcgccacagtgggatgctcgtatccgccggctga

SEQ ID NO: 98151 - protein, 682 aa, Methylococcus capsulatus str. Bath
MTNPLLEDHELPPFSRIEASHVLPAVRQILAESRAAVDALLQRGGPYTWAGLVEPLDDLDDRLNKAWSPVAHLNAVMNSEALRDAYNAALPLLSEYATEMGQNAGLYAAFREIAEGIEYARLDTAQRKIVDNALRDFRLSGVALEGKQRARFKEIAQELSRLGSRFSDNVLDATQGWTRHIDDEALLAGLPETDRAVARQAAEAEGKSGWVFGLAFPSYVAIMTHADDRGLREEFYRAYVTRASETGPHGGRWDNGEVMEKILALRHEEARLLGFANYAELSLATKMAESPEQVLGFLNDLAEKALPVARCDLEELKAFACENHGLDELQAWDVAYYSEKLREHKYAFSEEEVKAYFPAERAVSGLFAVVQRLYGLEIRRREDIDVWHPDVRYYEIFDRTGERRGGFYLDLYARPGKRSGAWMDECISRRRVGGAIQTPVAYLTCNFTPPAGDEPALLRHDDVVTLFHEFGHGLHHLLTKVEHLGVSGIRGVEWDAVELPSQFMENFCWEREALALISGHYRTGEPLPDELLARMLAAKNFQAGMQTVRQLEFALLDFRIHHEYDPARGGRVYEILEDVRRRVSVMPPPAYNRFPHSFQHIFGGGYAAGYYSYKWAEVLSSDAFSLFEERGIFDPETGHAFLSNVLEQGGRRSALESFIAFRGREPDIEALLRHSGMLVSAG

SEQ ID NO: 98152 - DNA, 2040 bp, Nocardia farcinica IFM 10152
  CDS (1)..(2040): transl_table=11
atgaatccgttcttcgaacgcagtgcgctgccctacgagttgccgccgttcgcgcggatacgggaggagcatttcctgcccgcgttcgagcgggggatgcgcgagcagttggcggaggtggcggcgatcgcgggggacgcgcaggcgccgacgttcgcgaacacggtggtggccctggagcgctcgggggcggtgttgcggcgggtgcgcgcggtgttcttcgcgctggtctcggcggattcgacgccggggatccaggcgatcgaggcggaggtctcgccgcggctggccgcgcatcacgacgcgatccacctgaacgcggagttgttcgcccggatcgacgcgctgtacgagcggcgcgcggagctgggattggacgcgcaggatctgcggctgctcgagcagtaccacctggagttcgtgcgggccggtgcgcgactggacgcggcgggacaggcccggttgcgcgagctgaacgccgaattggccgccgccgccacccgtttcggccagaacctgttggcggcgacgaacgcggcgacggtgctggtcgagcacgagcgggagctggccgggctggcgcccgatgcggtggcggcggccgccgagcaggcacgggcactcggccacgagggctgggcgttgcggctgcagaacgtctccaaccaaccggtgctcgcggagctgagcgatcgggagctgcgccgccgggtgctcgacgcctcgctggagcgcggtttcggcaccgaccccgacaacgccgcgacggccgtgcggatcgccgccctgcgcgccgagcgggccgcgctgctcggcttccccgatcacgcggggtacgtggtggccgaccagacggcgagcaccgccgaggcggtcgaggagatgttcgcgcggctggtcccgccggcggtggccaacgccgagcgcgaggccgccgaactggccgcggcgatgcgtgccgcgggcgcgggcgacgagctgcgggcctgggactggctgtactggtcggagcgggtgcgcgccgaacggttcgcggtggacggtgcggcgctacggccgtacctcgagttggagcgggtgctgtgggacggggtcttccacgcggccgagcgggtctacggcatcaccgtccgcgaacgcgcggacctgaccggctatcacccggacgtgcgggtcttcgaggtgttcgacgccgacggcagcccgctcggcctgttcctcggtgactacttcgcgcgcccgtccaagcgcggcggggcgtggatgacggcgctggtggatcagtccacgctgctgggcacccgcccggtcgtgacgaacgtgctcaacatcgcccggccgcccgagggtgagccggtgctgttgacctgggacaacgtgcgcaccctcttccacgagttcggccacgccctgcacgggctgtgctccgacgtgcgctacccgtatttctcgggcacggcggtgccgcgcgacttcgtcgagttcccgtcgcaggtcaacgagatgtggatggaccacccggagatcctggcgcgctacgcccgccacgtcgagaccggtgcgccgatgccgccggagttggtcgaacgcctgcgcgaggcggcgcgcttcggcgaagggttccgcaccgtggagtacctggcggccgcgcagctggactgggcctggcatcgggtcgccgacccggccgcgctcgacggcgtggacgccgccgctttcgaggagcaggcgctgcgcaaggcagggctggcgctgtcggccgtcccgccccgctatcgcaccgcctacttcgcgcacatcttctccggcgggtacgcggcgggctactactcctacatctggagcgaggtgctcgacgccgacacggtcgaatggttcaccgacggcgcggcgccgatccgggacaagggcgagatcttccggcgcacgctgctcgcacgcggcggctcggtcgacccgatggcggcgttcgcgcaggtccgggggcgcgagccggacatcgggccgctgctggcccggcgcggcctgagccggacgtga

SEQ ID NO: 98153 - protein, 679 aa, Nocardia farcinica IFM 10152
MNPFFERSALPYELPPFARIREEHFLPAFERGMREQLAEVAAIAGDAQAPTFANTVVALERSGAVLRRVRAVFFALVSADSTPGIQAIEAEVSPRLAAHHDAIHLNAELFARIDALYERRAELGLDAQDLRLLEQYHLEFVRAGARLDAAGQARLRELNAELAAAATRFGQNLLAATNAATVLVEHERELAGLAPDAVAAAAEQARALGHEGWALRLQNVSNQPVLAELSDRELRRRVLDASLERGFGTDPDNAATAVRIAALRAERAALLGFPDHAGYVVADQTASTAEAVEEMFARLVPPAVANAEREAAELAAAMRAAGAGDELRAWDWLYWSERVRAERFAVDGAALRPYLELERVLWDGVFHAAERVYGITVRERADLTGYHPDVRVFEVFDADGSPLGLFLGDYFARPSKRGGAWMTALVDQSTLLGTRPVVTNVLNIARPPEGEPVLLTWDNVRTLFHEFGHALHGLCSDVRYPYFSGTAVPRDFVEFPSQVNEMWMDHPEILARYARHVETGAPMPPELVERLREAARFGEGFRTVEYLAAAQLDWAWHRVADPAALDGVDAAAFEEQALRKAGLALSAVPPRYRTAYFAHIFSGGYAAGYYSYIWSEVLDADTVEWFTDGAAPIRDKGEIFRRTLLARGGSVDPMAAFAQVRGREPDIGPLLARRGLSRT

SEQ ID NO: 98154 - DNA, 2052 bp, Legionella pneumophila str. Paris
  CDS (1)..(2052): transl_table=11
atgctttcaaaaaattacatgatggaaaggtataacatgtcgaccacagttggattgccacaatttagccatataaaaattgaacatttcaaatctcatcttgatgctttattaaaaaaccatcttgaggaaattgacaggctgcttaaggaaaatcaccactatacctgggataatttaatttatcctttagatagcctcgccgatgaactggagcgtttttggtctccttttgcacatatgcacgcagtgatggattctgaggcaatacgtgaatcctatgaaacgtgtttgccattgctgtctgcctatgatgctgcgattgggcataatcaagacttgtatgaggcgattaaatcgatagatcagcattcccttaaccctgcccagaaaaaaatcattgaagacagcatgcaggattttgagctatcgggagttgctttatccaaggcgaataaaaagcgctttgaagccattcaatcaagactggctgaattatccagcaaattcgaaaacaatgtgctggacgcaacccatgcctacactatccatattaccgaagcagaacgtgtggcaggattacctgagcatgcattaaatacggcaaaagagttggcgcatgagaaagggctggatggttttgttttaaccctcgaatacccttgttttcaggccgttattactcatgctgaagacagggctttacgtgaagaaatgtaccgtgcttacatcaccagagcttcagatcaaggccctaatgcaggaacctttgataatactccgctgattgatgaaattctgtccctgcgccatgaaaaagccgagcttttagggtttaataattttgctgagttatccctggctaccaagatggctgcctcgaccaatcaagtcactgaatttatctatgatttgatcagcagaactcgtgacaagggtaaagcggaatttaggcagcttgaagtgtttgcacaggataaatggaatctgagtccggtaaacccatgggacgttgcttatctgtctgaaaaaagaagacaggatttgtattccttatctcaagaggaattacggccttattttccacagcctaaagtgatgcaaggcttgttcgcgattgttaaaaagctctttggtatgagtatcgaggagattgagggcgtggatgtttggcataaggatgttcaatgctattgcatagtcgatgaatccaatcaaacgcgcgggtacatttacacggatttgtttgccagaccgcacaagcgcaatggtgcctggatggactccatgcaaagccgcagaaaactggaggatggcacagttcaattacccattgcgaccttgacttgcaattttgccaagccttctgcaaacagaccggccatgttatcgcacgatgaagtggtgactttatttcacgagtttggtcattgtctgcatcacgttttgactcaagtcgattaccttggcggctcagggattaatggcgtggaatgggatgcggtggaattacccagccaatttttcgaaaactggtgctgggatgagcacgcattgtctttactgacttcgcacgtggatacaggggaaaccttgccttccgcattgtacgagcgcttgattgccgctaaaaattttcaatccgccatggccatgttaagacaaatggaatttgccttgtttgattttcgcattcaccaggaatatcaaatcggtaaagcgtcctatgtcgcaaatattctggcggatgtacgttctaaaaccagtgttgtacccattgttccttataaccgctttcaacatagtttctcgcatatttttgggggtggttacgctgctggttattacagttacatgtgggcagaagtactatccagtgatgcctttgcgcgctttgaggaggaaggtattttcaaccccaaaactggacatgactttttgaaatccattttggaggcaggcggctcaagaaaagcagccgatgctttcgccgaattccgagggagacccgcgacgattgatgctttgctgcgccataacgggattttataa

SEQ ID NO: 98155 - protein, 683 aa, Legionella pneumophila str. Paris
MLSKNYMMERYNMSTTVGLPQFSHIKIEHFKSHLDALLKNHLEEIDRLLKENHHYTWDNLIYPLDSLADELERFWSPFAHMHAVMDSEAIRESYETCLPLLSAYDAAIGHNQDLYEAIKSIDQHSLNPAQKKIIEDSMQDFELSGVALSKANKKRFEAIQSRLAELSSKFENNVLDATHAYTIHITEAERVAGLPEHALNTAKELAHEKGLDGFVLTLEYPCFQAVITHAEDRALREEMYRAYITRASDQGPNAGTFDNTPLIDEILSLRHEKAELLGFNNFAELSLATKMAASTNQVTEFIYDLISRTRDKGKAEFRQLEVFAQDKWNLSPVNPWDVAYLSEKRRQDLYSLSQEELRPYFPQPKVMQGLFAIVKKLFGMSIEEIEGVDVWHKDVQCYCIVDESNQTRGYIYTDLFARPHKRNGAWMDSMQSRRKLEDGTVQLPIATLTCNFAKPSANRPAMLSHDEVVTLFHEFGHCLHHVLTQVDYLGGSGINGVEWDAVELPSQFFENWCWDEHALSLLTSHVDTGETLPSALYERLIAAKNFQSAMAMLRQMEFALFDFRIHQEYQIGKASYVANILADVRSKTSVVPIVPYNRFQHSFSHIFGGGYAAGYYSYMWAEVLSSDAFARFEEEGIFNPKTGHDFLKSILEAGGSRKAADAFAEFRGRPATIDALLRHNGIL

SEQ ID NO: 98156 - DNA, 2043 bp, Photobacterium profundum SS9
  CDS (1)..(2043): transl_table=11
atgtctaacccattattgtccatgacggttttgccaccgttttctctgattaagccggaacatattaagccagccgttgaacaggctattgccgactgtcgtgtaaaagtagaagaagtactcaccaatagcgatgtggcaagttgggaaacgatttgtattccattggcagagacggatgatcgactcagccgtatttggtcacctgttgggcatcttaatggtgttaaaaatagccctgaactacgtgaagcgtatgaaagttgcttacctatcctatcggattacggtacttgggtgggtcagcacaaaggtttatacaaagcatataaagccattaaggtgagtgatgagtttgctgcgttgtctcaagcgcagaaaaaaacgattacagatgcgctcaaagacttcgaattgtctggtattggtttgcctgccaaagagcaacatcggtatggtgaaattagcaaacgactttcagaattagcatcaacgtttagcaataacgtgttagatgcaacaatgggatggagcaaacggattacagatgaatcggcattggaaggcttgcctgaatccgcaatacaagcagcaaaagcgaatgcagaagccaaagataaagaaggctacttgtttacgcttgaaattccttcttatttacctgtaatgacttattgtgccaaccgtgaattacgtcaggaaatgtatcaagcatttgctactcgtgcttcagatcgtggtccaaatgccggtgaatgggataacagtgaaatcattgctgaaaagttaaagctgagccatgaaattgcacgcctattaggttttaacacttacagtgaaaaatcacttgcgacgaaaatggcggaatctccagagcaagtgttgggttttctgaataatcttgcggtacgcgcaaaaccacaagctgaacgtgaagtggcagagctacgtgactatgcgaaaactgaatttggcgcagaagatctagaaccgtgggatttgtctttttattcagaaaaattgaaacaacaccgttatagcatttcagatgaacagcttcgcccgtatttccccgagaaaaaagccgttgctggtttgtttgaagtacttaagcgtgtttttgggatggatgtgaagcagcgcgaaggtgtcgaggtgtgggatgacacagttaccttctacgatatctttgatgcaactggcgagcttcgtggcagtttttatcttgatttatatgcccgtgaacataagcgtggcggagcatggatggatgaatgtgccgtacgccgtagatgcgccgatggtagcttacaaacccctgtcgcatacctaacgtgtaactttaataaacccattggcgataaacctgcattgtttacccatgatgaattggtcactttattccatgaaactggccatggtattcaccatatgttgacgcaggttgatgcgccatctgtttctggtatcaatggtgtgccgtgggatgcggttgaattaccgagtcagttcctcgaaaactggtgctgggaagaggaagcgctggcatttatttcgggtcactttgaaacgggtgagcctttaccgaaagaaatgctagataaaatgttggcggcaaaaaactttcaatctgcgatgggtattttacgtcagttagagtttggtctgttcgatttcagcctatacaccaactatgatccagaagtgggtgcgcaggtattagaaacattatttgatgtgaaatcgcgagtatctgttgtacctagccctgaatggggacgttttccgcatagctttagccatatttttgccggtggttacagtgcgggttattacagctacctatgggcagagctattatctgccgatgcattttctcgttttgaggatgaaggtatttttaaccaagcaacaggtgctgacttcctacattgcattctagagcgtggcggtagtgaagagcctatggacctttttaaacgtttccgcgggcgtgagcctcaactggatgcgatgctacgtcactgcggtattacaggctaa

SEQ ID NO: 98157 - protein, 680 aa, Photobacterium profundum SS9
MSNPLLSMTVLPPFSLIKPEHIKPAVEQAIADCRVKVEEVLTNSDVASWETICIPLAETDDRLSRIWSPVGHLNGVKNSPELREAYESCLPILSDYGTWVGQHKGLYKAYKAIKVSDEFAALSQAQKKTITDALKDFELSGIGLPAKEQHRYGEISKRLSELASTFSNNVLDATMGWSKRITDESALEGLPESAIQAAKANAEAKDKEGYLFTLEIPSYLPVMTYCANRELRQEMYQAFATRASDRGPNAGEWDNSEIIAEKLKLSHEIARLLGFNTYSEKSLATKMAESPEQVLGFLNNLAVRAKPQAEREVAELRDYAKTEFGAEDLEPWDLSFYSEKLKQHRYSISDEQLRPYFPEKKAVAGLFEVLKRVFGMDVKQREGVEVWDDTVTFYDIFDATGELRGSFYLDLYAREHKRGGAWMDECAVRRRCADGSLQTPVAYLTCNFNKPIGDKPALFTHDELVTLFHETGHGIHHMLTQVDAPSVSGINGVPWDAVELPSQFLENWCWEEEALAFISGHFETGEPLPKEMLDKMLAAKNFQSAMGILRQLEFGLFDFSLYTNYDPEVGAQVLETLFDVKSRVSVVPSPEWGRFPHSFSHIFAGGYSAGYYSYLWAELLSADAFSRFEDEGIFNQATGADFLHCILERGGSEEPMDLFKRFRGREPQLDAMLRHCGITG

SEQ ID NO: 98158 - DNA, 2043 bp, Salmonella enterica subsp. enterica serovar Paratypi A str. ATCC
  CDS (1)..(2043): transl_table=11
atgtcgacgaatcctttgttagaccagagtctgttgccttatcaggcaccgcgttttgatcggatcaaagattgccattatcgtcctgcttttgatgagggcgtgcggcaaaaacgcgtggaaatcgaggccatcgtcaatcatccggcggcccctgactttacgaatacgcttctggcgctggagcaaagcggggcgcttctgtcacgcgtcaccagcgtttttttcgcgatgacggccgcgcacactaacgatgaactccagcggttggatgaggccttttctgccgagctggcggcgctctccaacgatatttatttgaatagcgcgttattcgctcgcgtggatgccgtctggcaacagcgtcactcactggggctggatgatgagtcgctacggttggtcgatgttatccatcagcgttttgtgttggcaggcgcgcagcttgccgaagaggataaagcgcgactgaaggtattgaatactgaatccgcgaccttaatgagtcagtttaatcagcgtctgctggcggcaagtaaagcgggcgggctggcggtcgatgacgcgcattgcctggcaggattaagcccggaagaaatgaccgtcgctgctgaagcggcgcgtgaaaaaggcctggaggagcgctggttcattccgctccttaatacgacgcaacagcctgcgcttgctacactgcgcgatcgccagacccgcgaaaatttattcgcagcgtcatggactcgggcggaaaaaggagatgcccacgatacccgcgctatcgttcagcgtctggtagagattcgtcgctgtcaggcaaaactgctgggtttccccaattatgccgcatggaaaatggccgatcagatggcgaaaacgccgcaagccgcactgagctttatgcgtggcattgtgccgccagcgcgtcagcgggtactcaatgaacaggcggaaattcagaacgtcattgatggtgagcagggcggctacaccgttcaggcctgggactggatgttctatgccgaacaggtacggcgggaaaaatatgcgttagatgaagcgcaactgaagccctattttgccttaaatacggtgttgcaagagggggttttctggaccgccaaccagctattcggcatcaccttcgtcgagcgttttgacattccggtgtatcaccctgatgttcgggtgtgggagattttcgactccgatggtgtcggcatggcgttattttatggcgacttcttcgcgcgggactcgaaaagcggcggcgcgtggatggggaattttgtcgagcaatccacactcaatgaaacccggcccgttatatacaatgtttgtaactatcagaaaccggttgatgggcagcctgcattactgctttgggacgacgttattacgctcttccatgagtttggtcatacgttacatggtttgtttgccgtccagcgctatgccacgctttcaggtaccaatacgccccgcgactttgtcgagtttccctcccagattaatgagcattgggcgagccatccacgtgtgttcgaacgctacgcgcgtcatgtcgacagcggtgaaaaagtgcctgctgatttacaggaaaaaatgcgcaaggcgagtttatttaataaaggttacgatatgactgaattgctcggcgccgcattgctggatatgcgctggcatatgctggaggagagcgtagcagagcagtctgtcgctgagttcgagcagcaggcgctggccgccgagcatcttgatttaccggcggtgccgccccgctatcgcagcagttattttgcccatatcttcggcggcggctacgcagcgggatactacgcctatctttggacgcaaatgttagcggatgacggttatcaatggtttgtagagcagggcggcctgacgcgtgaaaacgggcagcgttttcgtgatgctatcctttcccgggggaatagtactgatttagaaacgctttattcagcctggcgtggacatgaaccgcatattgaccccatgttgcaatatcgtgggctcgatcgctaa

SEQ ID NO: 98159 - protein, 680 aa, Salmonella enterica subsp. enterica serovar Paratypi A str. ATCC
MSTNPLLDQSLLPYQAPRFDRIKDCHYRPAFDEGVRQKRVEIEAIVNHPAAPDFTNTLLALEQSGALLSRVTSVFFAMTAAHTNDELQRLDEAFSAELAALSNDIYLNSALFARVDAVWQQRHSLGLDDESLRLVDVIHQRFVLAGAQLAEEDKARLKVLNTESATLMSQFNQRLLAASKAGGLAVDDAHCLAGLSPEEMTVAAEAAREKGLEERWFIPLLNTTQQPALATLRDRQTRENLFAASWTRAEKGDAHDTRAIVQRLVEIRRCQAKLLGFPNYAAWKMADQMAKTPQAALSFMRGIVPPARQRVLNEQAEIQNVIDGEQGGYTVQAWDWMFYAEQVRREKYALDEAQLKPYFALNTVLQEGVFWTANQLFGITFVERFDIPVYHPDVRVWEIFDSDGVGMALFYGDFFARDSKSGGAWMGNFVEQSTLNETRPVIYNVCNYQKPVDGQPALLLWDDVITLFHEFGHTLHGLFAVQRYATLSGTNTPRDFVEFPSQINEHWASHPRVFERYARHVDSGEKVPADLQEKMRKASLFNKGYDMTELLGAALLDMRWHMLEESVAEQSVAEFEQQALAAEHLDLPAVPPRYRSSYFAHIFGGGYAAGYYAYLWTQMLADDGYQWFVEQGGLTRENGQRFRDAILSRGNSTDLETLYSAWRGHEPHIDPMLQYRGLDR

SEQ ID NO: 98160 - DNA, 2190 bp, Idiomarina loihiensis L2TR
  CDS (1)..(2190): transl_table=11
atgcggaaaactttactggctgtagctgtgagtgcggcagtatcgttgggagcttgcagtgatgcaaatgactcatcgacaactgagaacaaaacggcttcaactgaagcttctaaagacagcagtcaacaagcaaaagaaaccaacccattctacaaacccagtcctctgctgtatcaggcacctgacttcgatgccattgagttcaaacattttgagcctgcgtttgaaaagggtatggaagagcacatggctgaaattgaagccattgcaaataactcagcagagccaacatttgagaataccattgtagcgatggaaaaatcgggtgcgatccttggccgtgtttcatcagttttctacaacctgtcatcgtccaatagtaatgaacaaattcgcgagttgcagggtaagttagctcctaagttagcggctcatagcgataatattcgtctgaacgctaaattgtttgcccgaattaagtcacttcatgacaaacgcgacgaattagagctggatactgcgtcagaacgtttattagaagacacctacaaaggttttgtccgtgctggtgctgaactaaatgaagatgagcaacaacagattcgcgatgttaattcgcaactttccagcctgaccacagaatttcgcaacagcttaatgaagttgaccaaggaaaacgtgattgtcgttgattctaaagaagaattagccggcttaagtgatagtcaaatcagtagcttggcgagtgcggctgaaagccgtgatatgccgggtaaatacgccattactttaactaacacaacacgtcagtctattttgacggatcttgaaaaccgcgaattgcgtcagcgcatttgggaagcgtcctcaaaccgtggcacagggaataccgaaaccgatactcgcccaatggttgcaaagctaactcagttgcgtgcagaaaaggcgaatctattaggttatgacacctggggtgattacgttcttgaagaaaacatggccggtaatccagaagccgctcaaaaaatgttgcgtgatctggttcctgcagttgtaagcaacgttgaaagcgaagccgaagagattcgtgcgatgattaaggctgaaggcgaacagcatgaactgaaaccgtgggactggttctactacgcagagaaagttcgcgaagaaaaatacgcgattgactctgacgaagtgaaaaaatacttcgaatttaatcgtgttctggaagacggcgtgttctatgcaatgaaccaactgtttggcatcacttttgaagagcgtaacgatatccctgtttatcaggatgatgttgttgtttatgaagtgaaagacgtagacggctcaagtttaggtttgttctatgcggactattatgctcgcgacagcaaacgcggtggagcctggatgagctcgttccgtactcagtctgaattgatgaaccagaagccggttattttgaataacatgaacatcactaaagcgcctgagggtgaaccaaccttgttaagctttgatgaagtttcaaccatgttccatgaaatgggccatgcgttgcacggcatgttctctgacgtgaagtatccatctcaggcaggtacgtctgtgccgcgtgactacgttgagttcccttcaactttccaggaagactggacgctgaacccgaaagttattgcaaattatgcaaagcattacgaaacgggtgaacagattcctgacgagttactgcaaaaagtactggatgcacgtaactttaaccagggctttgatactttagagtatatttccgctgcgttactggatcttgagtatcatacagtggagccgggtacagaaattagcgacgttgagaagtttgagcaggacgcgctggagaaaaacggtgtagcgattgaagctgtaccaccacgctaccgttcaacttactttgctcacgtatttgctggcggctactcagcaggttactacgcttacatgtggagtgaagttctggcagccgatgcgtttaaacacatgggcaataacggtggtttgagccttgaaaatggccaggctttccgtaaagaaattctgtccaaaggcagcagtaaagatcctatgcaacagtacatcgactggcgtggtcaggagccaactgttgaagccttacttgagcgtcgcggactaacgaatcctagtattgactaa

SEQ ID NO: 98161 - protein, 729 aa, Idiomarina loihiensis L2TR
MRKTLLAVAVSAAVSLGACSDANDSSTTENKTASTEASKDSSQQAKETNPFYKPSPLLYQAPDFDAIEFKHFEPAFEKGMEEHMAEIEAIANNSAEPTFENTIVAMEKSGAILGRVSSVFYNLSSSNSNEQIRELQGKLAPKLAAHSDNIRLNAKLFARIKSLHDKRDELELDTASERLLEDTYKGFVRAGAELNEDEQQQIRDVNSQLSSLTTEFRNSLMKLTKENVIVVDSKEELAGLSDSQISSLASAAESRDMPGKYAITLTNTTRQSILTDLENRELRQRIWEASSNRGTGNTETDTRPMVAKLTQLRAEKANLLGYDTWGDYVLEENMAGNPEAAQKMLRDLVPAVVSNVESEAEEIRAMIKAEGEQHELKPWDWFYYAEKVREEKYAIDSDEVKKYFEFNRVLEDGVFYAMNQLFGITFEERNDIPVYQDDVVVYEVKDVDGSSLGLFYADYYARDSKRGGAWMSSFRTQSELMNQKPVILNNMNITKAPEGEPTLLSFDEVSTMFHEMGHALHGMFSDVKYPSQAGTSVPRDYVEFPSTFQEDWTLNPKVIANYAKHYETGEQIPDELLQKVLDARNFNQGFDTLEYISAALLDLEYHTVEPGTEISDVEKFEQDALEKNGVAIEAVPPRYRSTYFAHVFAGGYSAGYYAYMWSEVLAADAFKHMGNNGGLSLENGQAFRKEILSKGSSKDPMQQYIDWRGQEPTVEALLERRGLTNPSID

SEQ ID NO: 98162 - DNA, 2040 bp, Idiomarina loihiensis L2TR
  CDS (1)..(2040): transl_table=11
atgagccataacccgctattagaacagagccagcttccggactttgagcaaattaaacccgaacatattcaacccgctgttgaagagtgcatacagcacgctcgaaaaaccattgatgaagtactggaacatggtgattttagctggaatggtttgattgaacctttgaccgatgcggatgaaaagcttgagcatgtctgggcaccggtatcgcatttgaactccgtattaagcacgcctgaactgcgtgaagcgcatgacagttgcctgccattgttgtcggactacgcaacctatgtaggacagcacaaaggcttgtttgacgcttatcaggcactgcgtgaaagtgacgagttcgacagtttgaccgaagctcagcaaaaactcattaacgacaccttacgtgattttcgtttgtcgggtgtggatttacccgaagacaaaaagaaacgttatgctgaaatttcatcgcggctgtctgacttgtcttcaatcttcagcaacaacttgctggatgccacccacgcatggacttgcctgattaccgatgaaagccgcctggctggcttgccggaaagcatcaaagaagctgcaaaagaaaccgcagcagaccaggaaaaagaaggctggttgttcactttagatattccaagttatctgccggtcatgttgtacgccgaagaccgggagctgcgtaaagaaatgtaccaggcttttgtgacccgcgcgtcggaaactgggcctaatggcggggagttcgataactctgaggttatgaacgaaactttggctttgcgtcatgaaatgtcggaactgttaggttttaacgactttgctgaaatgtcactggcgacgaaaatggctgagtcgccggagcaggtattaggttttgtgcaggatcttgccaataagtctaaagcacaggcgaaagccgagtatgctgaaattgaaacctttgcggcagagcaaggcgtggagaaaatggaagcctgggatgttccttactttagtgagcagttaaagcagcagcgctactctatttccgatgaattattacgcccttactttcctgagcaacaagtgctaaacggtttgtttgaggtggttaagcgcctgtttggcatgacggttagcgagcaaaaagacgtaaaaacctggcatgagaatgtgcgtttcttccgcattcacgatgccgacggacatttgcgtggcagcttctatctggatctctacgcgcgttcaggcaagcgaggaggcgcctggatggcggattttgtcggccgcagagtgcacgccgatggcgaattgcaaaacccggtggcctttttaacctgtaactttagcaagccggtgggtggtaagcctgcactctttactcacgatgaagtgctgacattattccatgaattcggtcatggcttgcaccacatgttaactcaggtcgataccgctggtttgtctggtattaacggtgttgaatgggacgctgttgagctgcccagtcaattcctggaaaactggtgctgggaaccggaagcgctggcattaatatccggacactatgaaaccggtgaaccgctgccacaggagcttctggaaaaaatgttggctgcgcgcaattatcagtcggctatgcaaatgatgcgtcaattggagttctcgctgtttgatatgcgcattcaccacgagtttgacgaaaacacgggtgcgcgtattagtgaaattctgagtgaagtgcgtcagcaaacttcggtacgtattccaccggagtacaaccgttttcagcatagctttggtcatatctttgctggcggctatgcggcaggttattacagttacaaatgggctgaagtgctgtcgtctgatgcgtttgcgcgctttgaagaagagggcatatttaacgctacaaccgggcgcgactttttacatgtcattctggaacgtggtggcagccgtaaagccgcagatttattccaggaatttcgtggtcgcgaaccgaatgccgaagctttgttacgtcatagcggcatagctgcctga

SEQ ID NO: 98163 - protein, 679 aa, Idiomarina loihiensis L2TR
MSHNPLLEQSQLPDFEQIKPEHIQPAVEECIQHARKTIDEVLEHGDFSWNGLIEPLTDADEKLEHVWAPVSHLNSVLSTPELREAHDSCLPLLSDYATYVGQHKGLFDAYQALRESDEFDSLTEAQQKLINDTLRDFRLSGVDLPEDKKKRYAEISSRLSDLSSIFSNNLLDATHAWTCLITDESRLAGLPESIKEAAKETAADQEKEGWLFTLDIPSYLPVMLYAEDRELRKEMYQAFVTRASETGPNGGEFDNSEVMNETLALRHEMSELLGFNDFAEMSLATKMAESPEQVLGFVQDLANKSKAQAKAEYAEIETFAAEQGVEKMEAWDVPYFSEQLKQQRYSISDELLRPYFPEQQVLNGLFEVVKRLFGMTVSEQKDVKTWHENVRFFRIHDADGHLRGSFYLDLYARSGKRGGAWMADFVGRRVHADGELQNPVAFLTCNFSKPVGGKPALFTHDEVLTLFHEFGHGLHHMLTQVDTAGLSGINGVEWDAVELPSQFLENWCWEPEALALISGHYETGEPLPQELLEKMLAARNYQSAMQMMRQLEFSLFDMRIHHEFDENTGARISEILSEVRQQTSVRIPPEYNRFQHSFGHIFAGGYAAGYYSYKWAEVLSSDAFARFEEEGIFNATTGRDFLHVILERGGSRKAADLFQEFRGREPNAEALLRHSGIAA

SEQ ID NO: 98164 - DNA, 2058 bp, Azoarcus sp. EbN1
  CDS (1)..(2058): transl_table=11
atgcccaatcccctccttgatttttcggcgctgccgcgcttcgacgacatccgcccggagcatgtcgcgccggcaatccgccagctcatcgacgagaaccgcgcgctgatcgcggagctcgtcgccgaccccgcgccgccgacctgggcgaacttcgtcacgccgatgaccgaggaaggcgagcgactcggtcgcgcgtggggcatcgtcggccatctgcacagcgtcatggacgtgcccgaatggcgcgaagcctacaacgcgatgctgcccgaggtgtcgagcttctatgccgaagtcgggcagaacctcgagctgttcgagaaataccggctgctgcacgacagcgccgaatacgacatgctgtctccggcgcgccagcgcatcatcgaccacgagctgcgcgacttccgcctgtcgggcgccgagctgccggacgccgacaagccgcgcttcaaggaaatccaggaagagcagtcggcgctcgcggcgaaattttccgagaacctgctcgacgccaccaacgcccacaccgaatggatcgaggacgaagcggagctcgccggactgccggacgatgcgatcgccgcggcgcgcgcggccgccgaacgcgacggcaagccggggtggaaattcacgctgcagatgcccgcctacctgccggtgatgcagtacgccgacaaccgcgaactgcgcgcacgaatgtatcgcgcgtatgcgacacgcgcgtcggaacagggcaggccggagctcgacaacgggccgctgatcggccgcatcctcgctctgcgcgccgaagaggcgaagatgctcgggtaccgcaacttcgccgaagtgtcgctcgtgccgaagatggccgaaacgcccgacgaggtgctcgccttcctgcgcgagctggcgacgaaagccaagccgttcgccgagcgcgatctcgccgaactgcaagctttcgcccgcacggaactgggcctcgatccgctcgagccgtgggacatcggttatgcgtcggaaaaactgcgccaggcccgttacgcgttctcggaccaggaagtgaaacagtacttccccgagccgaaagtgctcgaaggcctgttcggcgtgatccgcacgctgtatggcgtcgacatcgtcgccgacaacgcgccgctgtgggatgcgggcgcacatttcttccgcatcgaccgggacggcgcgacgctgggacatttctacctcgacctgcacgcgcgcaagaccaagcgcggcggcgcatggatggactcggcgaggagccgctacgtcggtccgcgcggcacgcagacgccggtcgcgtacctcgtatgcaacttccccggcccggtgggaggaaagcctccgaccttcacgcacgacgacgtgctgacgctgttccacgaatgcggccacggcctgcatcacctgctgacgcagatcgacgacctcgcggtatcgggcatccacggcgtcgaatgggacgccgtcgaactgccgagccagttcatggagaacttctgctgggaatgggacgtgctctgcggcatgacttcgcatgtcgacaccggggccccgctgccacgcgaactcttcgacaagatgatcgcggcgaagaacttccagagcggcatgcagacggtgcgacagctcgaattctcgatgttcgacctgcgtctgcacagcgaggtcgacgcgtcggccggaccggttccggtcgagcgcgtcatggagctgctcgacgaagtgcggcgcgaagtcgcggtgatgatcccgccgccctggcaccgcttcccgcacagcttctcgcacatcttcgccggcggctacggggccgggtattacagctacaaatgggctgaagtgctgtcggccgacgcgttcgcggcgttcgaggaagcgggcgcggggaaagggacgttgctggaccgtgaaacgggggaacgcttctggcgcgaaatcctcgctgtcggaggcagccgcccggcgctcgaatcattcaaggctttccgcggccgcgaaccgcgcgtcgatgcgctgctgcggcacaacggcatggtgagcgcatga

SEQ ID NO: 98165 - protein, 685 aa, Azoarcus sp. EbN1
MPNPLLDFSALPRFDDIRPEHVAPAIRQLIDENRALIAELVADPAPPTWANFVTPMTEEGERLGRAWGIVGHLHSVMDVPEWREAYNAMLPEVSSFYAEVGQNLELFEKYRLLHDSAEYDMLSPARQRIIDHELRDFRLSGAELPDADKPRFKEIQEEQSALAAKFSENLLDATNAHTEWIEDEAELAGLPDDAIAAARAAAERDGKPGWKFTLQMPAYLPVMQYADNRELRARMYRAYATRASEQGRPELDNGPLIGRILALRAEEAKMLGYRNFAEVSLVPKMAETPDEVLAFLRELATKAKPFAERDLAELQAFARTELGLDPLEPWDIGYASEKLRQARYAFSDQEVKQYFPEPKVLEGLFGVIRTLYGVDIVADNAPLWDAGAHFFRIDRDGATLGHFYLDLHARKTKRGGAWMDSARSRYVGPRGTQTPVAYLVCNFPGPVGGKPPTFTHDDVLTLFHECGHGLHHLLTQIDDLAVSGIHGVEWDAVELPSQFMENFCWEWDVLCGMTSHVDTGAPLPRELFDKMIAAKNFQSGMQTVRQLEFSMFDLRLHSEVDASAGPVPVERVMELLDEVRREVAVMIPPPWHRFPHSFSHIFAGGYGAGYYSYKWAEVLSADAFAAFEEAGAGKGTLLDRETGERFWREILAVGGSRPALESFKAFRGREPRVDALLRHNGMVSA

SEQ ID NO: 98166 - DNA, 2016 bp, Silicibacter pomeroyi DSS-3
  CDS (1)..(2016): transl_table=11
atgaccaatcccatccttgccgactggcagaccccgttcgacatcgccccgttcgaccggatcgcagacagcgatttcgccccggcgctggaggtggcgctggccgaacaccgggccgagatcgccgccatcgccgacagccccgaggcgccgacctttgccaatgtgatcgaggcgctcgaggcggcaggcggcgcgctggaccgggtgctgggcgtgttctttaccgtggcgggtgcggacagcaatccggcgcgcgaagaattgcagcgcgcgttctcgccccagctggcggcgcatttttccgagatttcggccaacaaggcgctgttcgcccgcgtcgccgccgtgtgggaggcgcgcgcggatctcgaactgagcgacgaacagcagcgggtgctgatgctgacccatcgtggctttgtccgtgcgggcgcggcgctcagcggtgaggctgaagcgcggatgaaagagatcaaggcgcgactggcggtgctgggtaccgaattcacccagaacctgctggcggacgagcgcgactggttcatggacctgtccgaggacgatctggaggggctgcctgatttcgtcaccgccgccgcccgcgcggcggggcaagaaaaagaggccgcaggcccggtggtgaccctgtcgcgctcgctgatcgtgccgttcctgcaattctcgccgcgccgcgatctgcgtgagcgggcctatcgcgcctgggtggcgcgtggggccaatggcggcaagaccgacaaccgcgccatcgcgaccgagaccctgaccctgcgccaggagcgcgcggcgctattgggctatgacagtttcgccgcatacaagctggaaaccgagatggcgcgtagccccgaccgggtgcgcgatctcttgatgcaggtctgggcacccgcccgcgcgcgggccgaggcggatgccgaggtgctgacggcgatgatgcaggaggacgggatcaacggcccgctggaaccctgggactggcactattacgcggcacggcggcgcaaggccgagcatgatctggatgaagcggcgctgaaaccctatctgcagctcgaccgcatgatcgaggcgtcctttgcctgtgccaaccgcctgttcgggctggagttccgcccgctcgacatcgcgctctatcaccccgattgccgggcctgggaggtgacacgggatggtcggcatgtggccgtctttatcggcgactatttcgcgcgcggctcgaaacgctcgggcgcctggtgctcggcgatgcgggcgcaggcgaagttcccgcgcacccaggcgccggtggtgatcaacgtctgcaacttcgccaagggcgatccggcgctgctgagctatgatgacgcgcgcactctgtttcatgaattcggccacgcgctgcaccagatgctgtcggatgtgacctatgaaagcgtgtcgggcacatcggtcgcgcgcgatttcgtggaactgcccagccagctttacgagcattggctggaggtgcccgaggtgctggccgagttcgccacccatgccgagaccggtgcgccgatgcccgccgagatgctggaaaaggtgttgggcgcggccaattttgaccaagggttccagacggtggaatatgtcgcctcggccctggtggacctggcgtttcacgacggcccggcgccgtctgatccgatggcgaaacaggccgaggtgctggcggagctggggatgccccatgccatcggcatgcggcacgccaccccgcatttcgcgcatgtctttgccggtgatggctatagctcgggctattacagctatatgtggtccgaggtgatggatgccgacgcctttgccgcgttcgaggaggcgggcggtgcctttgacccggaccgggccgaagcgctggagcggcatatcctgtcgacaggcgggtcgcgcgatgccgaggacctctatctggccttccggggccgcttgccgggggtcgaggccctgctcaaaggccgcggattgatcgcggcctga

SEQ ID NO: 98167 - protein, 671 aa, Silicibacter pomeroyi DSS-3
MTNPILADWQTPFDIAPFDRIADSDFAPALEVALAEHRAEIAAIADSPEAPTFANVIEALEAAGGALDRVLGVFFTVAGADSNPAREELQRAFSPQLAAHFSEISANKALFARVAAVWEARADLELSDEQQRVLMLTHRGFVRAGAALSGEAEARMKEIKARLAVLGTEFTQNLLADERDWFMDLSEDDLEGLPDFVTAAARAAGQEKEAAGPVVTLSRSLIVPFLQFSPRRDLRERAYRAWVARGANGGKTDNRAIATETLTLRQERAALLGYDSFAAYKLETEMARSPDRVRDLLMQVWAPARARAEADAEVLTAMMQEDGINGPLEPWDWHYYAARRRKAEHDLDEAALKPYLQLDRMIEASFACANRLFGLEFRPLDIALYHPDCRAWEVTRDGRHVAVFIGDYFARGSKRSGAWCSAMRAQAKFPRTQAPVVINVCNFAKGDPALLSYDDARTLFHEFGHALHQMLSDVTYESVSGTSVARDFVELPSQLYEHWLEVPEVLAEFATHAETGAPMPAEMLEKVLGAANFDQGFQTVEYVASALVDLAFHDGPAPSDPMAKQAEVLAELGMPHAIGMRHATPHFAHVFAGDGYSSGYYSYMWSEVMDADAFAAFEEAGGAFDPDRAEALERHILSTGGSRDAEDLYLAFRGRLPGVEALLKGRGLIAA

SEQ ID NO: 98168 - DNA, 2022 bp, Francisella tularensis subsp. tularensis Schu 4
  CDS (1)..(2022): transl_table=11
atgaattcgataattgaagactctaaattacctaaacttgcagaatttaaagtaaacgaagtaaagcctgctatagataaactctttagcctagctcaaagcaaccttgaaaatgctctacaaactcaaaatcccaattggcagacgttactaaaactagaggaagatgacgagaaaataagtcaagctttttcaacaatctcacatatgaatgctgtttgtaattctaaagaactgcgcgaaagttatgaatatgcgatagctaaacttactgactactataccaaattaggacaaaataaagatttatatgacctctacaaacaaattcaaaaagataatttaactaatgaacaagctcaagcagtacgtaaagctattattggctttgagcaatcaggggtaaatcttgatgaagctaagagaaagagactacaacaaatctctcaagaacttgctcaactaagcactaaatttgaaaataatgttctagatgcaactatggattggctatatactaccgatgatgagaaagaactcaaaggtttatcacaacatactatagaatcagcaaaagctaaagccaatcaaaagaatatcgctgaaaaatatgctctaggtatagacatcccaacgtacttggcagtaatgcagcaagcagacaatcgaaaacttcgtgaaaaattctacaaagcatattgcacaaaagcgtcaaaagaagctgataataaaaattttgataatgatgaaaatattgaaaaaattctaaaattacgtattgaaaaatctcaaatacttggctttgataattatgctgaaaattctctctttacaaaaatggctgaaacaccagaacaagtcttagagctattaaataaactcctagaaaaatctttaccacaagctaaaaaagaacttaatgaattacgtagatttgcagaggatgctggccttgtcgatgcgctacaaccatgggatagcgcatactactctgagaaactcaaaaaagctaaattcgacttcacagaagaagaacttagagaatactttccattagaaaaagtacaagatggattatttaaaatactcaagcaaatctataatttagatgtaaaagaaaatactcaatatacaaaatatgtacccgaacaacagacatttgactttttcaaaaatgatcaatatgtcggtagtataatctgtgatttttttgctcgtgataacaaacgcggtggtgcatggatggatgattcacgtactgcttttaccacttctagtggttcaaaacaaaatccagtagcttatgtaaactgcaatttcctaccaccctcaaaagatggtgcaaatctaacccataatgatgttgtgacactatttcatgagtttggtcatgcattgcatcatatattatcacaagtaactattccttctatctccggtacaaatggtgttgagtgggatgctattgagttgccgagtcaatttatggagaatttctgttggtgtcaggaaggtctagcagttatatctggatcacgagatggtaaggtactcagtagcaaacagatagataagcttgtaggtactagacactttcattcagctctaatgatggttagacaacttgagtttggaatatttgatatgaatatccactataaaaaactaacatctgcaacagaagtacaaaaagagctagacagtattagagaaaaaattaatttaattaaaacaccaagttataataaattccaaaatggcttttcacatatttttgctggtggctatgctgcgggttactatagctataaatgggcagaaatcttatcttcagatgtattctcacgctttgagcaagaagggatacttagtcataaagttggtaatgagttgttagaaaatattatttctaaagggtcatcacgtgatgctatggataactttgtcgcatttatgggacgcaaaccaaacgaagatgcgctacttagacatagtggcattaactataagatttacatttaa

SEQ ID NO: 98169 - protein, 673 aa, Francisella tularensis subsp. tularensis Schu 4
MNSIIEDSKLPKLAEFKVNEVKPAIDKLFSLAQSNLENALQTQNPNWQTLLKLEEDDEKISQAFSTISHMNAVCNSKELRESYEYAIAKLTDYYTKLGQNKDLYDLYKQIQKDNLTNEQAQAVRKAIIGFEQSGVNLDEAKRKRLQQISQELAQLSTKFENNVLDATMDWLYTTDDEKELKGLSQHTIESAKAKANQKNIAEKYALGIDIPTYLAVMQQADNRKLREKFYKAYCTKASKEADNKNFDNDENIEKILKLRIEKSQILGFDNYAENSLFTKMAETPEQVLELLNKLLEKSLPQAKKELNELRRFAEDAGLVDALQPWDSAYYSEKLKKAKFDFTEEELREYFPLEKVQDGLFKILKQIYNLDVKENTQYTKYVPEQQTFDFFKNDQYVGSIICDFFARDNKRGGAWMDDSRTAFTTSSGSKQNPVAYVNCNFLPPSKDGANLTHNDVVTLFHEFGHALHHILSQVTIPSISGTNGVEWDAIELPSQFMENFCWCQEGLAVISGSRDGKVLSSKQIDKLVGTRHFHSALMMVRQLEFGIFDMNIHYKKLTSATEVQKELDSIREKINLIKTPSYNKFQNGFSHIFAGGYAAGYYSYKWAEILSSDVFSRFEQEGILSHKVGNELLENIISKGSSRDAMDNFVAFMGRKPNEDALLRHSGINYKIYI

SEQ ID NO: 98170 - DNA, 2028 bp, Synechococcus elongatus PCC 6301
  CDS (1)..(2028): transl_table=11
atggcaaaaaacatcattctttcagcaatcgtgggttatacctacgacaaaattgacctattcttaacttctgcactccgtaacacctcagcagatattcttttaattgcatcaagtccttcagcccaactccgtcatcagttattgagttcacctcgggtcaaactcgttgatgtgaaccttcaaggtgaaccagctgaaatggtatttcgccgtttctttattgccaaggagattttggcgagaatcgaagcagatgaaattctcttgagcgatgctcgcgatgtctatttccaatctgacccttttggtgtccaaggggttttatttgccgaggaacctcagctaatcgcaaactgtaaagtcaatagcagctggataaaaaaatacttaggagaggatgagtttcaagccatttctcctaatccaattctctgcgggggcaaccatgtgctggatgccaccaaggcctttagcctgacgttgaccacaccagaagaaattgttgggctgcccgagagtttgctggccttggcggctcaagctgctcaagccgctggtgaaacagaggcaacacccgaagccggcccttggcgaatcaccctcgacttcccaagctttggcccctttttgaaatatagtcagcggcgcgatctgcgcgagcaggtctatcgggcttacattcgccgcgccaccgaaggtgacctagacaaccggactctgattcagcagattttggagctgcgtcgccagaaggcacaactgttgggctttaacacctatgctgagctgagccttgctagcaagatggctccgtctgtggaagcggttgaagggctgctggaagaactgagagttgccagctgggatgccgcgatcgcagatttggaagccctcaaagcgtttgcccgtgagcaaggggcacctgaagccgacgatctcaaacagtgggatatcagcttttggtcggagcgactacgggaagctaagtttgccttcaatgccgaggaactgcgcccctacttccccctgccgcgagtactggaagggctatttggtctttgccaacgcctgtttgggattcagatcgaagcagcggatggccaagctccaatttggcagagcgatgttcgctacttccaagttaagaacgaacagggagaagcgatcgcggctttttacctcgatccctacacccgtccccccgaaaaacgggggggcgcttggatggatgactgcttggggcgggcgcgtttccaactgggcgatcgcagcatcagtcgcaatcccgttgcctatttaatctgtaaccagacaccgcccgtgggtgagcaacccagcctgatgacttttggagaagtggaaacgctcttccatgaatttggtcacggcttgcagcacatgctgacgaccgtcgaccatcccggttgctccggtattaataatgtcgagtgggatgcggtggagctgcccagccagttcatggagaactggtgttacgacagagccacgctgttcggcatggcgcgtcactggcaaaccggcgaaccgctaccggaggcttactacgaaaaactactggcggcccgtaccttcatggcgggttctggaatgctgcgccagatcaacttcagcctgctggatctagagcttcaccatcgcttcgatccgcaaggaacagagacagtcgaagcggttcgcgatcgcattgcggccaagacttcggtactggcgccgctccccgatgatgcgttcctctgctcctttggacatatctttgccggcggctatgcggcgggttactacagctataagtgggcagaagtgctgagtgcggatgctttttctgcttttgaagaagtagaccttagcaatgaagcagccgtgcaaagcttaggtcgccgcttccgcgatacggtgctggcccaaggtggtagccaacatccgctcaccgtatttgtcgacttccgaggtcgcgaaccggccactgaaccgttgctgcgccacagtggtctccaagccgcttag

SEQ ID NO: 98171 - protein, 675 aa, Synechococcus elongatus PCC 6301
MAKNIILSAIVGYTYDKIDLFLTSALRNTSADILLIASSPSAQLRHQLLSSPRVKLVDVNLQGEPAEMVFRRFFIAKEILARIEADEILLSDARDVYFQSDPFGVQGVLFAEEPQLIANCKVNSSWIKKYLGEDEFQAISPNPILCGGNHVLDATKAFSLTLTTPEEIVGLPESLLALAAQAAQAAGETEATPEAGPWRITLDFPSFGPFLKYSQRRDLREQVYRAYIRRATEGDLDNRTLIQQILELRRQKAQLLGFNTYAELSLASKMAPSVEAVEGLLEELRVASWDAAIADLEALKAFAREQGAPEADDLKQWDISFWSERLREAKFAFNAEELRPYFPLPRVLEGLFGLCQRLFGIQIEAADGQAPIWQSDVRYFQVKNEQGEAIAAFYLDPYTRPPEKRGGAWMDDCLGRARFQLGDRSISRNPVAYLICNQTPPVGEQPSLMTFGEVETLFHEFGHGLQHMLTTVDHPGCSGINNVEWDAVELPSQFMENWCYDRATLFGMARHWQTGEPLPEAYYEKLLAARTFMAGSGMLRQINFSLLDLELHHRFDPQGTETVEAVRDRIAAKTSVLAPLPDDAFLCSFGHIFAGGYAAGYYSYKWAEVLSADAFSAFEEVDLSNEAAVQSLGRRFRDTVLAQGGSQHPLTVFVDFRGREPATEPLLRHSGLQAA

SEQ ID NO: 98172 - DNA, 2127 bp, Gluconobacter oxydans 621H
  CDS (1)..(2127): transl_table=11
atggctttcaatttcaggcttgccgcagttcttgcggtttcggcattttccctttccgttgaggcgcatgccgcttctacgaacccgttcttttcggcaagcacgctgccctatcaggccccccgtttcgaccagatcacggacagcgactacgctccggccttcgagcgcggaatggctgagcatctgcgcgagatcaaggcgattgccaacaaccgcgcagcgccgacgttcgataacaccattgccgccatggaacgcgcgggccagacgctcaaccgcgtgcaaatgacgttctatggtgtctaccaggccaacaccgatgatacgctggacaaggtgcagagccaggaagcgccccggctgaccgcccatgaagatgaagtctatctgaacgcaaagctcttcgcccgcgtgaagtccctttatgaccggcgcgaaaagctcaacctgacgcccgaacaggcgcagctcctcgacatctattaccagcagttcgtccatgccggcgcccagctctcggcagcggacaagacgaagctgcgtgcgatcaacacgcgcctttccaatcttgaaacccagtacgaacagaagctgattgccagcgccaagaacggcgccctcatcgtggacagcaaaaaggcgctggccggtctggatgacaacacgatcgcctcggctgccaaggccgcgcaggagcgcggactgaccgggaaatgggtcatcccccttcagaacacgacgcagcagccggccctctcttccctgacggaccgcgagacccgtcaggccctgttcgagcagagctggacccgtgccgagaagggcgacgagaacgacacccgcgccacgatcgccgaactggcagaactccgcgcgcagaaggccgcgctcttcggctatccgaatttcgccgcctatacgttgtacgatcagatggccaagacgccggaagctgcggaaaacttcatgcagcagctcgttccggccacggttgccgaacagaagcgggaagccgaggttcttcagaaagccatccgcaaggacggcgggaagttcgatctgaagccctgggactggaagcattattccgatcaggtgcgtcgcgcgaagtacaatctcgatcaggatgaaatcaagccgtatttcgagctcaaaacggtcctgacagatggcgtgttctttgccgccaaccagctttacgggatcacgttccagcagcggacggatatccccgtctatcagcctgacgtcatggtttttgaagtccacgacaaggacggctctccgctgggcctgatgtatttcgattacttcaagcgggacaacaagtccggcggtgcgtggatgtccaatttcgtcgggcagtccaagctgcttgggacgaagcccgtcatctacaacgtcgccaacttcaccaaggcagcccccggccagccgcagctgatcacgtctgacgatgtgacgaccatgttccacgaattcggccatgccctgcacgggctgttcgcggaccagacctatccgtcgctgtctggcacgagtgtggcgcgtgacttcgtggagttcccctcgcagttcaacgagaactgggcgctggatccgaaggtgctgtcgcattacgcccggcactacaagaccggcgctccgatgcccaaggctctggtcgagaagatccgcaaggccgcacatttcaatcagggctatgcgctgggcgagatcgtggccgcagccgagctggacatgaaatggcacagcctgcccgcgacggcaccgcggcaggacgtggacaagtttgaaagcgatgcgctgaacagcacggggctggacgtcgcagccgttccgccgcgttatcgttccagctacttcctgcatatctggtccaacggatattccgccggctattacgcctatctgtggacggaaatgctggatcaggacgtgttctcctggttccaggagcatggtggtctgacacgtgaaaacggacagcgcttccgtgacatgatcctctcgaagggacacaccatggattacggcccgatgttccgcgccttctacggccgcgacccggacatcaccccgatgctggtgcatcgtgggcttgtttccgaacagggcaaataa

SEQ ID NO: 98173 - protein, 708 aa, Gluconobacter oxydans 621H
MAFNFRLAAVLAVSAFSLSVEAHAASTNPFFSASTLPYQAPRFDQITDSDYAPAFERGMAEHLREIKAIANNRAAPTFDNTIAAMERAGQTLNRVQMTFYGVYQANTDDTLDKVQSQEAPRLTAHEDEVYLNAKLFARVKSLYDRREKLNLTPEQAQLLDIYYQQFVHAGAQLSAADKTKLRAINTRLSNLETQYEQKLIASAKNGALIVDSKKALAGLDDNTIASAAKAAQERGLTGKWVIPLQNTTQQPALSSLTDRETRQALFEQSWTRAEKGDENDTRATIAELAELRAQKAALFGYPNFAAYTLYDQMAKTPEAAENFMQQLVPATVAEQKREAEVLQKAIRKDGGKFDLKPWDWKHYSDQVRRAKYNLDQDEIKPYFELKTVLTDGVFFAANQLYGITFQQRTDIPVYQPDVMVFEVHDKDGSPLGLMYFDYFKRDNKSGGAWMSNFVGQSKLLGTKPVIYNVANFTKAAPGQPQLITSDDVTTMFHEFGHALHGLFADQTYPSLSGTSVARDFVEFPSQFNENWALDPKVLSHYARHYKTGAPMPKALVEKIRKAAHFNQGYALGEIVAAAELDMKWHSLPATAPRQDVDKFESDALNSTGLDVAAVPPRYRSSYFLHIWSNGYSAGYYAYLWTEMLDQDVFSWFQEHGGLTRENGQRFRDMILSKGHTMDYGPMFRAFYGRDPDITPMLVHRGLVSEQGK

SEQ ID NO: 98174 - DNA, 2169 bp, Xanthomonas oryzae pv. oryzae KACC10331
  CDS (1)..(2169): transl_table=11
atgtcgcgtaccgtcgttctcgccgcagccatcaccctggcactggctgcttgttctggaaaagagtcgtccggccaggagtccaccaccgtgcccgagaaaaccaccccggccccggccgcagatgctgcatcgaaccccttgctgaccgccagcacgctgccgttccaggcgccgccgttcgacaagatcaaggatgccgattacctgccggcgttcgaagagggcatgcgcctgcatctggcggacatccgcaagattaccgataaccccgaagcgcccaccttcgacaacaccatcgaagcgatggagcgcggtggcgaaacgctcaggcgcgtgtcgcgcatcttcttcgggctggtgcaggccgataccagcgacgcacgtcagaaaatccaggaagagattgcgcccaagctggctgcgcatcaggacgagatcaatctcgatcccaaactcttcgcacgcgtcaaaaccatctacgaccagcgcgacacgttgaacctagacccggagcagaagcgtctggtcgagcgcgattaccagcaactggtgcgcgccggtgcgcagttgtccgatgccgacaaggacagcctgcgcaagctcaacgtggaagaaaccacgctctccacgcagttccatacccgcttggtcgccgcctcggccgccggtgcggtggtggtggacgacaaggccaagctcgatggcctgagcgaagccgacatcgctgccgcggccgatgccgccaaggcgcgcaagctcgacggcaaatatctgctcagcttgcagaacaccacgcagcagccggtgctggcgtcgctgaagaatcgcgagctgcgtgccgaggtgttgaaagcctctgaaacgcgcgcggaaaaaggcgatgccaacgacacccgccagaccatccagcgccttgcgcagctgcgtgcgcagaaggccaagttgctcggcttcgacaactacgccgcctacagactgggcgaccagatggccaagacgccggacgtcgcgcgcaagctgctgaccgacaccgtgcccgctgccactgccaaggcacgtcgcgaagcggccgagattcagaaggtcatcgacgcgcagaacggcggcttcaaactcgccgcctccgattgggacatctacgccgagcaggtgcgcaaggccaagtacgatctggacgaagcgcagatcaagccgtacttcgaactaaataatgtgctcaagaacggcgtgttctacgccgccacgcagctgtacggcatcacgttcaaggaacgcaccgacatcccgacctatcacgccgacatgaaggtgtatgaggtgttcgatgtggacggcacctcgatggcgttgttctacaccgactacttcaagcgcgacagcaagtccggtggcgcgtggatggacgtgttcgtcgagcaggacggccttaccggtgccaagccggtggtctataacgtgtgcaacttcaccaagccggccgccggccagccggcgttgctgagcttcgacgacgtcaccaccttgttccatgagttcggccatgcgctgcacggcatgttctccaaggtgaagtacccgtcgatctccggcaccagcacatcgcgcgacttcgtcgagttcccctcgcagttcaacgagcactgggcgtccgatccgaaggtgttcgccaactacgccaagcactaccagactggcgcgccgatgccggccgagctggtggaaaagatcaagaaggccaagaccttcaacagcggctacgccactaccgcatacctgtcggcggcgctgctggatctggcttggcacacccagccggccgatgcgccgctgcaggacgtgagcaagttcgaagccgacgccttgaagcacttcaaggtggatctggccgacgtgccgccgcgctaccgcagcagctatttcgaccatatctggggcggtggttattcggccgggtactacgcgtacttctggtcggaagtgctcgacgacgatgcgttcgagtggttcaaggaaaacggcggcctgacccgcaagaacggcgacaccttccgcgccaagatcctctcgcgcggcaacaccgtcgatctgaccacgctgtaccgcgacttccgcggcaaggatcccagcgtcaaggcgctgctggaaaaccgtggattgaccgaataa

SEQ ID NO: 98175 - protein, 722 aa, Xanthomonas oryzae pv. oryzae KACC10331
MSRTVVLAAAITLALAACSGKESSGQESTTVPEKTTPAPAADAASNPLLTASTLPFQAPPFDKIKDADYLPAFEEGMRLHLADIRKITDNPEAPTFDNTIEAMERGGETLRRVSRIFFGLVQADTSDARQKIQEEIAPKLAAHQDEINLDPKLFARVKTIYDQRDTLNLDPEQKRLVERDYQQLVRAGAQLSDADKDSLRKLNVEETTLSTQFHTRLVAASAAGAVVVDDKAKLDGLSEADIAAAADAAKARKLDGKYLLSLQNTTQQPVLASLKNRELRAEVLKASETRAEKGDANDTRQTIQRLAQLRAQKAKLLGFDNYAAYRLGDQMAKTPDVARKLLTDTVPAATAKARREAAEIQKVIDAQNGGFKLAASDWDIYAEQVRKAKYDLDEAQIKPYFELNNVLKNGVFYAATQLYGITFKERTDIPTYHADMKVYEVFDVDGTSMALFYTDYFKRDSKSGGAWMDVFVEQDGLTGAKPVVYNVCNFTKPAAGQPALLSFDDVTTLFHEFGHALHGMFSKVKYPSISGTSTSRDFVEFPSQFNEHWASDPKVFANYAKHYQTGAPMPAELVEKIKKAKTFNSGYATTAYLSAALLDLAWHTQPADAPLQDVSKFEADALKHFKVDLADVPPRYRSSYFDHIWGGGYSAGYYAYFWSEVLDDDAFEWFKENGGLTRKNGDTFRAKILSRGNTVDLTTLYRDFRGKDPSVKALLENRGLTE

SEQ ID NO: 98176 - DNA, 2112 bp, Xanthomonas oryzae pv. oryzae KACC10331
  CDS (1)..(2112): transl_table=11
atggcggcgatttgcctgctttgccttgtgcagcgctggaatgaccgccatatcgggcaatcatccagtccaccaccggagcgccccatgaccaacccgctgctcgatctgtccggactgccgtccttcgatgcgatccgccccgaacacgtgggcccggcgatcgaccaattgctcgccgaggccgaggcggcggtgaaggcagccgagcaggtcagcccggtgcgctgggacagcttcgtgacgccgctggacgatgccaccgagcggctgtggcgtgcgtgggcgcaggtggggcatctgcaggcggtggtcaacacgccggagctgcgcgaggcctacaacagcaatctgcccaaggtgagccgcttcggcagcgcgctgggtcagaatctggcgctgtatgcgcaatacaaggcgctggcgcaatcgccggaagccgcacacttcgatgaagcccgtcgcaaggtgctggaaaacgcgctgcgcgatttccgcctgggcggtgccgagctcgatgacgccgccaaggcgcggtttgcgcaaatccaggaagaactctcggcattggcggccaagtttttgcagaacgtgctcgacgccaccgatgcgtggtgttacctcaccgaagacgacacgcagttatcagggctgacggccgaagtgatcgctgcggcacgcgctgccgcagaacaggaccgcgtgccaggttggaaattcaccttgcagatgccgtgctatctgccggtgcaaaccgatgcggacagccgcgagttgcgcgcgctgttgtatcgcgccaatgccgagcgcgcgtccgaatttggcgatgccgcgctggacaacagcgccaacatcgatcgcattctggccttgcgcgccgagttggcacagctgctcggcttcgccagctacgcggactattccgtcgctaccaagatggcgcagagccccgatgaagtgatgggctttctgcgcgatctggccgtgcgtgccaagccgcacgcgcagcgtgaccgtgccgagctggaagcctttgcgcgcgacgaactcggtctgcacgacctgcatgcctgggacctggcgtacgcatcggaaaagctcaagcaggcgcgttacagcttctccgagcaggaggtgaaacagtacttcaccgagccgaaggtgctggccggcctgttcgatgtgatccacagcctgtacgggcttacggtcaagccggacagcgcgccggtgtggcatccggatgtgcggttttaccggctggaagatgcgcaaggcgccctggtcggccagttctatctggacctgtatgcgcgcgagggcaagcgcggtggcgcgtggatggacgactgccgcaatcgtcgcaccaccgccaacggggtgcagacgccgctggtgtatctggtgtgcaacttcggccgcggtagcggcaatgcaccggccaccttccgccacggcgaagtcaccacgctgttccatgagatgggccacggcctgcatcagttgctgacgcgtatcggcgagctgggtgtagcgggtatcaacggcgtggagtgggatgcagtcgagttgccgagccagttcatggaaaacttctgctgggaatgggagcgcgtgcaggcaatgaccgcacacgtgcagaccggcgagccgctgccgcgcaacctgttcgatcgcctgctggcagcacgcaatttccagagcggcatgttcaccgtgcgccagctggaattcgccttgttcgatatgcagctgcacagcaacttcgacccgagccgagacagcttgctgcaactcatcgagcgcgtgcgtgacgaagtggcggtcaatcggccgccggcctggaatcgcttcccgcatcagttcagccacatcttcgcaggcggctacgcagccggctattacagctacaaatgggccgaagtgctcagtgccgatgcctatgctgcgttcgaagaggcgccggagcaggtagctgacactggcgcacgtttccgccatgaagtgttgtcgcgcggcggcagccgcagcgcggctgacaatttccgtgctttccgtgggcgcgcgccaagtatcgatgcgttgctgcgccacagtggcatggccggctga

SEQ ID NO: 98177 - protein, 703 aa, Xanthomonas oryzae pv. oryzae KACC10331
MAAICLLCLVQRWNDRHIGQSSSPPPERPMTNPLLDLSGLPSFDAIRPEHVGPAIDQLLAEAEAAVKAAEQVSPVRWDSFVTPLDDATERLWRAWAQVGHLQAVVNTPELREAYNSNLPKVSRFGSALGQNLALYAQYKALAQSPEAAHFDEARRKVLENALRDFRLGGAELDDAAKARFAQIQEELSALAAKFLQNVLDATDAWCYLTEDDTQLSGLTAEVIAAARAAAEQDRVPGWKFTLQMPCYLPVQTDADSRELRALLYRANAERASEFGDAALDNSANIDRILALRAELAQLLGFASYADYSVATKMAQSPDEVMGFLRDLAVRAKPHAQRDRAELEAFARDELGLHDLHAWDLAYASEKLKQARYSFSEQEVKQYFTEPKVLAGLFDVIHSLYGLTVKPDSAPVWHPDVRFYRLEDAQGALVGQFYLDLYAREGKRGGAWMDDCRNRRTTANGVQTPLVYLVCNFGRGSGNAPATFRHGEVTTLFHEMGHGLHQLLTRIGELGVAGINGVEWDAVELPSQFMENFCWEWERVQAMTAHVQTGEPLPRNLFDRLLAARNFQSGMFTVRQLEFALFDMQLHSNFDPSRDSLLQLIERVRDEVAVNRPPAWNRFPHQFSHIFAGGYAAGYYSYKWAEVLSADAYAAFEEAPEQVADTGARFRHEVLSRGGSRSAADNFRAFRGRAPSIDALLRHSGMAG

SEQ ID NO: 98178 - DNA, 2037 bp, Neisseria gonorrhoeae FA 1090
  CDS (1)..(2037): transl_table=11
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccacagcggcttcgacaacgcggcttga

SEQ ID NO: 98179 - protein, 678 aa, Neisseria gonorrhoeae FA 1090
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRHSGFDNAA

SEQ ID NO: 98180 - DNA, 2019 bp, Rhodobacter sphaeroides 2.4.1
  CDS (1)..(2019)
atgcccaacccgttgctcgccccctggaccacgccctttgccctgccgcccttcgccgagatccgcgacgaccagttcggtcccgccatcgaggcgggactcgcggaggcgcgccgggcgatcgcggccatcgcggacaatcccgaagcgcccaccttcgccaatacgatcgaggcgctggagctgtccgaggagacgctcgaccgggtggcgggggtgttctacaacctcgccggcgccgacagcaacgcggcgcgcgaggcgctgcagcgcgagcttgcgccgaagatgtcggccttttcctccgagatcgtgaacaaccgcccgctcttccggcggatcgagacgctctggcaggggcgggaggctctgggcctttcgcccgagcaggagcgggtgctgatgctctaccggcggatgttcgtgcgctcgggcgccgagctggagggggccgaggccgagaagttgacagctgtcaaggcgcagctcgcggtgctgggcaccaccttctcgcagaacctgctggccgatgagcgcgactggacgatggcgctcgccgaggaggatctggaggggctgcccgatttcgtggtcgagacggcgcgggcggcgggtgccgagcgcggcgccggagggccgattgtcacgctcaaccgctcgctgatcgtgcccttcctgcagttctcgccgcggcgcgagctgcggcggcgggcttacgaggcctgggtggcgcggggggcgaacggcaatgcctccgacaaccgggcggtcgcggcggagatccttgcgctgcggtcggagcgggcgcagcttctgggctacccggactttgcctcctacaagctcgagaccgagatggccaagacgccggaggcggtgcgcgagttgctgctgcgggtctggacgcccgccaaggcccgcgccgaggcggaccgggcggtgctcgaggccatgatgcaccgcgacggaatcaacggcgatctcgagccctgggactggcgctattattccgagaagcgccgcgcggccgagttcgatctcgatgaggcggcgctgaagccctacctgccgctcgagcggatgatcgaggcggccttcgactgcgcacggcgcctgttcgggctggagttccggccgctcgacgtgccgctctatcacccggacgtgcgcgcctgggacgtcacgcgcgaggggcggcacatggcggtgttcctcggcgactattttgcgcggtcctcgaaacggtcgggcgcctggtgttcgaccatgcgcgggcagcgcaggctcggcggcgaggtgcggccgatcgtggtcaatgtctgcaacttcgccaagggtgagcccgcgcttctgtcctgggacgatgcgcggacgctgttccacgagttcggccatgcgctgcatcagatgctgtcggacgtgacctacggcttcatctcgggcacgtcggttgcgcgcgacttcgtggagctgccgagccagctctacgagcactggctcgaggtgccggaggtgctggaggcccatgcgcggcactggcagaccggggcgccgatgccggccgagatgcgcgagcggctgctcgcggcctcgacctacgatcagggctttgccacggtcgaattcatctcgtcggcgatggtggatctggccttccacgagggcgcgcccccggccgatccgatggcgaagcaggcggaggtgctggcggggctcgggatgccgaaggcgatccggatgcgccatgccacgccgcatttcgcgcatgtcttctctggcgacggctattccgcgggctattacagttacatgtggtccgaggtgatggatgcggacgcgttcgcggccttcgaggaagcgggcggggccttcgatcccgagatggcgcgcaagctcgagcggcatgtgctctcggccggcggatcggaggaggcggaggcgctctataccgcgttccgcggccggatgccgggggtggaggcgctgctgcggggcagggggctgctcgacgccgcgtga

SEQ ID NO: 98181 - protein, 672 aa, Rhodobacter sphaeroides 2.4.1
MPNPLLAPWTTPFALPPFAEIRDDQFGPAIEAGLAEARRAIAAIADNPEAPTFANTIEALELSEETLDRVAGVFYNLAGADSNAAREALQRELAPKMSAFSSEIVNNRPLFRRIETLWQGREALGLSPEQERVLMLYRRMFVRSGAELEGAEAEKLTAVKAQLAVLGTTFSQNLLADERDWTMALAEEDLEGLPDFVVETARAAGAERGAGGPIVTLNRSLIVPFLQFSPRRELRRRAYEAWVARGANGNASDNRAVAAEILALRSERAQLLGYPDFASYKLETEMAKTPEAVRELLLRVWTPAKARAEADRAVLEAMMHRDGINGDLEPWDWRYYSEKRRAAEFDLDEAALKPYLPLERMIEAAFDCARRLFGLEFRPLDVPLYHPDVRAWDVTREGRHMAVFLGDYFARSSKRSGAWCSTMRGQRRLGGEVRPIVVNVCNFAKGEPALLSWDDARTLFHEFGHALHQMLSDVTYGFISGTSVARDFVELPSQLYEHWLEVPEVLEAHARHWQTGAPMPAEMRERLLAASTYDQGFATVEFISSAMVDLAFHEGAPPADPMAKQAEVLAGLGMPKAIRMRHATPHFAHVFSGDGYSAGYYSYMWSEVMDADAFAAFEEAGGAFDPEMARKLERHVLSAGGSEEAEALYTAFRGRMPGVEALLRGRGLLDAA

SEQ ID NO: 98182 - DNA, 1842 bp, Xylella fastidiosa Dixon
  CDS (1)..(1842)
atgatctcgcgtaccgccattttggctgctgccattagtctatcgcttgctggttgttcttccaaagaatcttccgcaatgcctgagaaaactacaaccacacctcaagtgccagttactaccagcaatccactgttaacggccagttccttaccgttccaagcgccaccgttcgataaaattaaggacagcgattatttacccgcgttcgaggagggaatgaagcaacatctggctgaaatcaccaagattgctgagaatcccgatgcaccaaccttcgaaaacactatcgaaatgctggagcacagcggcacaaccttggatagggtctcacgaatctttttcggtctagtacatgctgacaccaatgatacgcgccaaaagattcaggaagaaatcgcgcctaagctggctgcacaccaggatgagatttatttgaatcccaagctgttcactcggatcaagtcaatttacgatcagcgtgacacgcttagtttggacccattacagaaacgtttggtcgaacgtgattatgaaggattcgtacatgccggcgctcagttgcctgaagcagataaaacaactttacgtaaaatcaacgtagaagagagcacgctgtccacacagtttcacgctaagctggtcgccgccacagcggcaagtgcaattgtggttgatgaaaaaaataaacttgatggactgagcgagggcgacattgctgcagcagcggaggctgccaaggcgcgtaagctcaatgacaagtacgtactcgcattacaaaataccactcaacaacctatatcagcttcgctgaaggatcgtgagttacgtgctcaggtgttacaagcttcagaaactagggccgaaaaaggtgacgctaacgatacccgccaaatcgtgcagcgcctgactcagttacgtgcacaaaaagccaagttactcggtttcccaaactatgccgcttataacttggcagatcagatggcaaagacccctgaagcagcgttaaaactactcaacgataccgtgcctgcggctactgcgaaagcacgtaaagaggctgccgaaattcaaaaattgattgataagcaacgtgtcaatactaaagcgaatcactttgaattggttgcctctgactgggatttctatgcggagcaggtgcgcaaagccaagtacaatttggatgaagagcaaatcaaaccgtattttgagctcgacaacgtgctgcaaaacggtgttttctacgccgccaatcagctatacgggatcacttttaaggagcgcaaagatataccaacttaccatccggacatgaaggtttacgaggtgtttgaccatgacggcagctcgttggcactgttctacactgattactttaaacgtgacagtaaatccggtggtgcgtggatggatgtgttcgttgaacaaaatgcgatcaccgggaccaaacccgtggtctacaacgtctgcaactttactaagcctgcgcctggccagccggcactattgagcttcaaagacgtgaccatcctcttccacgagtttggccatgcgttacacgggatgttttcgaaagtgaagtatccttcgttggcaggcacctcaacatcacgcgattttgttgaattcccgtcgcaattcaacgaacactgggcctctgatccaaaggtgttttcacattatgccaagcactaccaaaccggtgagtccatgccgcagagtttggtggacagtattcgcaaggcaaaacactttcaaccagggttacgtaactaccgagtacctttcagccgcacttctagacttggcttggcataccttaccagccgatggcgccactag

SEQ ID NO: 98183 - protein, 613 aa, Xylella fastidiosa Dixon
MISRTAILAAAISLSLAGCSSKESSAMPEKTTTTPQVPVTTSNPLLTASSLPFQAPPFDKIKDSDYLPAFEEGMKQHLAEITKIAENPDAPTFENTIEMLEHSGTTLDRVSRIFFGLVHADTNDTRQKIQEEIAPKLAAHQDEIYLNPKLFTRIKSIYDQRDTLSLDPLQKRLVERDYEGFVHAGAQLPEADKTTLRKINVEESTLSTQFHAKLVAATAASAIVVDEKNKLDGLSEGDIAAAAEAAKARKLNDKYVLALQNTTQQPISASLKDRELRAQVLQASETRAEKGDANDTRQIVQRLTQLRAQKAKLLGFPNYAAYNLADQMAKTPEAALKLLNDTVPAATAKARKEAAEIQKLIDKQRVNTKANHFELVASDWDFYAEQVRKAKYNLDEEQIKPYFELDNVLQNGVFYAANQLYGITFKERKDIPTYHPDMKVYEVFDHDGSSLALFYTDYFKRDSKSGGAWMDVFVEQNAITGTKPVVYNVCNFTKPAPGQPALLSFKDVTILFHEFGHALHGMFSKVKYPSLAGTSTSRDFVEFPSQFNEHWASDPKVFSHYAKHYQTGESMPQSLVDSIRKAKHFQPGLRNYRVPFSRTSRLGLAYLTSRWRH

SEQ ID NO: 98184 - DNA, 2025 bp, Xylella fastidiosa Ann-1
  CDS (1)..(2025)
atgagtaacccactcctcgatttctcagaccttcctcgcttcgacgcgattctccctgaacacgttggcccggccattgagcagttgctcgcagaggcggaggcagccgtcgcccacgcggaacaggtaacgcctgtgacatgggagaacttcgtagtaccgctggacgatgccaccgagcggttgtatcgcgcatggggccaggtggcgcatttggaggcggtggtcaacacgccggcgctgcgtgaggtgtataacgtcactctgccgaaagtcactcgattcagcagtacgctcggacagaacctggcgctgtatgcgcagtacaaagcattagcgtgtgcgccggaatgggaccgtgataacgcagtacggtgcaaggttgttgataacgctttgcgtgatttccgtctcggcggtgccgagctggatgccgccgggaaagtccgtctggcagagatcaagcaggagctgtcggcattgtctgcaacgttttcgcaaaatgtgcttgatgcaacagaggcatggtcctacaccaccgaagacgccgctgtgttatccggtctgccgacagagactgtcgctaccgcgcgggcggccgcagaaaagaagggggtatcaggctggacgttcacgttacagatgccctgctatctgtcggtccaaagcgatgctgacaaccgcgcgttacgagagcgctcatatcatgctagtgcgatacgggcttcggaatttggcgatgccgctttggataatagtccgcacattcatcagattctcacgctgcgttccgaattggcagcgctgcttggtttctcctgttacgcggcatactcggtcgcaaccaagatggcagaggatccggctgaggtactcagcttcctgcatgacttggcaggacgtgccaagccgcatgctcaacgtgatcgccgtgaactggaaacgttcgcacgcgaggtgctggggcttgagacgctggaagcctgggacattgcatatgccagtgagaagctcaaacaagcccgttacaatttctccgagcaggaagtaaagcagtatttcaccgaacccaaggtcctggctgggttgttcgaggtgatccgctccctgtatggactgcgaatcgaagaagacgccgcgccggtctggcatccagatgttcgcttctaccgtctcattgatacgaatgggcaacgcgtcggccagttttatctggatctgtatgcacgggagggcaagcgcggcggggcatggatggatgattgccgtaaccgccgtgacaaaggcaatggggtgcaaactccggtggtctatttggtgtgcaatttcggtcgtggtaacgacggtgtgctgcctacgttccgtcatcaggaggtcattactttatttcacgaaatgggccatgggctgcatcagttactgacccggattggggaactgggcgtggctggtattaatggtgtggaatgggatgcggtggagttgcccagtcagttcatggaaaacttttgctgggagtgggaacgcgttcaagccatgacggcacacgtggagaccggtgcaccgctgccacgcagtctgttcgatcggatggtctgcgcacgcaattttcagagcggaatgttcaccgtgcgccaacttgagttcgcgctattcgacatgctgctacatagtaacttcgatccagcacaggacagcgtactgggactgttagaacgcgtccgtgatgaagtggccgtcaaccggttaccggactggaatcgttttccgcaccagttcagacatatttttgctggtggttatgcagcgggatactacagttacaaatgggccgaagtcctcagcgcagacgcttatgctgcatttgaagaggctccggatcaatttgccgaaataggggcgcgctttctcgacgaaatcctaagtcgtggcggcagtcgcagcgcagcagagaatttccaggccttccgcaaacgcgcgcctcgcattgatgcgttactgaagcgcaacgggataacagaatag

SEQ ID NO: 98185 - protein, 674 aa, Xylella fastidiosa Ann-1
MSNPLLDFSDLPRFDAILPEHVGPAIEQLLAEAEAAVAHAEQVTPVTWENFVVPLDDATERLYRAWGQVAHLEAVVNTPALREVYNVTLPKVTRFSSTLGQNLALYAQYKALACAPEWDRDNAVRCKVVDNALRDFRLGGAELDAAGKVRLAEIKQELSALSATFSQNVLDATEAWSYTTEDAAVLSGLPTETVATARAAAEKKGVSGWTFTLQMPCYLSVQSDADNRALRERSYHASAIRASEFGDAALDNSPHIHQILTLRSELAALLGFSCYAAYSVATKMAEDPAEVLSFLHDLAGRAKPHAQRDRRELETFAREVLGLETLEAWDIAYASEKLKQARYNFSEQEVKQYFTEPKVLAGLFEVIRSLYGLRIEEDAAPVWHPDVRFYRLIDTNGQRVGQFYLDLYAREGKRGGAWMDDCRNRRDKGNGVQTPVVYLVCNFGRGNDGVLPTFRHQEVITLFHEMGHGLHQLLTRIGELGVAGINGVEWDAVELPSQFMENFCWEWERVQAMTAHVETGAPLPRSLFDRMVCARNFQSGMFTVRQLEFALFDMLLHSNFDPAQDSVLGLLERVRDEVAVNRLPDWNRFPHQFRHIFAGGYAAGYYSYKWAEVLSADAYAAFEEAPDQFAEIGARFLDEILSRGGSRSAAENFQAFRKRAPRIDALLKRNGITE

SEQ ID NO: 98186 - DNA, 2046 bp, Azotobacter vinelandii
  CDS (1)..(2046)
atgactgccagcaatcccctcctgcaagctttcgacctgccgccctattccgccatccgtccggaacacgtcgagccggccatcgaccggatcctcgccgacaaccgcgccgccatcgcgcagaccctcgccgatcaggccgacacgccgagctgggacggcctggtgctggcgctcgacgaactgggcgaacgcctcggccgggcctggagtccggtcagccatctcaatgcggtgtgcaacagccccgagctgcgcgccgcctacgaggcctgcctgcccaagctgtccgcctactggaccgagatgggccagaaccgcgccctctgcgacgcctacaaggccctggccgccagccccgcgaccgccggcttcgacgtggcgcagaagaccgtcctcgaacacaccctgcgcgacttccacctgtccggcatcgatctgccggaggagcagcagaagcgctacggcgagatccagatgcgtctgtccgagctgaccagccgcttctccaaccagttgctcgacgccacccaggcctggaccaagcacgtcaccgacgagtccgcgctggccggcctgaccgactcggccagggcgcagatggcccaggccgcccaggccaaggggctcgacggctggctgatcagcctggagttccccagctactacgcggtgatgacctacgccgacgaccgcgccctgcgcgaggagctctacgccgcctactgcacccgcgcctccgaccaggggccgaacgccgggcaattcgacaacggcccactgatggagcagatcctcgacctgcgccgcgaactggcccggttgctcggctacccgaactacgccgaactgtcgctggcgaccaagatggccgactccggcgagcaggtgctcggtttcctgcgcgatctggccgcgcgcagccggccgttcgccgagaaggacctggccgagctgcgcgccttcgccgccgaacagggctgcggcgatctgcagagctgggacgtgggctactacagcgagaagctgcgccaggcccgctacagcatttcccaggagcagttgcgcgcctacttcccgatcgacaaggtgctcggcggcctgttcgccatggtccagcgcctctacggcatcgagatccgcgagcttgcggatttcgatagctggcacccggacgtgcgcctgttcgagattcgcgagaacggcgagcacgtcgggcgcttcttcttcgacctctacgcgcgggccaacaagcgcggcggcgcctggatggacggcgcccgcgacaagcgccgcaacaccgccggcgagctggtcagcccggtggccaacctggtgtgcaatttcaccccggcggtgggcggcaagccggcgctgctcacccacgacgaagtcaccaccctgttccacgagttcggccacggcctgcaccacctgctgacgcgcatcgagcacgccggcgcctccggcatcagcggggtgccctgggacgcggtcgagctgcccagccagttcatggagaactggtgctgggagccggaaggcctggcgctgatctccggccactaccagaccggcgagcccctgccccaggacctgctggagaagatgctggcggcgaagaacttccagtccggcatgatgatggcgcgccaactggagttctcgctgttcgacttcgagctgcacgtccaccatggcgacgggcgcggcgtgctcgaggtgctcaagggcatccgcgacgaggtttcggtgatgcagccgccggcctacaaccgcttccccaacagcttctcgcacatcttcgccggcggctacgcggccggctactacagctacaagtgggcggaagtgctctccgccgacgccttctcccgcttcgaggaggacggcgtgttcaaccccgtcaccggccaggccttccgcgaggcgatcctggcccgtggcggctcgcaggaccccatggtgctgttcgtcgacttccgcggccgcgagccgtccatcgacgccctgctccgtcaccttggcctgagcgcggcggcctga

SEQ ID NO: 98187 - protein, 681 aa, Azotobacter vinelandii
MTASNPLLQAFDLPPYSAIRPEHVEPAIDRILADNRAAIAQTLADQADTPSWDGLVLALDELGERLGRAWSPVSHLNAVCNSPELRAAYEACLPKLSAYWTEMGQNRALCDAYKALAASPATAGFDVAQKTVLEHTLRDFHLSGIDLPEEQQKRYGEIQMRLSELTSRFSNQLLDATQAWTKHVTDESALAGLTDSARAQMAQAAQAKGLDGWLISLEFPSYYAVMTYADDRALREELYAAYCTRASDQGPNAGQFDNGPLMEQILDLRRELARLLGYPNYAELSLATKMADSGEQVLGFLRDLAARSRPFAEKDLAELRAFAAEQGCGDLQSWDVGYYSEKLRQARYSISQEQLRAYFPIDKVLGGLFAMVQRLYGIEIRELADFDSWHPDVRLFEIRENGEHVGRFFFDLYARANKRGGAWMDGARDKRRNTAGELVSPVANLVCNFTPAVGGKPALLTHDEVTTLFHEFGHGLHHLLTRIEHAGASGISGVPWDAVELPSQFMENWCWEPEGLALISGHYQTGEPLPQDLLEKMLAAKNFQSGMMMARQLEFSLFDFELHVHHGDGRGVLEVLKGIRDEVSVMQPPAYNRFPNSFSHIFAGGYAAGYYSYKWAEVLSADAFSRFEEDGVFNPVTGQAFREAILARGGSQDPMVLFVDFRGREPSIDALLRHLGLSAAA

SEQ ID NO: 98188 - DNA, 2112 bp, Nostoc punctiforme PCC 73102
  CDS (1)..(2112)
atgagtgcaagtaccattatttccgacaatcccctacttcaaggcgttggtttacctccctttgcagagattaaaccagaacgagtagtaccagccttcaatcagttgttggcagaactagaccagcagcttgccaccttagaagctagtgtacagcctacttggagtggtttagtagaacccttagaaaagctgacagaaaggcttacctggagttggggggtggtgaatcatttaatgggtgttaaaaatagcccggaactgcgcgaagctcatgaaatcgtacagccactagttgtacaatttatcaacaagctcggtcaaagtcaacctatctacaatgcttttaaagcactccgtaccagtgagaattgggcaactttagaattagctcaacagcgcattgtagaagccgccattcgagatgcagaactttctggtgttggcttagaaggagaggtaagagagcgtttcaacgccatacaaatggagttagcagaactttctaccaaattttctaaccatgtacttgatgccacgaaagccttcagcttaaccctaacaacacaagcggaaattgaaggtttaccaccaagcttagtgagtctagcagctcaagttgctcgtgcagcaggcgaaagtaacgccacaccagaaaatggcccttggcggattactttagacttccccagctatggccctttcatgcagcacagcacccggcgagatttgcgtgaaaagctctacaaagctcatatcacccgcgcttctactggcgatttagataacaaccccttaattgagcgcattttgaagttgcgccaagaactcgcagatatattaggctttaaaagttttgcccaattgagtctggctagtaaaatggctcctaatgttgaggcagtcaacgccctattagaagaactacgccatgctagttatgatgctgctgtcaaagacttggtagaactcaaagcttttgcagcagcacagggagcagcagaagctgaggatttaaaacactgggatatcagcttttgggcagaacgccaacgagaagcaaaatttgcctttactgctgaagaattgcgtccctacttcccgcttccccaagtgttagacggcttatttggattagtcaagcggctgtttggtgttactgtcacttctgccgatggtcaagccccagtctggcatgaggatgtgcgttatttccaaattgctgacgaaactggttctcccatagcctacttctacttagacccttacagccgtccagccgaaaaacgcggtggtgcttggatggatgtgtgcatcaatcgggccaaaatcactgaaaatggtgtcactgccatccgcttacctgtagcttatttggtgtgtaatcaaagtcctcctgtagatggtaaacctagtttgatgaccttctatgaagtagagactttgttccacgagtttggtcatggattgcaccatctgcttactaaggttaattatcccggagccgcaggcatcaataatgtggagtgggatgcagtggaactacctagtcagtttatggaaaactggtgctatgagcgaaccactttctttggaatggcgaagcattatgaaactggtgaagccttaccggagcattattatcaaaaactgctagcggcgcgtaattatatgagtggtactgctatgttgcggcagattcacctaagcagtcttgatttagaactacactaccgctatcaccctggtagtagtgaaactccatcagatgtgcgtcatcgcatagccaagactactaccgttttacagccacttccagaagatgcaattttatgtgcttttgggcatatttttgagggtggttatgcagcgggttactacagttacaagtgggctgaggtactgagtgctgatgcttttgccgcttttgaagaagctggtctagaagatgaagaggctataaaagctacaggtcggcgttatcgggatacggtactagcacttggtggtggtcagcatccaatggaggtgtttaaaactttccggggtcgtgaaccaagtacgatcgctttgctcaggcacaatggtttagtcagtgctgctgtaaactaa

SEQ ID NO: 98189 - protein, 703 aa, Nostoc punctiforme PCC 73102
MSASTIISDNPLLQGVGLPPFAEIKPERVVPAFNQLLAELDQQLATLEASVQPTWSGLVEPLEKLTERLTWSWGVVNHLMGVKNSPELREAHEIVQPLVVQFINKLGQSQPIYNAFKALRTSENWATLELAQQRIVEAAIRDAELSGVGLEGEVRERFNAIQMELAELSTKFSNHVLDATKAFSLTLTTQAEIEGLPPSLVSLAAQVARAAGESNATPENGPWRITLDFPSYGPFMQHSTRRDLREKLYKAHITRASTGDLDNNPLIERILKLRQELADILGFKSFAQLSLASKMAPNVEAVNALLEELRHASYDAAVKDLVELKAFAAAQGAAEAEDLKHWDISFWAERQREAKFAFTAEELRPYFPLPQVLDGLFGLVKRLFGVTVTSADGQAPVWHEDVRYFQIADETGSPIAYFYLDPYSRPAEKRGGAWMDVCINRAKITENGVTAIRLPVAYLVCNQSPPVDGKPSLMTFYEVETLFHEFGHGLHHLLTKVNYPGAAGINNVEWDAVELPSQFMENWCYERTTFFGMAKHYETGEALPEHYYQKLLAARNYMSGTAMLRQIHLSSLDLELHYRYHPGSSETPSDVRHRIAKTTTVLQPLPEDAILCAFGHIFEGGYAAGYYSYKWAEVLSADAFAAFEEAGLEDEEAIKATGRRYRDTVLALGGGQHPMEVFKTFRGREPSTIALLRHNGLVSAAVN

SEQ ID NO: 98190 - DNA, 2040 bp, Haemophilus somnus 129PT
  CDS (1)..(2040)
atgtctaatccactattaacccattcagaacttccacaattttcaaaaatcaagcctgaacatgttcaaccggcgattgagcaattaatccgagaaaatcgtgaaacagtagaacaactgttaaaacaaccgcactttacatgggagaattttattcaacccctaaacgataaagaggaaaaacttggtcgtgcttggtcgcctgtttctcatttaaatgcggtgaaaaacagtcctgaattgcgtgccgcttatcaagcttgtttaccgctgatttcagaatacagtacttggttagggcaacataaagggttatataatgcctatgtgcaactaaaaaatagtccggaatttacccaatatacggttgcacaaaagaaagcgatagaaaatgcgttgcgtgattttgaattatcgggtattgccttatcagaagataaacagcaaagatacggtgaaatcgttgctcgtttatctgaactaaacgctaaatttagtaataatgtccttgatgcaacaatgggatgggataaagtcgtcgaaaatgaacaagatctaattggcttgcctgaaagtgcattacaagcagcaaaacaatccgcacaatctaaagggcttgatggttatcgttttaccttggaattccctagttatttacccgtcatgacctattgtgaaaaccgagaactacgagaagaaatgtatcgagcttttgctactcgtgcttcagaactgggaccaaatgcaggaaaatgggataatacagatgttatgcaagaaattttgactttgcgtgtagaacttgctcatttgttaggctttaatacttatacagagctttcccttgcgaccaaaatggcggacactccacaacaagttattgatttcttggaaagtttagcaaaacgttcaaaaaatcaaggcgagaaagaattgaccgaattacaagaattttgccaaaaaaattacaatatcaccgcacttgaaccttgggatattagcttttatagcgaaaaacaaaaacagtatttatactcaattaatgatgaggaacttcgcccttattttccagaagatcaagttatttcaggtctatttgaattaattaaacgaattttcaatattcgagcagtagagcgttttgacgtagacacttggcacaaagatgtacgcttctttgatttaattgatgaaaaaaatgaagtgagaggaagtttctacttagatctttatgctcgagaaaataaacgtggcggtgcttggatggatgattgtattggacgaaaacgtaaagctgacggttcaattcaaaaacctgttgcatacctaacttgtaattttaatgctccgattggcgacaaacctgctttattcacccatgacgaagtcactaccctattccatgaatttggacatggtattcatcatatgctcacaaaaattgatgtcgctgatgttgccggaattaatggtgtaccttgggatgcagtagaattgccaagtcaatttttagaaaattggtgttgggaagaagaggcgttagcattcatctcaggacattatgaaaccggcaagccactaccaaaagaaaaattagatcaattactaaaagcgaaaaactttcaagcggcaatgtttgttttacgtcaattagaattcggtttatttgacttccgtttacaccattattttgaagctaataaaccaaatcaaatcttagcgaccttaaaacaggttaaatctgacgttgcggtgatcaaaggtgtggattgggcaagaacacctcacagctttagccatatttttgcaggcggatattctgccggatactacagctatctttgggctgaagttttatctgccgatgcttattctcgttttgaagaagaaggaattttcaatgctgaaacaggtcgttcatttttagaggaaattttaactcgtggcggctcggaagatccgatgactttatttaaacgctttagaggtcgtgaacctcaattagatgcactactgcgacataaaggtattgctaattag

SEQ ID NO: 98191 - protein, 679 aa, Haemophilus somnus 129PT
MSNPLLTHSELPQFSKIKPEHVQPAIEQLIRENRETVEQLLKQPHFTWENFIQPLNDKEEKLGRAWSPVSHLNAVKNSPELRAAYQACLPLISEYSTWLGQHKGLYNAYVQLKNSPEFTQYTVAQKKAIENALRDFELSGIALSEDKQQRYGEIVARLSELNAKFSNNVLDATMGWDKVVENEQDLIGLPESALQAAKQSAQSKGLDGYRFTLEFPSYLPVMTYCENRELREEMYRAFATRASELGPNAGKWDNTDVMQEILTLRVELAHLLGFNTYTELSLATKMADTPQQVIDFLESLAKRSKNQGEKELTELQEFCQKNYNITALEPWDISFYSEKQKQYLYSINDEELRPYFPEDQVISGLFELIKRIFNIRAVERFDVDTWHKDVRFFDLIDEKNEVRGSFYLDLYARENKRGGAWMDDCIGRKRKADGSIQKPVAYLTCNFNAPIGDKPALFTHDEVTTLFHEFGHGIHHMLTKIDVADVAGINGVPWDAVELPSQFLENWCWEEEALAFISGHYETGKPLPKEKLDQLLKAKNFQAAMFVLRQLEFGLFDFRLHHYFEANKPNQILATLKQVKSDVAVIKGVDWARTPHSFSHIFAGGYSAGYYSYLWAEVLSADAYSRFEEEGIFNAETGRSFLEEILTRGGSEDPMTLFKRFRGREPQLDALLRHKGIAN

SEQ ID NO: 98192 - DNA, 2034 bp, Actinobacillus pleuropneumoniae serovar 1 str. 4074
  CDS (1)..(2034)
atgtctaatcctcttttaaattacaccggtttacctgcattttcacaaattaaaccggaacatatccagcctgcggtagaagcagtaatcaaagaatgtcgtgataccattgaacaagttgcccgaattgaaaacccgacttgggaaaatttctatatgccgcaagcgattgccggcgataaatttgcgcgtgcgtggtcgcctgtcggtcatttaaacggcgtgaaaaactcaccggaattgcgtgaagcataccaagcctgcttgccgctactttctgaatacagcacttgggcgggacaacaccaaggtttgtatcaaggttatgtaaaactgaaaaactcaccggaattcgagagctattcgcttgcacagaaaaaagcgattgaaaacagcctacgtgattttgagctttcggggatttcattaccggcagataaacaaaaacgctatggcgaagtgtccgctcgtttatcggaactcagctcgcaattcagtaacaatgtattggatgcgaccatgggttgggatatcgtgatcacagacgaagcacagcttaaaggcttacctgaatccgctttagaagcggcaaaactttctgcggaaagcaaaggtcaaaaaggctatcgttttactttggagttcccaagttactatccggtactcacttactgcgaaaaccgtgaattacgtgcggcaatttataaagaatatgcaacacgtgcttctgaccaaggctcaaatgcaggaaaatgggataactcggcaaatattgatgaaaaactcaaattacgcttagaaatggcgcagttattagggtttgaaacttacgctgatctttctcttgctacgaaaatggcggaaaacccgcagcaagtggtggatttcttagaagatttagccaaacgatcaaaagcacaaggcgaaaaagaattagcggaattacacgcttttgtggaacaagaatacggcgtaaccgaacttcaaccgtgggatattgcattctatagcgaaaagcaaaaacaagcgttatatgcgatcaatgatgaagaacttcgcccttatttcccggaagatcgtgtactttcaggcttatttgaattaatgaaacgtattttcggcttacgtatcgaagaaaaattcggtattgatacttggcacgaagacgtgcgtttcttccaaatttacgatgagcaaaacgaagaacgcggtgcattctatttagatttatacgcacgtgaaaataaacgtggcggtgcatggatggacgattgtatcaaccaaaaacgtttagcggacggttcgttacaaaaaccggtagcatacttaacttgtaactttaataaaccgattggtgataagccggcactctttacgcatgacgaagtcactaccttattccatgagtttggtcacggtatccaccatatgctcactcaaattgatgtcggtgatgttgcgggtatcaacggtgtaccgtgggatgcagtggaattaccgagccaattcttagaaaactggtgttgggaagcggaagcgcttgaatttatctcgggacattatcaaaccggtgaatcgttaccgaaggataaattaactcagttactcaaggcgaaaaacttccaagccgccatgtttgtactaagacaattagaattcggtttattcgatttccgtttgcatttggcacagcctcgtgaaggtttggtattagatacgttaaaagtggtaaaagcggatgttgcggtggtacgcacacctgaatgggtacgcacgccacatagctttagccatatttttgccggcggttatgcagcaggttattacagctacttatgggcggaagtattatcggcggatgcctttgctaaatttgaagaagatggcattttcaaccgagcgaccggtcaatcttatttagataatattctgactcgcggcggttcggaagaaccgatggtattgtttgaacgcttccgcggtcgcaagccaaccttagacgctttattacgccataaaggtattgcgagctaa

SEQ ID NO: 98193 - protein, 677 aa, Actinobacillus pleuropneumoniae serovar 1 str. 4074
MSNPLLNYTGLPAFSQIKPEHIQPAVEAVIKECRDTIEQVARIENPTWENFYMPQAIAGDKFARAWSPVGHLNGVKNSPELREAYQACLPLLSEYSTWAGQHQGLYQGYVKLKNSPEFESYSLAQKKAIENSLRDFELSGISLPADKQKRYGEVSARLSELSSQFSNNVLDATMGWDIVITDEAQLKGLPESALEAAKLSAESKGQKGYRFTLEFPSYYPVLTYCENRELRAAIYKEYATRASDQGSNAGKWDNSANIDEKLKLRLEMAQLLGFETYADLSLATKMAENPQQVVDFLEDLAKRSKAQGEKELAELHAFVEQEYGVTELQPWDIAFYSEKQKQALYAINDEELRPYFPEDRVLSGLFELMKRIFGLRIEEKFGIDTWHEDVRFFQIYDEQNEERGAFYLDLYARENKRGGAWMDDCINQKRLADGSLQKPVAYLTCNFNKPIGDKPALFTHDEVTTLFHEFGHGIHHMLTQIDVGDVAGINGVPWDAVELPSQFLENWCWEAEALEFISGHYQTGESLPKDKLTQLLKAKNFQAAMFVLRQLEFGLFDFRLHLAQPREGLVLDTLKVVKADVAVVRTPEWVRTPHSFSHIFAGGYAAGYYSYLWAEVLSADAFAKFEEDGIFNRATGQSYLDNILTRGGSEEPMVLFERFRGRKPTLDALLRHKGIAS

SEQ ID NO: 98194 - DNA, 2226 bp, Psychrobacter sp. 273-4
  CDS (1)..(2226)
atgacttctatttcttcagagttacatcttgtcgattttgcagatcctgcgccaagtaccttacaacagcaagttattagcgccattgacgcggctaatgcatttttagatgaattaacggtgatgacagagaccaaggaagcgtctaccccgatagacgctgagcaagcgctaaccgatataaaagactttgaccatatcaacctagcactggatcgcagctggggaattttgtcgcatcttaatagcgtgatgagtaacgatgagattcgtcatgtccatcatgagctgctaccaaagctgtctgcctatggtacgcgagttgggcagcatcagccgctatttagccgttatcaagcgattatcaatgataaagcattctttgcaacgcttgagcctgctagagcacgagctattgagcttgcgctacgcagctttgagttatcaggggtcgcactacctaaaacagaacaagacaaatttgctaccattcaaagccagctgtctacgttgtcagccactttttcagaccatgtcttagatgctactcaagcttatgttttaccgcttaaacaagagcagttgacaggcttgaccgacagtggcttggcattagtagctgatgcaggtgagcagtacaaaacaaaccagcttgcaaatggttcgctcacgcaaacagaggttgatgcattgccaagcccgtattatgtggcaagcttaaatatgcctgtatatcttgccatcatgacccatgccgatgatcgccatctacgcgagacgttatatcgcgcctatgtcacccgcgcctctgagtttgatgagcataccaatgccaaaggagaatcgctcaataacgccgatatcatgagtcagattttgcagttacgtgagcaaaaagccaaattactgggttttaataactatgcagaagtatcgctatccaccaaaatggcagatagcgtggcggaagtggaaacctttttgcgtgatttagctgtgcaagcaacgccaactgctgagcaagatttggcacaattgcaaaagtacgcgcaagattacggtattaaagatttacagccgtgggacagtgcttatatcgccgaaaaggtaaaacaaagtgagtttagcttatcacaagaagaaattcgctcgtacttcccattaccaagagtgattagcgggttattcgctatcgttgagcgtttatacggtatcaaagtacaagagcaaagtaatgacagcgcaaataatagtacagacaaatcattagcatcacgttggcacgatgatgtccgtttttatcaattattcgatgctgatgacaatttgcttggtggtttctactttgatttatttgcccgtagtggtaaacgcggcggtgcttggatgagtggctttcagtcgcgttatagttataataagcaagatcatcagcagctaccagtgtgctttatggtgggcaactttaccccagcactcgatggtaagccaagcttattgactcatgatgaagttgtcaccttattccatgagttcggtcacggtttacatcatctgttgactcaagtaaccattggtgatgttgctggcgtcaatggcgtagaatgggacgccgtcgagctgccaagccagtttatggaaaactgggcatgggatgcggaaggtattgctcttattagcagtcatgtcgaaacgagcgcgcccttgcctaaagataagcttgatgcgctattggcagtcaaaaacttccaaagtggactacaaacgctccgtcaaatcgaatttgccttgtttgacttgttgattcatgcgcagacaccagtgcttgattataaaggtatcttgactacccttaacagcgtacgtgatgatattgccattgtgcagacgcctgattacaaccgctttgccaatggctttagtcacatctttgccggtggttatgccgctggttattactcatataaatgggcagagctgttatctgccgatgcctttagtaagtttgaagaagaaggtgtttttaaccctatcacaggtaaagccttccgtgagaccatcttgtccgttggtggtagttttccagctaaggtgaattttgagaacttccgtggtcgcagtgccagtattgaggctctgttacgtcatagcggttttgctgatactaacaaccagactaaaaacagtacggctgccaatgcccaaacaactcgtaaggtgatataa

SEQ ID NO: 98195 - protein, 741 aa, Psychrobacter sp. 273-4
MTSISSELHLVDFADPAPSTLQQQVISAIDAANAFLDELTVMTETKEASTPIDAEQALTDIKDFDHINLALDRSWGILSHLNSVMSNDEIRHVHHELLPKLSAYGTRVGQHQPLFSRYQAIINDKAFFATLEPARARAIELALRSFELSGVALPKTEQDKFATIQSQLSTLSATFSDHVLDATQAYVLPLKQEQLTGLTDSGLALVADAGEQYKTNQLANGSLTQTEVDALPSPYYVASLNMPVYLAIMTHADDRHLRETLYRAYVTRASEFDEHTNAKGESLNNADIMSQILQLREQKAKLLGFNNYAEVSLSTKMADSVAEVETFLRDLAVQATPTAEQDLAQLQKYAQDYGIKDLQPWDSAYIAEKVKQSEFSLSQEEIRSYFPLPRVISGLFAIVERLYGIKVQEQSNDSANNSTDKSLASRWHDDVRFYQLFDADDNLLGGFYFDLFARSGKRGGAWMSGFQSRYSYNKQDHQQLPVCFMVGNFTPALDGKPSLLTHDEVVTLFHEFGHGLHHLLTQVTIGDVAGVNGVEWDAVELPSQFMENWAWDAEGIALISSHVETSAPLPKDKLDALLAVKNFQSGLQTLRQIEFALFDLLIHAQTPVLDYKGILTTLNSVRDDIAIVQTPDYNRFANGFSHIFAGGYAAGYYSYKWAELLSADAFSKFEEEGVFNPITGKAFRETILSVGGSFPAKVNFENFRGRSASIEALLRHSGFADTNNQTKNSTAANAQTTRKVI

SEQ ID NO: 98196 - DNA, 2055 bp, Dechloromonas aromatica RCB
  CDS (1)..(2055)
atgaccgccagcaacccgctcctcgatttctccgacctgccccgcttcgacctgatccagcccgaacacgtcaaaccagccatcgaatccctgcttgccgaaggcaaggcgctgatcgagcgcctgaccgccgacagcacgcccgccacctggccggaattcgccggggcgctttccgacgggctggagcctttcggccgcgcctggggcattgtcggccacctgcattcagtcaatgacgtgcctgcctggcgcgaggcctacaacgaaatgctgcctgaggtgtcgcgcttctacgccgaactcggccagaacctgaaactgttcgaaaagtacaaggccctgcgtgaaagtgccgaatacgcgacgctgagcgtcgaacagaaaaagatcgtcaataacgaggtgcgtgatttccgcctttctggtgcggaattaccggaagagcagaagccgcgcttccaggccatcatggaagagctatcgcagctgtctgccaaatttgccgagaacctgctcgacgcgaccaacgcgttcgccgaagtcatcaccgacgaagcacagctcgctggcctgcccgacgacgtcaaggaagccgcgaagaccgcggccgaaaaagccggcgtcgatggttggcgtttcagcctgcaggccccgtcctacggcccggtcatgcagtatgccgacaaccgcgagctgcgtgcccggatgtaccgcgcctacgcgacgcgcgccgccgaattccacgacggctccagcaagccggaatgggacaatacgccgatcatccagcgcatgcttgaactgcgcgaggaagacgccaggatgctcggcttcaacaacttcgccgaagtgtcgctggcccccaagatggctgacacgccggcccaggtgctggctttcctacgcgaactggcagccaaggccaagccgttcgccgccaaggacatcgccgagctgcgcgcctttgccaaggatgaactgggcctgaacgacttccagccgtgggatgccgcctatgtatccgaaaagctgctgcaggcccgctacgctttctccgagcaggaagtgaagcagtatttcaccgagcccaaggtgctcggcggcctgttcaaggtcatcgagagcctgttcaacgtcaaggtcaagccggacacggcgccggtctggcatgaggacgtccgcttctaccggctggaaacgccgaccggcgatctggtcggccagttctacctcgacctctacgcccgcgaaaccaagcgtggcggtgcctggatggatgaagcccgctcgcgccgccgcaccgtcaccggcatccagaagccgattgcctacttgaactgcaatttcgcccgcccggtcggcggcaaaccggccaccttcacgcacgacgaagtgaccaccctgttccacgaaaccggccacggcctgcaccacctgctgacccgtggcgaagagctcggcgtttcgggcattcatggcgtcgagtgggatgccgtcgaactgccctcgcagttcatggaaaactactgctgggaatgggaagtcgtgtccggcatgacggcccacgtcgataccggcgcgacgctgccgcgcgaactgttcgacaagatgctggccgccaagaatttccagagcggcatgatggccgtgcgccagatcgagttctcgctgttcgacatgctgatccattccgatcttgacccgaaatccggcttgaccgtgatggacgtgctcaaggacgtacgcaaggaagtcgccgtgctgattccgcccgaatggcatcgcttcccgaacagcttctcgcacatttttggcggcggttatggggccggttacttcagctacaagtgggcggaagtgctgtcggccgatgcctatgcggctttcgaagaggccggcgatcccttcgatgccacggtgggcaagcgcttcctcgatgaaatcctgtcggttggcggctcgcgtccggccatcgagtcgttcaaggccttccgtgggcgcgaaccgagcgtcgatgcactgctccgtcatagcggtatgattgcggcctaa

SEQ ID NO: 98197 - protein, 684 aa, Dechloromonas aromatica RCB
MTASNPLLDFSDLPRFDLIQPEHVKPAIESLLAEGKALIERLTADSTPATWPEFAGALSDGLEPFGRAWGIVGHLHSVNDVPAWREAYNEMLPEVSRFYAELGQNLKLFEKYKALRESAEYATLSVEQKKIVNNEVRDFRLSGAELPEEQKPRFQAIMEELSQLSAKFAENLLDATNAFAEVITDEAQLAGLPDDVKEAAKTAAEKAGVDGWRFSLQAPSYGPVMQYADNRELRARMYRAYATRAAEFHDGSSKPEWDNTPIIQRMLELREEDARMLGFNNFAEVSLAPKMADTPAQVLAFLRELAAKAKPFAAKDIAELRAFAKDELGLNDFQPWDAAYVSEKLLQARYAFSEQEVKQYFTEPKVLGGLFKVIESLFNVKVKPDTAPVWHEDVRFYRLETPTGDLVGQFYLDLYARETKRGGAWMDEARSRRRTVTGIQKPIAYLNCNFARPVGGKPATFTHDEVTTLFHETGHGLHHLLTRGEELGVSGIHGVEWDAVELPSQFMENYCWEWEVVSGMTAHVDTGATLPRELFDKMLAAKNFQSGMMAVRQIEFSLFDMLIHSDLDPKSGLTVMDVLKDVRKEVAVLIPPEWHRFPNSFSHIFGGGYGAGYFSYKWAEVLSADAYAAFEEAGDPFDATVGKRFLDEILSVGGSRPAIESFKAFRGREPSVDALLRHSGMIAA

SEQ ID NO: 98198 - DNA, 2109 bp, Anabaena variabilis ATCC 29413
  CDS (1)..(2109)
atgagtgcgaatactaccattactcaaaatcctttacttaaaggttctggcttgcctccatttacggaaattcagccagaacaagtacaaccagcctttgaacaattattggcggaactggaacaagaactgactaccttggaagcgaatgtacagcctacttgggatggcttggtcgaacctttggaaaagttaagcgatcgccttacctggagttggagtatagtaaatcatctaatgggtgtgaaaaatagcccagaactgcgtacagcccatgaagctgtgcagccacaagtagtgcagtttgctaacaagttgggacaaagccaacccatctacaatgcttttaaacaactccgcgccagtgatagttggcaaactttagaatcagctcaacagcgaattgtggaagcagccattcgggatgcagaactgtccggtgtgggcttgcaaggagaagcacgggaacgtttcaatgctattcaaatggaattggcagaattggctaccaagttctctaaccatgtccttgacgcaaccacagcatttagcctcaccctcactactcaagcagaagttgacggcttaccccaaagtttacttagtttagcagcacaagccgcacgggcaactggtgcagaaaatgccacaccagaaaatggcccttggcgtattactttagatatccccagttacacccccttcatccagcacagcaccaggcgtgatttgcgcgaacagctttacaaaacttatattacccgcgcctcatctggtgaattagataacaacccaattatcgaacggactttagagttacgccaagaactggcaaatttattgggcttccaaaattatgccgagttgagcctagccagtaaaatggctcccaatgtggaagcagttgaagcactattagaagaattacgcagtgctagttacgatgcatctgttaaagatttagaaaccttgaaagcctttgcagcctctaaaggagcgccagaagccgcagatttacgacactgggatattagcttttgggctgaacgccaacgagaagaaaaatttgccttcaccgccgaagaactacgtccttacttccccctaccccaagtcctcgatggcttatttggactggtgcatcggctgtttggcattactgttaccccagcagatggacaagccccagtttggcacgaagatatccgttatttccaaatagctgatgaaactggcaatcccatcgcctatttctacttagacccttacagccgtccaggtgaaaagcgtggcggtgcatggatggatacctgtatcaatcgcgccataattacagaaaatggtgtaaaaactgtacgtttacctgtggcttatttggtgtgtaaccaaactccgccagtggatggtaaacctagtttgatgacattctatgaagtagaaacgctgttccatgaatttggtcatgggctacatcatatgctcaccaaggttaactatgctggagccgcaggcatcaataatgtagagtgggatgcagtggaactaccaagtcagtttatggaaaactggtgttatgaacgtaccaccttatttagcttggctaaacattacgaaactggggaaacactaccagaacattattatcaaaagctcctagccgcccgtaattatatgagtggtagcggtatcttgcgccaactccactttagtagcgttgatttggaattacactctcactatcacccaggtggtcaggaaaccgccgccgatgtgcgtcatcgagttgcccaaaaaactactgtcttaccaccactaccagaagatgctttcctctgcgcttttggacacatctttgcaggtggttatgctgcgggatactacagttacaagtgggctgaggtacttagtgctgatgctttcgccgcttttgaagatgctgggctagaagatgaagttgccattaaagctacgggtagacgttatcgagatactgtattagctcttggtggtagcaagcatccgatggaggtgtttgcagcgttccgaggacgggaaccgagtacagcttctttgctcaagcataatgggttgctgcccaatgctgcttaa

SEQ ID NO: 98199 - protein, 702 aa, Anabaena variabilis ATCC 29413
MSANTTITQNPLLKGSGLPPFTEIQPEQVQPAFEQLLAELEQELTTLEANVQPTWDGLVEPLEKLSDRLTWSWSIVNHLMGVKNSPELRTAHEAVQPQVVQFANKLGQSQPIYNAFKQLRASDSWQTLESAQQRIVEAAIRDAELSGVGLQGEARERFNAIQMELAELATKFSNHVLDATTAFSLTLTTQAEVDGLPQSLLSLAAQAARATGAENATPENGPWRITLDIPSYTPFIQHSTRRDLREQLYKTYITRASSGELDNNPIIERTLELRQELANLLGFQNYAELSLASKMAPNVEAVEALLEELRSASYDASVKDLETLKAFAASKGAPEAADLRHWDISFWAERQREEKFAFTAEELRPYFPLPQVLDGLFGLVHRLFGITVTPADGQAPVWHEDIRYFQIADETGNPIAYFYLDPYSRPGEKRGGAWMDTCINRAIITENGVKTVRLPVAYLVCNQTPPVDGKPSLMTFYEVETLFHEFGHGLHHMLTKVNYAGAAGINNVEWDAVELPSQFMENWCYERTTLFSLAKHYETGETLPEHYYQKLLAARNYMSGSGILRQLHFSSVDLELHSHYHPGGQETAADVRHRVAQKTTVLPPLPEDAFLCAFGHIFAGGYAAGYYSYKWAEVLSADAFAAFEDAGLEDEVAIKATGRRYRDTVLALGGSKHPMEVFAAFRGREPSTASLLKHNGLLPNAA

SEQ ID NO: 98200 - DNA, 2079 bp, Ralstonia eutropha JMP134
  CDS (1)..(2079)
atggaccaagccgtcaacaatccactgctggacttcaccgacctgccgcgcttctccgagatccgccccgagcacatcagcccggcgctcgacgtgctgctcgagcgtgcccaggctgccgtggcccgcgccgaagaccccgccacgccggccgactgggggaatgccgtcgaggcactggaaaccgccaccgagccgctggggcgcgcgtggggcgtggtcggccatctgagcgcggtcgccgacacgccggaactgcgcaaggcgcacgccgaaaacctgccgcgcatgaccgagttctggtcgtcgctcggacagagcctggcgctctatgaaaagtacaaggcgctcgcagccagccccgagttcgccggcatggacgccgcgcgccaccagctgatcgagaacgagctgcgcggcttccgcctgggcggcgccgaactgcccgaagacaagaagccacgctttgccgagatccaggaacaccaggcgcagctgtccaaggcgttttccgaccacgtgctcgatgccaccaatgcgtacgcgctgatcatcgaagaccccgcgcgtctgtccggcttgcccgaagacgcgaaggaagccgcgcgccacgccgccgagaaggacggcaaggccggctggaagttcacactgcacttcccgtcctatttccccgtgctccaatacgcggacgaccgcgcgctgcgccagaccctgtacgaagccaacgtgacacgtgcgtcggcgcaggccccgcagtacggcaacggccaggccgattgggacaacacggacaatatgcgcgagcagctcgcgctgcgccgcgaagaagcgcagatgctcggctaccagtgctacggcgaagtctcgctggtgccgaagatggccgaatcgccggccgaggtgctcaagttcctcgatgaactcgccgtcaaggcgcgtccgtatgccgagaaggactgggccgaactcagggccttcgctgcggcggaactgggactggccgaactcgcaccgtgggacgtcgcctacgcctccgaaaagctgcgcgagcagcgctatgcgttctccgaacacgaggtgaagcagtacttccccgagcacaaggtgctgcagggcctgttcggtgctgtggagcggctgttctcggtcaagatccagcccgaccagtcgcagacctggcacaaggatgtgcgcttcttccgcgtgagcgcgaccgatggcacgctgctcgcccagttctatatcgacctctatgcgcgcgagggcaagcgcggcggtgcgtggatggatgatgcgcgtgggcgcaagatcctcgcagacggcgaggtgcaaacacccgtggcctacctgacctgcaacttctcgtcgccggtcggcgacaagcccgcgctgttcacgcacgacgaagtcatcacgctgttccatgagttcggccatggcctgcaccatatgctgacgcaggttggcgagttgggcgtgtctggcatcaacggcgtggaatgggatgcagtcgagctgccgtcccagttcatggagaacttctgctgggaattcgaagtgctcagcggcatgacgcagcatgtcgacagcggcgagccgctgccgcgcgcgctgtttgaccgcatgctcgccgccaagaatttccagaacggcatgatgacgcttcgccagatcgtgttctcgtccttcgacatgcacctgcacaccgacttcgatccgcaaggtgccaagtcggtgctcgacctgtcgcgcgagatcaacgaccgcgtgcatgtggtgccacagtacccgctgtcgcgctggcccaataccttcagccacatcttcgctggcggctatgccgcgggctactacagctacaagtgggctgaagtgctgtcggccgacgtgtatgccgcgttcgaagaagccgcgcaactttcgggcaccgtgctcgacagtgaaaccggcgctcgctaccagcgcgagatcctgtcggtcggcggcagccgcccggccatggattcgttcgtcgcgttccgcggccgcgcgccgcagatcgacgcgctgctgcgccacggaggcatggcagcatga

SEQ ID NO: 98201 - protein, 692 aa, Ralstonia eutropha JMP134
MDQAVNNPLLDFTDLPRFSEIRPEHISPALDVLLERAQAAVARAEDPATPADWGNAVEALETATEPLGRAWGVVGHLSAVADTPELRKAHAENLPRMTEFWSSLGQSLALYEKYKALAASPEFAGMDAARHQLIENELRGFRLGGAELPEDKKPRFAEIQEHQAQLSKAFSDHVLDATNAYALIIEDPARLSGLPEDAKEAARHAAEKDGKAGWKFTLHFPSYFPVLQYADDRALRQTLYEANVTRASAQAPQYGNGQADWDNTDNMREQLALRREEAQMLGYQCYGEVSLVPKMAESPAEVLKFLDELAVKARPYAEKDWAELRAFAAAELGLAELAPWDVAYASEKLREQRYAFSEHEVKQYFPEHKVLQGLFGAVERLFSVKIQPDQSQTWHKDVRFFRVSATDGTLLAQFYIDLYAREGKRGGAWMDDARGRKILADGEVQTPVAYLTCNFSSPVGDKPALFTHDEVITLFHEFGHGLHHMLTQVGELGVSGINGVEWDAVELPSQFMENFCWEFEVLSGMTQHVDSGEPLPRALFDRMLAAKNFQNGMMTLRQIVFSSFDMHLHTDFDPQGAKSVLDLSREINDRVHVVPQYPLSRWPNTFSHIFAGGYAAGYYSYKWAEVLSADVYAAFEEAAQLSGTVLDSETGARYQREILSVGGSRPAMDSFVAFRGRAPQIDALLRHGGMAA

SEQ ID NO: 98202 - DNA, 2040 bp, Methylobacillus flagellatus KT
  CDS (1)..(2040)
atgagcattgccaacaacccattgctggatttttccggcttgccccagttcgaccaaatcaaggctgaacatgtcacccctgcggtggaccacttgctggaaaagggcaaggccctgatagaaaccctggtcacagaccctgcgccgcccacttgggaaaacttcgtgcgtccgctggaggatttcgaggagcagatctcgcgcgcctggtcgcaagtcggccatctcaatgccgtggtcaacagcccggagttgcgcgaggcctacaatcaaaacctgcccaagctcactgcattctatgcagacctctcacaggacgagcgcctgtatgccaagttccgcgccatcaaggccagcgctgcctatgaacagctcaacactgcccagcgcaagatcgtcgataacgaattgcgtgatttccgcctcggcggcgccgagttgccggcagacaagaaggcccgcttcaaggcgatccaggaagagctttccaccctggccgccaagttcgaggaaaacctgctcgacactaccaacgactatgccttgttcatcgaggacgaagcccagctgcaaggcatcccccaagatgccttgcaggctgcggctgaagccgccaaggccgatgggaagaccggctggaagttcaccctgcacttcccctcctatatgccggtgttgcaatatgccgacaatcgcgaactgcgtgaaaccctctaccgcgcctatgccacccgcgcttccgagttcggcaaaccggaatgggacaacaccgagatcatccgcgatatcctcactctgcgccacgaagctgccttgctgctgggctatcgcaactatgccgaagtctcgcttgccaccaagatggcagaaaccccggcccaggtggaagagttcctcaacaacctcgctgagcgcgccaagcctttcgccgagcgcgacatgcaggagctcagccaatatgccgctgacaagctgggtctgcctgagctgcaggcatgggatatcgcctatgcctccgagaaactgcgcgaggaaaagtacgcgttctccgatcaggaggtgaagcaatactttcccgagcaacaagtgctgcagggcctgttcaaggtcaccgagaccatctttggcctgcaggtgcgcaagaaggaagcaccagtctggcacaaggacgtcagtttctacgaaatcactaccccggcaggggagccagtgggccagttttacctcgacctctacgcgcgcaacaacaagcgcggtggcgcctggatggacgaagccatcacccgccgcaggaagaaccacggcgtcgaaattcccgtggcttaccttacctgcaatttctccgcgccggtcggcggcaagcccgccctgttcacgcatgacgaagtcatcaccatgtttcacgagttcggccatggcctgcaccacatgctgacccgcgtcgaggattatggtgtatccggcatcaagggcgtggagtgggatgctgtggaactgcccagccagttcatggaaaacttctgctgggaatgggacgtgctgcgtcacatgaccaggcacgtcgataccggcgagcatttacccaaggcactgttcgacaagatggtcgctgccaagaattttcaggccggcatgcagaccgtacgccagatcgagttctccctgttcgacatgcgtctgcattccgacttcagcgaatacgacaccaccacagcacttgagctcatcgaagccatccgcgacgaagtcgccgtggtgcgtccgcccaagtggaaccgcttccccaacaatttctcgcacatcttcgcaggtggttatgcggccggctattacagttacaaatgggcggaagtgctctccgcagatgcctacagcatgttcgaggaaaacggcgtgctttccgcggaaaccggcaagcgcttctggaacgaaatcctcgcccagggcggctcgcgccccgcgctggaatcgttcatcgcgttccggggcagggcgccgagcattgatgccttgctacggcataacgggatgacggcttga

SEQ ID NO: 98203 - protein, 679 aa, Methylobacillus flagellatus KT
MSIANNPLLDFSGLPQFDQIKAEHVTPAVDHLLEKGKALIETLVTDPAPPTWENFVRPLEDFEEQISRAWSQVGHLNAVVNSPELREAYNQNLPKLTAFYADLSQDERLYAKFRAIKASAAYEQLNTAQRKIVDNELRDFRLGGAELPADKKARFKAIQEELSTLAAKFEENLLDTTNDYALFIEDEAQLQGIPQDALQAAAEAAKADGKTGWKFTLHFPSYMPVLQYADNRELRETLYRAYATRASEFGKPEWDNTEIIRDILTLRHEAALLLGYRNYAEVSLATKMAETPAQVEEFLNNLAERAKPFAERDMQELSQYAADKLGLPELQAWDIAYASEKLREEKYAFSDQEVKQYFPEQQVLQGLFKVTETIFGLQVRKKEAPVWHKDVSFYEITTPAGEPVGQFYLDLYARNNKRGGAWMDEAITRRRKNHGVEIPVAYLTCNFSAPVGGKPALFTHDEVITMFHEFGHGLHHMLTRVEDYGVSGIKGVEWDAVELPSQFMENFCWEWDVLRHMTRHVDTGEHLPKALFDKMVAAKNFQAGMQTVRQIEFSLFDMRLHSDFSEYDTTTALELIEAIRDEVAVVRPPKWNRFPNNFSHIFAGGYAAGYYSYKWAEVLSADAYSMFEENGVLSAETGKRFWNEILAQGGSRPALESFIAFRGRAPSIDALLRHNGMTA

SEQ ID NO: 98204 - DNA, 2085 bp, Crocosphaera watsonii WH 8501
  CDS (1)..(2085)
atgaccaacgcaactgtaaccaataaccctttattgatcggaaaaggattaccgacctttgataaaattactcctgatcatattattcctgcaatgactgaattattgcaagaattggaaactaaattaaatgatttagaaaccactgttaaacctacctgggaaggtttagtggaacctctaacaaaaatagaagaaaaatttagttggagttggggtattgttggacatttaatgggggttcaaaatagtcctgaacttcgtgaagcttacgaaactgcacaacctaaagttattcaatttattaataagttaggtcaaagtaagcccatttatgaagcctttaaatcccttcaagcaagcgagtcatggaatagtttagaaaatgctcaaaagcggattgttgaaacagctatcaaagaagcagaattatcgggggttgctttaacaggagaaacccgtgataaattcaacaaaattaaattagaattagcggaattatctaccaaattttctaaccatgttttagatgcaactaaagcctttaaactgaaactaactacagagaaagaagtagaaggtttacccgcaagtttactcagtttagcagcacaaactgcccgtgcagaaggagaagataacgttaccccagaaacaggaccttggctaattactttagattatcctagttatgttccctttatgaaatatagtagccaacgggacttaagagagaaggtttataaagcatttatctcccgtgcatctagtggagaattagacaataaaccgttaattgagcgtattttagaactgcggaaacaacaagcagaaattctcggttataacacctatgctgaggttagtttagctagaaaaatggctcctaatgttgaagctgtagaagggttattagaagagttaagaaccgtaagttatgacgctgcactaaaagacttagaaacattaaaagcctttgccaaaaccgatgatttacagccttgggacgtgagttattgggcagaaaaacaacgagaaaccttatttaactttactgctgaagaactacgcccttattttcctttaccccaagtattagatgggttatttactttagcaaaaagaatctttggggtaactataactgctgctgatggacaagcaccaatatggcaagaagatgtaagatattttcaggttaataatgaagcaggagaagcgatctcaaacttctatttagacccctatagtcgccccgcagagaagcgtggaggggcttggatgaatgattgtattggacgggcaaaaattaagctagaagagcaatttataacccgtttacctgttgcttatttaatctgtaatcaaactcctcccgtggatggaaaaccaagtttaatgacctttgatgaagtaacaactttatttcatgaattcggtcatggactacaacatatgttgacaaaagtagattatcctggggctgctggaattaataatgtagagtgggatgcggtggaattacccagccagtttatggagaattggtgttatgatcgcatcaccttatttaacatggcaaagcattatgaaacaggagaaaccttaccagaacattactacgataagttagtttctgctcgtaattatatgagtggctcagccatgttaagacaactacattttagttttttggatctggaattacaccatcgttatcaaccaaatggtaatgaaactcatgcagaagttcgtaaccgtattgctgagaaaacaacggtgatcaaaccgttacccgaagacgcatttttgtgtgcctttgggcatatttttgccgggggttatgcagcaggttactacagttacaaatgggcagaagtattaagtgctgatgccttttctgcctttgaagaagtgggtttaaacgatgaaaaagccgtttcaagcacaggaaaacgattcagagataccgtgttagcattaggaggtagtttagacccaatggaagtatttaaagcctttcgaggaagggaaccacaaacagaacctttattaagacatagtggtttattaggcgcaatttag

SEQ ID NO: 98205 - protein, 694 aa, Crocosphaera watsonii WH 8501
MTNATVTNNPLLIGKGLPTFDKITPDHIIPAMTELLQELETKLNDLETTVKPTWEGLVEPLTKIEEKFSWSWGIVGHLMGVQNSPELREAYETAQPKVIQFINKLGQSKPIYEAFKSLQASESWNSLENAQKRIVETAIKEAELSGVALTGETRDKFNKIKLELAELSTKFSNHVLDATKAFKLKLTTEKEVEGLPASLLSLAAQTARAEGEDNVTPETGPWLITLDYPSYVPFMKYSSQRDLREKVYKAFISRASSGELDNKPLIERILELRKQQAEILGYNTYAEVSLARKMAPNVEAVEGLLEELRTVSYDAALKDLETLKAFAKTDDLQPWDVSYWAEKQRETLFNFTAEELRPYFPLPQVLDGLFTLAKRIFGVTITAADGQAPIWQEDVRYFQVNNEAGEAISNFYLDPYSRPAEKRGGAWMNDCIGRAKIKLEEQFITRLPVAYLICNQTPPVDGKPSLMTFDEVTTLFHEFGHGLQHMLTKVDYPGAAGINNVEWDAVELPSQFMENWCYDRITLFNMAKHYETGETLPEHYYDKLVSARNYMSGSAMLRQLHFSFLDLELHHRYQPNGNETHAEVRNRIAEKTTVIKPLPEDAFLCAFGHIFAGGYAAGYYSYKWAEVLSADAFSAFEEVGLNDEKAVSSTGKRFRDTVLALGGSLDPMEVFKAFRGREPQTEPLLRHSGLLGAI

SEQ ID NO: 98206 - DNA, 2046 bp, Mesorhizobium sp. BNC1
  CDS (1)..(2046)
atggcttccatcgatctttccacacatccgctcactgcctggaacggcccgttggggctcccggaatttgatggcatcgaggaatccgctttcgcgccggttttcgaatctgcctttgccgcgcatgaagcggagatcgcggccattgcggatagcggcgaggcgccgactgtcgagaacacgcttgccgcgcttgagctttccggcgacccgctgtcgcgcgtgtcggccatcttctggtgccgggcgggtgctcataccaatgaggttatccagaagctggaacgcgaaatctcgccgcgcatggcccggcattattcgcgtctctttatgaacgaggcgctcttcaggcgcatcgacacgctctatggcgcgcgaaccaccctcgggctggacaaggagaccgcgcgcgttctggaaaagacctggaagcatttcgtgcgtggtggcgccaagcttgatgccgagggcaaggcacggctagcgaagatcaatgaggaactggcagagctcggagcgcggttcggccagaatgtgctcgccgacgaaagcaagtgggcgctcttcctggaagagaccgatctggcgggtctgccgtcctcgcttaggagcgcaatggccgaggcggcgcaatcgcgtggacagcccggacgctacgccgtcacgctctcccgctcgattgcggaacccttcctttctttctcttcgcgccgcgacctgcgcgaagcggtgctggaagccttcactcgtcggggcgccaatgacggagaggcaaacaatgccgggatcgttcagaagacattgaagctgcgcgccgagaaggcacgccttctcggctatgagaactatgccgcctacaagctcgacgacaccatggcgaagacgcccgacgccgtgatgacgctgctcgagcctgtttgggaaaaggcgcgggaaaaagccgcggccgacgagaaggagctacagcgcctcgccgccgccgaaggctacaatcacccaatcgccgcgtgggactggcgctactatgccgagaagctcagggctgaacgctttaccttcgacgagggcgcgcttgaaccctatctggcgctggaaaatgtcatcgcggctgccttcgacgtggctcaccgcctgtttggcctcaccttcgaggaacagaagagcgttccggcctggcatgaggatgttcgtgtcttcacagtcaaaaatcgggacggcagcgagcgcggcgtgttcctggccgattacttcaaccggccatcaaagcgctccggcgcgtggatgagcgggttgcagtctggttacaagctaggccacggcgagagccccatcatctataacatcatgaatttcgccaagccgccaaaaggcaagccggcgcttctttcggtcgacgacgcgcgcacgctcttccacgagttcggccatgcgctgcacggcctcctctccgacgtcacctggccctcgatcgccggcacctcggttgcgcgggatttcgtcgagcttccatcgcagctctttgaacactggttcagcacgccccaagtgctctcgaagcacgcgcgccatgtcgagaccggcgaatccataccggcggagctgctggagaaaatgcgcgcggcgcgcaatttcaacgccggtttcgccacggttgaattcacggcctccgcactggtcgacatggcctatcacgcacgccccgatgctcccgaagaccctctcgcctttgaagccgaggtgcttgagaagcttgcgaagcccgcggcagttcccatgcggcatgccacgccgcattttctccatgtgttctcgggcgaaggctattcggcgggctactattcctatctctggtcggaggtgctggacgcggacgccttccgcgccttcgaggaagccggcgatcctttcgatcagggcactgccgaaaagctgcgccgctacatctattccgcaggcggttcagcggatcccgaggagctttacaagaccttccgcgggcgattgccgagccccgatgctatgatggagaagaaggggctcgcttga

SEQ ID NO: 98207 - protein, 681 aa, Mesorhizobium sp. BNC1
MASIDLSTHPLTAWNGPLGLPEFDGIEESAFAPVFESAFAAHEAEIAAIADSGEAPTVENTLAALELSGDPLSRVSAIFWCRAGAHTNEVIQKLEREISPRMARHYSRLFMNEALFRRIDTLYGARTTLGLDKETARVLEKTWKHFVRGGAKLDAEGKARLAKINEELAELGARFGQNVLADESKWALFLEETDLAGLPSSLRSAMAEAAQSRGQPGRYAVTLSRSIAEPFLSFSSRRDLREAVLEAFTRRGANDGEANNAGIVQKTLKLRAEKARLLGYENYAAYKLDDTMAKTPDAVMTLLEPVWEKAREKAAADEKELQRLAAAEGYNHPIAAWDWRYYAEKLRAERFTFDEGALEPYLALENVIAAAFDVAHRLFGLTFEEQKSVPAWHEDVRVFTVKNRDGSERGVFLADYFNRPSKRSGAWMSGLQSGYKLGHGESPIIYNIMNFAKPPKGKPALLSVDDARTLFHEFGHALHGLLSDVTWPSIAGTSVARDFVELPSQLFEHWFSTPQVLSKHARHVETGESIPAELLEKMRAARNFNAGFATVEFTASALVDMAYHARPDAPEDPLAFEAEVLEKLAKPAAVPMRHATPHFLHVFSGEGYSAGYYSYLWSEVLDADAFRAFEEAGDPFDQGTAEKLRRYIYSAGGSADPEELYKTFRGRLPSPDAMMEKKGLA

SEQ ID NO: 98208 - DNA, 2067 bp, Kineococcus radiotolerans SRS30216
  CDS (1)..(2067)
atggggcagcatgcccgcatgagccccctcgccgcggacaaccccttcgccgcccccagcgacctgccgttcgcggtgccgcccttcgaccggatccgcgccgagcactacgccccggccttcgaggcggggatggccgagcacctcgccgaggtcgacgccctcctcgccgccgacctggacgccgcggccttcctcgacgccctgcagtcggcggggcagctgctcgggcgcgcggaggccgtgttccacaacctcgtcggcaccgacgccgacgacgcgctgcgcgcggtgcaggaggagttctccccgcggctctccgcccaccacgacgccgtgcgcctggacccccgggtcgtgcagcgggtccgggagctgcacgaggaccccgcccccgacctcgaccccgagcagcggcggctgctgacggagctgcaccgcgacgccgcgcgctccggggccctgctcgacgagcccggcgccgcccggctgcgggagctcaacgaggagctctcccggctcaccacccggttcgacgtcgagctgctcgccgacaccaacgccctggccgtgcacgtggacgccgccgccgacctggaggggctcggggcgggggagctggcccgcgccgccgccgcggcgggcgagcgcggcgggtacctcctcccgctcgtcctgcccaccgggcagccggtgctggagtccctgcggcgccgggagacccgccgccgggtccacgaggcgtcggtctcgcgcggcgggcgcggcggggagcacgacacccgcgccgtcctgcagcgcatcgccgcgctgcgcgccgagcgggccgtgctgctcagccaccccgaccacgcctcctgggtcatcgccgacgagaccgccggggacgtcgaggccgccgccggcatgctgcgccgcctcgcccccgcggcggtcgccaacgcccgccgcgaggaggccgagctgaccgggctgctgctcgccgacggcgaggagggacccctgcggccgtgggactgggcctactacgccgagcggctgcgccggcagcggttcgccgtcgacgccgaggcgctgcggccgtggttcgagctcgaacgcgtcctcgtcgacggggtcttcgccaccgccaccgccctgtacgggctgaccttcaccgaacgcaccgacgtgccggtgttctcgcccgacgtgcgcgccttcgaggtcgccgacgagtccggtcccctcggcctctacctcttcgacccctacgcccgggagtccaagcggggcggggcgtggatgagctccttcgtcgagcagtcccggctgctggggcagcggcccgtcgtcgtgaactgcctcaacgtcgcgaggcccgccgcgggcgatccggcgctgctgagcgtcgacgaggtcgagaccctcttccacgagttcggccacaccctgcacggcctgctgtccgacgtgcgcttcccccggttctccggcacgagcgtcccgcgcgacttcgtcgagttcccctcccaggtcaacgagttctgggggttcgaacccgaggtcctggcccgctacgcccgccacgtcgagacgggggaaccgctgcccgccgacgccgtcgacggcctgcgcgcggcccgcggctacggccagggcttcgccaccaccgagtacctcgccgccgccctgctcgaccaggcctggcaccgcctcgcccccggggccctcgacggggccgcgcccgaggacgtggagcggttcgaggccgaggccctggccgaggccggggtcgcgctggagaccgtccccccgcgctaccgcagcacctacttccaccacgtcttcggcggcgggtacgcggccgcctactactcctacgtgtggagcgaggtcctcgacgccgacaccgtggagtggttcgccgagaacggcggcctgcgccgggagaacggcgaccgcttccgggccgcggtgctctcccgcggcggcagcgtcgaccccctggaggcctaccgggagttccgcggccgcgacgcccgcctggaacccctgctgcgccgtcgcggcctcgacggggcctga

SEQ ID NO: 98209 - protein, 688 aa, Kineococcus radiotolerans SRS30216
MGQHARMSPLAADNPFAAPSDLPFAVPPFDRIRAEHYAPAFEAGMAEHLAEVDALLAADLDAAAFLDALQSAGQLLGRAEAVFHNLVGTDADDALRAVQEEFSPRLSAHHDAVRLDPRVVQRVRELHEDPAPDLDPEQRRLLTELHRDAARSGALLDEPGAARLRELNEELSRLTTRFDVELLADTNALAVHVDAAADLEGLGAGELARAAAAAGERGGYLLPLVLPTGQPVLESLRRRETRRRVHEASVSRGGRGGEHDTRAVLQRIAALRAERAVLLSHPDHASWVIADETAGDVEAAAGMLRRLAPAAVANARREEAELTGLLLADGEEGPLRPWDWAYYAERLRRQRFAVDAEALRPWFELERVLVDGVFATATALYGLTFTERTDVPVFSPDVRAFEVADESGPLGLYLFDPYARESKRGGAWMSSFVEQSRLLGQRPVVVNCLNVARPAAGDPALLSVDEVETLFHEFGHTLHGLLSDVRFPRFSGTSVPRDFVEFPSQVNEFWGFEPEVLARYARHVETGEPLPADAVDGLRAARGYGQGFATTEYLAAALLDQAWHRLAPGALDGAAPEDVERFEAEALAEAGVALETVPPRYRSTYFHHVFGGGYAAAYYSYVWSEVLDADTVEWFAENGGLRRENGDRFRAAVLSRGGSVDPLEAYREFRGRDARLEPLLRRRGLDGA

SEQ ID NO: 98210 - DNA, 2088 bp, Burkholderia cepacia R1808
  CDS (1)..(2088)
atgtccgccagcgccaataccaatccgctcctcgatttctccggcctgccccgtttcggcgagatccgcccggaacacgtgacgcccgccctcgacgtattgctggccgccgccaaccgcgcggtcgacaccgccagcgcaagcgagacgccggcgacctgggctgcgatcgtcgagacggtcgagcaggcgacggagccgctcgggcgcgcgtggggcgtcgtcggccacctgaacgcggtcgccgatacgcccgaactgcgcgccgcgtacggcgaaaatctgccgcgcgtgaccgagttctggtcgagcgtcggccagaacctcgcgctgtacgaaaagtacaaggcgatcgcggcgggcgccgaatacgcgacgctgtccgccgaacgcaagaagatcctcgataacgcgctgcgcgatttccgcctgtcgggcgccgagctgcccgaagaccagaagccgcgcttcgcggaactgcaggagcagcaggccgcgctgtcgaaggcgttctccgatcacgtgctcgacgcgaccaacgcgtacgcgtatttcgcgcaggacgaagccgagctggccgggctgccgggcgacgcgatcgaggcggcccgcgaagccgcgcagaaggacggcaaggaaggctggaaattcacgctgcacttcccgtcgtacttcccggtgctgcaatacgccgagaaccgcgcgatgcgcgaaacgatgtaccgcgcctatgcgacgcgcgcgtcggaactcgggccgcagtacggcggcggcaaggccgagtgggacaacacggcgatcgtcgccgacgagctgaagctgcgccgtgaagaagcgcagatgctcggctaccgcaacttcgccgaagtgtcgctcgcgccgaagatggccgaatcgccgcagcaagtgatcgccttcctcgaggatctcgcaacgcgtgcgcgcccgcacgcggagaaggactgggacgaactgcgcgcgttcgccgcgaaggagctcgggctcaccgagctcgcgccgtgggacgtcgcgtttgcggccgagcgcctgcgccagcagcgctacgcgttctcggagaacgaagtcaaacagtacttcccggaaccggcggtgctgaagggccttttcaccgtcaccgaaacgctgttcggcgtacggatcaagccggacgatgcgccggtctggcacaaggacgtgcgcttcttccgcgtggagaaccgcgacggctcgctcgtcgcgcagttctatctcgacctgtacgcacgcgaaggcaagcgcggcggcgcgtggatggatgacgcgcgtgcgcgcgcgaagcgcgacggcgccgtgcagacgccggtcgcgtacctcacctgcaacttctcggcgcccgtcggcggcaagcccgcgtgcttcacgcacgacgaagtgatcacgctgttccacgagttcggccacgggctgcatcacatgctcacgcgcgtcgacgagctgggcgtgtcgggcatcaacggcgtcgaatgggacgcggtcgagctgccgtcgcagttcatggagaacttctgctgggaatgggacgtgctgtcgtcgatgtcgtcgcacgtggaaaccggcgccgcgctgccgcgcgagctgttcgacaagatgatcgccgcgaagaacttccagagcgggctcggcacgctgcggcagatcgtgttctcgatgttcgacatgctgctgcacgtcgacttcggcccggccggcgcgaccggcgtgaacgccttcgcgcgcgagatcaacgagcgctaccacgtgatcccgcaggcggccttctcgcgctggccgaacacgttcagccacatcttcgcgggcggctatgcggccggctactacagctacaagtgggccgaggtgctgtcggccgacgcgtatgcggcgttcgaggaagcagcggccgaaagcggcagcgtgctcgacgcgacgaccggcacgcgctatcgccgcgagatcctcgaagtgggcggcagccgtccggcgatggattcgttcaaggcgttccgcggccgcgagccggaaatcgacgcgctgctgcgtcacaacggtatggcagcgcccgcgcagtga

SEQ ID NO: 98211 - protein, 695 aa, Burkholderia cepacia R1808
MSASANTNPLLDFSGLPRFGEIRPEHVTPALDVLLAAANRAVDTASASETPATWAAIVETVEQATEPLGRAWGVVGHLNAVADTPELRAAYGENLPRVTEFWSSVGQNLALYEKYKAIAAGAEYATLSAERKKILDNALRDFRLSGAELPEDQKPRFAELQEQQAALSKAFSDHVLDATNAYAYFAQDEAELAGLPGDAIEAAREAAQKDGKEGWKFTLHFPSYFPVLQYAENRAMRETMYRAYATRASELGPQYGGGKAEWDNTAIVADELKLRREEAQMLGYRNFAEVSLAPKMAESPQQVIAFLEDLATRARPHAEKDWDELRAFAAKELGLTELAPWDVAFAAERLRQQRYAFSENEVKQYFPEPAVLKGLFTVTETLFGVRIKPDDAPVWHKDVRFFRVENRDGSLVAQFYLDLYAREGKRGGAWMDDARARAKRDGAVQTPVAYLTCNFSAPVGGKPACFTHDEVITLFHEFGHGLHHMLTRVDELGVSGINGVEWDAVELPSQFMENFCWEWDVLSSMSSHVETGAALPRELFDKMIAAKNFQSGLGTLRQIVFSMFDMLLHVDFGPAGATGVNAFAREINERYHVIPQAAFSRWPNTFSHIFAGGYAAGYYSYKWAEVLSADAYAAFEEAAAESGSVLDATTGTRYRREILEVGGSRPAMDSFKAFRGREPEIDALLRHNGMAAPAQ

SEQ ID NO: 98212 - DNA, 2034 bp, Rubrivivax gelatinosus PM1
  CDS (1)..(2034)
atgagcaatcctctactcgataccgccgccctgccgcgcttcggcgagatccgccccgagcatgtggagcctgcggtcgaggccctgctggccgaagcgaacgtggcgctggaacgcgccacgggcgcggacgtgccggccgactacgatgccctctccgcggtgctcgatgtcgcaaccgagcgcctcgggcgcgcctggggagcggtcagccacctcaacgcggtggccgacacgcccgagctgcgcgccgcctacaccgaggccctgccgcgcgtgaccgagttctacacgaacctgggtgccgacgagcggctctacgcgaagtacaaggccgtggccggcagccctgcggcagccgcgctcaacgcggcacggcgcaaggcgctgtcgaacgcgatgcgcgatttcgtgctgtccggcgccgagctgcagggggccgccaaggagcgcttcgcagccatccaggcgcgtcaggccgaactcggccaggccttctccgagcatgtgctcgacgcgacagacggctggagcttcatcgcgagcgaggccgagctcgccggcgtaccggaggacgtcaaggccgccacgcgcgccgccgcccgggccgacggccaagacggccacaagctcagcctgcacatgccggtctacctgccggtgctgcagtacgcgcaggaccgcgcgctgcgcgaacgcgtctaccgcgcccacgtcacgcgtgcctcggaggccggcccgaccgagcgcgacaacagcgccgtgatgggcgagatcctcactctgcggcaggaagaggccgagctgctgggctaccgcaacttcgccgaggtttcgctggtcgccaagatggccgactcgccggcgcaggtgcagggattcctgcgcgacctggcgcggcgcgcacggccccacgccgagcgcgatctggccgagcttcgcgagttcgcccgcaccgagctcggcctggccgatctgcaggcctgggacatggcctacgcggccgagcgcctgaaggaagcccgttacgccttcagcgacaccgaggtgaagcagtacttcaccgaacccaaggtgctggccggcctgttccgcatcatcgagacgctgttcgaggtggcgatccgcccggacacggcgccggtctggaacgagcacgtgcgattcttccgcatcgagcgcggcactcagctggtcggccagttctacctcgacccctacgcacgccccggcaagcgcccgggcgcctggatggacgacgtacggggtcgctgggcccgccctgagggcagggtgcagacgccggtggctcatctggtttgcaacttcgctgcgcccgtcggtgaccgccccgcgctgctgtcgcacgacgacgtgaccacgttgttccacgagttcggccacggcctgcaccacatgctcacgcaggtcgacgagatcggcgtggccggcatctccggcgtcgagtgggacgcggtcgagctgcccagccagttcatggagaacttctgctgggagtgggaggtggtgaagcacatgacggcgcacgtcgacagcggcgagccgctgccgcggacgctgttcgacaagatgctcgccgcaaagaacttccagagtggcttgcagacgttgcgccaggtggagttctcgctgttcgacatgctgatccacgacggtgcgtcggcggcgccctacggcgccgacgccatccagcgggtgctcgacggcgtgcgccgcgagatcgcggtcatcgtgccgccggccttcaaccgcttccagcacagcttctcgcacatcttcgccggcggttacgcagccggctactacagctacaagtgggccgaggtactgagcgccgacgcctacgccgccttcgaggaggaaggggtgttcaaccccgccgtcggccgccgttaccgcgaagccatcctcgaagccggtggcagccgtccggcgatggagagcttcaaggccttccgcggtcgcgagccacgcatcgacgccctgctgcgccaccagggcatggcggactaa

SEQ ID NO: 98213 - protein, 677 aa, Rubrivivax gelatinosus PM1
MSNPLLDTAALPRFGEIRPEHVEPAVEALLAEANVALERATGADVPADYDALSAVLDVATERLGRAWGAVSHLNAVADTPELRAAYTEALPRVTEFYTNLGADERLYAKYKAVAGSPAAAALNAARRKALSNAMRDFVLSGAELQGAAKERFAAIQARQAELGQAFSEHVLDATDGWSFIASEAELAGVPEDVKAATRAAARADGQDGHKLSLHMPVYLPVLQYAQDRALRERVYRAHVTRASEAGPTERDNSAVMGEILTLRQEEAELLGYRNFAEVSLVAKMADSPAQVQGFLRDLARRARPHAERDLAELREFARTELGLADLQAWDMAYAAERLKEARYAFSDTEVKQYFTEPKVLAGLFRIIETLFEVAIRPDTAPVWNEHVRFFRIERGTQLVGQFYLDPYARPGKRPGAWMDDVRGRWARPEGRVQTPVAHLVCNFAAPVGDRPALLSHDDVTTLFHEFGHGLHHMLTQVDEIGVAGISGVEWDAVELPSQFMENFCWEWEVVKHMTAHVDSGEPLPRTLFDKMLAAKNFQSGLQTLRQVEFSLFDMLIHDGASAAPYGADAIQRVLDGVRREIAVIVPPAFNRFQHSFSHIFAGGYAAGYYSYKWAEVLSADAYAAFEEEGVFNPAVGRRYREAILEAGGSRPAMESFKAFRGREPRIDALLRHQGMAD

SEQ ID NO: 98214 - DNA, 2034 bp, Rubrivivax gelatinosus PM1
  CDS (1)..(2034)
atgatcgccgacacctatcccttcccgatccgcatgaacgcttccgtcctcgctttcctgtcccggctgcttcggctgtcgagttgcgtcgccctgttcggcgtcagcggctggagcgccgcggccgacaccgcgccctacgtctttccgagctaccgcgacggcgccgccgtgaaggcgcgttgcgaccgcacgctgcgcgagatcgaggcgcaggcgcggcgcatcgcggccggtcggggcccggacggcgtgctggtcgagatcgaccggctcggacagacagtcgacgacagcatgtcgccggtgttcttcctggcgaacgtgcaccccgacaagccggtgcgcgacgcggccgaggcctgcgagctgcgctaccaggccttcaccagccggctgtaccagaaccccaggatctaccggcgtctgcaggcgctgcagccggtcgatgcgatcgaccggcagatgcgggccgatctgctcgcgagtttcgaggacgccggggtcggcttgccggccgcgaagcgcgaccgcgcacgcgcgctcaacgacgaactgggccgcctgtcgcaggacttcgagcgtcgcctgcgcgaggacaagacccgcgtcgccttcaccgacagcgagctcgacggggtgccggccagtgtgtggagcaccgccccccgcgacgcgcagggccgggtgctgctggggctcgactacccgacctactcgccggtggtggagaacgcgcgcagcccgggggcacgcgaacgcatgtggcgggccttccaggcgcgcggcggccaggcgaacctgaagacgctggcgcggctgggcgagaagcgccgcagctacgcgcgcctgttcggtgtcgagagctatgccgatttcacgctgcgccgtcgcatggcgctgaacgtgggcaacgtgcaggccttcctcggcgaggtgaagggcgagctgggcgagcgcgaggaacgcgatctgtccgaactgcgtgccgccaaggccgccgagttgaagacggcgcccgacaccacgccgctgaaacgctgggacgtgggctactacctcgagcgcgtcaagcgcgagcgcctggcgctcgaccaggagagcttccgccgctatttcccgccgcaggccagcgtcgacttcgtgttcgcgctcgccgggcggctgttcggcgtgggcttcgagccggtgcctcagtcgctgtggcatcccgacgccaaggcctacgtcgtggtcgacgccgccagccgcacgccgctggccacgctctacctcgatctctacccccgtgccgacaagtacggccacgcggcggtgtggccgctgcgcggctcgtcgacctggagcgggcagttgccgacggccgcgctggtgaccaacttcgaccgccagggcctgacgatcgacgagctggaaacgctgctgcacgagttcggccatgcgctgcacgtcacgctgtcgcacacgcgctatgccgcacaggccgggaccgcggtcaagctcgacttcgtcgaggcgccatcgcagatgctggaggaatgggtctacgacgcccaggtgctggcgctgttccagcaggtctgcgcgagctgcgagccggtgccagccgacctgctggcgcgcgccgtgcaatcgcgcagcttcgccaaggggctgcagttcgcgcgccagcatctgtacgccaactacgacctcgcgctgcacgacaaggacgcgccggacccgatggcgctgtgggcccgcatggagagcgccacgccgctcggctacgagcccggctcgctgttcccggccggcttctcgcacgtcgccggcggctacggcgccggctactacgcctacctctggagcctggcgatcgcgcaggatctgcgcaccgccttcgcggccgacccgctggacccggccgtcggtcgtcgctaccgtgagacggtgctggccaacggcggccaggctccgcccgccgagctggtggcgcgcttcctggggcgtgcgccgagcaacgccgcgttctttgagtggctcgagcgctga

SEQ ID NO: 98215 - protein, 677 aa, Rubrivivax gelatinosus PM1
MIADTYPFPIRMNASVLAFLSRLLRLSSCVALFGVSGWSAAADTAPYVFPSYRDGAAVKARCDRTLREIEAQARRIAAGRGPDGVLVEIDRLGQTVDDSMSPVFFLANVHPDKPVRDAAEACELRYQAFTSRLYQNPRIYRRLQALQPVDAIDRQMRADLLASFEDAGVGLPAAKRDRARALNDELGRLSQDFERRLREDKTRVAFTDSELDGVPASVWSTAPRDAQGRVLLGLDYPTYSPVVENARSPGARERMWRAFQARGGQANLKTLARLGEKRRSYARLFGVESYADFTLRRRMALNVGNVQAFLGEVKGELGEREERDLSELRAAKAAELKTAPDTTPLKRWDVGYYLERVKRERLALDQESFRRYFPPQASVDFVFALAGRLFGVGFEPVPQSLWHPDAKAYVVVDAASRTPLATLYLDLYPRADKYGHAAVWPLRGSSTWSGQLPTAALVTNFDRQGLTIDELETLLHEFGHALHVTLSHTRYAAQAGTAVKLDFVEAPSQMLEEWVYDAQVLALFQQVCASCEPVPADLLARAVQSRSFAKGLQFARQHLYANYDLALHDKDAPDPMALWARMESATPLGYEPGSLFPAGFSHVAGGYGAGYYAYLWSLAIAQDLRTAFAADPLDPAVGRRYRETVLANGGQAPPAELVARFLGRAPSNAAFFEWLER

SEQ ID NO: 98216 - DNA, 2079 bp, Pseudomonas fluorescens PfO-1
  CDS (1)..(2079)
atgtttcttccagccaaggtgccaaccgtgagcgtgaacaaccctcttctgcagtcctacgacctgccgccgttctccgcgatccgtgccgaacacgtgcagccggccatcgaaaccatcctggccgacaaccgcgccgccatcgccgaaatcctcaagacccaaggccagaacccgacctgggccgggctggtgctggcgatggacgaactcaatgatcgcctgggcgctgcctggagtccggtcagccacctcaatgccgtgtgcaacagcgccgaactgcgtgaagcctacgagtcgtgcctgccggcattgagcgcctactccaccgaaatgggccagaaccgcgaactgttccaggcctatgaagccctggccaacagcccggcagccgccggtttcgacgtggcgcaaaaaaccattctggaacacgccctgcgcgatttccgcctgtcgggtatcgacctgccggaagccgaacagaaacgctacgccgaagtgcagagcaagctatcggagctgggcagccgcttttccaaccagttgctcgacgccactcaggcctggaccaagcacctgaccgatgaagccgccctcgccggcctgaccgattcggccaaggcgcaaatggctgctgcggcacaggccaagggcctcgacggctggctgatcaccctggaattcccgagctactacgcggtgatgacctacgcccaggaccgtgcgctgcgtgaagaagtctacgccgcctactgcacccgtgcgtcggatcaaggcccgaacgccggccagaacgacaatggcccggtgatggacgaaatcctcgacctgcgtcaggaactggcaaaactgctcggtttttccagcttctccgaactgagcttggccaccaaaatggccgagtccagcgatcaggtgctgagcttcctgcgtgatctggccaagcgcagcaaaccgttcgccgcccaggatctgcaacagctcaaggcttacgccgccgagcagggctgcgccgatctgcaaagctgggacagcggtttctacggtgaaaaactccgtgaacagcgttacagcgtcgctcaggaaaccctgcgcgcctacttcccgatcgacaaagtgctgggtggtctgttcgccatcgttcagcgcctgtacggcatcgaaatcgccgaactgaaaggcttcgacacctggcacccggacgtgcgcctgttcgaaatcaaggaaaacggtcagcacgtcggccgtttcttcttcgacctctacgcccgcgccaacaagcgcggcggtgcgtggatggatggcgcccgcgaccgtcgccgcaccgtcgacggcgtgctgcaaagcccggtggccaaccttgtgtgcaacttcaccccggccgacagcggcaaacctgcgctgctgacccacgatgaagtgaccaccctgttccacgaattcggccacggcctgcatcacctgctgacccgcgtcgagcatgccggcgtttccggtatcaacggcgtggcgtgggacgccgtcgagttgccgagccagttcatggaaaactggtgctgggagccggaaggtctggcgctgatttccggccactacgagaccggcgagccgctgccgcaggatctgctggaaaaaatgctcgcggcgaagaacttccagtccggcctgatgatggtgcgccaactggaattctcgctgttcgacttcgaactgcacgccacccacggtgacggccgcagcgtcgcgcaagtgctggaaggcgtacgcaacgaagtctcggtaatgcgacctccggcctacaaccgcttcccgaacagcttcgcgcacatcttcgccggcggttacgcggcgggttactacagctacaaatgggcggaagtgctgtcggcagatgccttctccaagttcgaagaagacggcgtgctgaatgccgacaccggtcgcgccttccgcgaagcaatcctcgcccgcggcggctcgcaggagccgatggtgctgttcgtcgacttccgtggccgtgagccatcgattgacgcactcttgcgccacagcggcctgagtgaggacgcggcagcatga

SEQ ID NO: 98217 - protein, 692 aa, Pseudomonas fluorescens PfO-1
MFLPAKVPTVSVNNPLLQSYDLPPFSAIRAEHVQPAIETILADNRAAIAEILKTQGQNPTWAGLVLAMDELNDRLGAAWSPVSHLNAVCNSAELREAYESCLPALSAYSTEMGQNRELFQAYEALANSPAAAGFDVAQKTILEHALRDFRLSGIDLPEAEQKRYAEVQSKLSELGSRFSNQLLDATQAWTKHLTDEAALAGLTDSAKAQMAAAAQAKGLDGWLITLEFPSYYAVMTYAQDRALREEVYAAYCTRASDQGPNAGQNDNGPVMDEILDLRQELAKLLGFSSFSELSLATKMAESSDQVLSFLRDLAKRSKPFAAQDLQQLKAYAAEQGCADLQSWDSGFYGEKLREQRYSVAQETLRAYFPIDKVLGGLFAIVQRLYGIEIAELKGFDTWHPDVRLFEIKENGQHVGRFFFDLYARANKRGGAWMDGARDRRRTVDGVLQSPVANLVCNFTPADSGKPALLTHDEVTTLFHEFGHGLHHLLTRVEHAGVSGINGVAWDAVELPSQFMENWCWEPEGLALISGHYETGEPLPQDLLEKMLAAKNFQSGLMMVRQLEFSLFDFELHATHGDGRSVAQVLEGVRNEVSVMRPPAYNRFPNSFAHIFAGGYAAGYYSYKWAEVLSADAFSKFEEDGVLNADTGRAFREAILARGGSQEPMVLFVDFRGREPSIDALLRHSGLSEDAAA

SEQ ID NO: 98218 - DNA, 2043 bp, Pseudomonas fluorescens PfO-1
  CDS (1)..(2043)
atgcccgacaccaatcccctcctgcaacactggacgctgccaccgtggccagcgattcacgccgagcatttactgccggccgtcaacagcatcattgccgataaccgacgcatcatcgcccaggtgatcgccagtcagaccgaacatcccggctgggatgatctggtgctgagcatcgacgaggccgacgcgcgcctcggcgaagtccgctcgattctcgaaacgttgtcgatggtcagatccgacgatccggtctggctcgtggaaagcgccaaggcgcatctggcgatcaatcagtatcgctctgaaaaagcccacaatcgccggttgtacgagacctatcagcgtttggcgcagagctcgatcgccggcagtttcgatgaggcgcgcaacatcgcactgtcgcgaattctgcgccgattcaagcagtcgggcattgagcttcccactgaacagcagcaggagctggcgcggttgaaccgcgagatcggaggcttggaattcgtatttctggacaacctcgagcgctgggccgaggcgtggagcaaacgtgttgacgatgtggcactgcttacgggcctgccgccggcgatgaaggatcggctggcactcgccgcacgccagaccggccatgacggctggttgatccgcctggaccagaacaccttccagcacatccttaaatacgccgagaaccgcgccttgcgggaggaatgctatgtggcctacatgacccgtgcctccgatcgagggccgctggccggccgcttcgacaacgccccggtactgaagaagctgctcgccttgcgtcagcagaaagcccgtttgctcggtcatgaaaacgccgcgcaactgagtcttgccaaaaacagcgccgggacaacggcatgggttagtggttttctacagcgtcaggcggcgcaactggcacctaccctcgcgcaggatgcagaacaactgacagacttcgcgcagcaacgcgggatcgaccgggtccagccgtgggatgaagacttcctcgccgaacaatggcgccagcagcagtttcccggtgcgcttgaaaacctgcgggattacttcccgctcgagggcaccctgcgcaggctcttgctgttttgcgagcgaatgttcgggatccgcatcgtcgagcaatccggcggtgggcacttgcacgacgatgtgcgcctgctggaaatcagcgaggatgagcaggtcatcggctacatctacctcgatccgtttcaccgcgatggcgctgcggatttccccggcaccttcacgctgcgcaaccgccggatcaatgccgaaggccgcccggcgctgccgattgccctgctctacagcaatttcacaccggccagcgatacccatccgtgccggctcgagctccacgatctgcgggtgctgtttcatgaattcggccattgcctccagcacgtgctgacgcgctcgccccatcacagcctgtccggcatccttcaattgggccatgaagcggcggagttttccgggcaattgttcgagcagtggtgtctgtcgcgtgagtttttgctgtggctgggtgctcattttcagacgggcaaacgattgagcgcagcaagggtcgacgcggcattgtcagccagtcaggcccattccgcccggcaacaggcctttttgctgatgggggcgatgatcgatttcgagctgcacctgacccacggcgatgggcgctcggtcgaggagacttgcaccgatgtgcagcgcagcctgggtcatctgcaactgccggacgatcatcgcttcgccaatggattcgattacatggtgacccagtacgacgcctcggtttacgcctacgtctggtcgggcgtgctggctcaggaagcgttcaagcgcttcagccaggactgggtgttcaacgcgcaaaccggccgtgagtttcgtgcaacgttctttgcgccgggtgcggggcgtccattgctggacgcggtggaagcgttcatcggccggccggtcgccggcctcgttgacggagaggccggacgagttacttcagattga

SEQ ID NO: 98219 - protein, 680 aa, Pseudomonas fluorescens PfO-1
MPDTNPLLQHWTLPPWPAIHAEHLLPAVNSIIADNRRIIAQVIASQTEHPGWDDLVLSIDEADARLGEVRSILETLSMVRSDDPVWLVESAKAHLAINQYRSEKAHNRRLYETYQRLAQSSIAGSFDEARNIALSRILRRFKQSGIELPTEQQQELARLNREIGGLEFVFLDNLERWAEAWSKRVDDVALLTGLPPAMKDRLALAARQTGHDGWLIRLDQNTFQHILKYAENRALREECYVAYMTRASDRGPLAGRFDNAPVLKKLLALRQQKARLLGHENAAQLSLAKNSAGTTAWVSGFLQRQAAQLAPTLAQDAEQLTDFAQQRGIDRVQPWDEDFLAEQWRQQQFPGALENLRDYFPLEGTLRRLLLFCERMFGIRIVEQSGGGHLHDDVRLLEISEDEQVIGYIYLDPFHRDGAADFPGTFTLRNRRINAEGRPALPIALLYSNFTPASDTHPCRLELHDLRVLFHEFGHCLQHVLTRSPHHSLSGILQLGHEAAEFSGQLFEQWCLSREFLLWLGAHFQTGKRLSAARVDAALSASQAHSARQQAFLLMGAMIDFELHLTHGDGRSVEETCTDVQRSLGHLQLPDDHRFANGFDYMVTQYDASVYAYVWSGVLAQEAFKRFSQDWVFNAQTGREFRATFFAPGAGRPLLDAVEAFIGRPVAGLVDGEAGRVTSD

SEQ ID NO: 98220 - DNA, 2109 bp, Burkholderia fungorum LB400
  CDS (1)..(2109)
atgtccaccaccgcctcgaatcacgacaatccgctcctcgatttctccgacctgccgcgctttggccaaatccgccccgaacacgtcacgcccgccctcgatgtgctgctcgccgatgcgtccgccgccgtcgagcgcgccgcccagcccatcacgcccgcttcatgggccgacgtggtcgagccggtcgagcgcgccaccgaaccgctgtcgcgcgcatggagcgtggtcggccatctgaacgcggtggccgatacacccgagctgcgcgccgtgtatggcgagaatctgccgcgcgtcaccgaattctggtcgagcgtcggacagaacctcgcgctgtacgagaagtacaaggcattgcacgccagcagcgatttcgaatcgctgaccggcgagcgcaagaagatcctcggcaatgcgctccgcgatttccgcctgtccggcgcggaattgccggaagaccagaagccgcatttcgccgaattgcaggaacgccaggcggcgctctcgaaagcgttttcggatcacgtgctcgacgcgaccaacgcgtatgcgtatatcgtcgaagccggcgctgaagcgcaactggccggcctgcccgaagacgtgatcgaagccgccagggaagcgaccgagcgcgaaggcaagaccggctacaaattcacgctgcacttcccgtcgtatttcccggtgatgcagtactcggaaaatcgtccgatgcgcgaggcgatgtatcgcgcctatgtcacgcgcgcctcggaactcggcccgcaatacggcaatggcaagcccgagtgggacaacaccgcggtgctcgccgagcagttgaaactgcgcgccgaagaagcgcacatgctcggctacaacaacttcgccgaagtctcgctcgcgccgaaaatggccgagtcgcccgcccaggtgatgagctttctcgaagatctcgccacgcgtgcgcgtccgcatgccgagcaggactggaaggaactgcgcgaattcgccgcgaacgaactcggcatgagcgaactgcagccgtgggacatgacctttgccgcggagcgtctgcgtcagaagcgctattcgttctccgagaacgaggtcaaacagtactttccggaagacaccgtgttcaagggtcttttcaaggtcactgaaacgctgttcggcgtgcgcatccgtcgcgacaaagcggacgtgtggcatccggacgtacgctttttccgtgtcgagaatcaggacggcggcctcgtcgcgcagttctacctcgatctgtatgcgcgcgaaggcaaacgcggcggcgcctggatggacgacgcgcgcggccgccacaggcacacgcacggcggcgtgcaaacgccggtcgcgtatctgacctgcaacttctccgcgccggtcggcggcaagcccgcctgctttacgcacgacgaagtcatcacgctgttccacgagttcggccacggcctgcaccacatgctcacgcgcgtggacgagctgggcgtgtcgggcatcaacggcgtggagtgggacgcggtcgaactgccgtcgcaattcatggagaacttctgctgggagtgggacgtgctgagcgacatgacctcgcacgtcgaaacggccaggccgttgccgcgcgaactgttcgacaagatgctcgcggcgaagaacttccagagcggtctcggcacgctgcgccagatcgtcttctcgatgttcgacatgcaactgcataccgacttcgacgcgtccggcacgaagagcgtcaccgaactcgcgagcgaaatcaacgagcgcttccacgtcgtgccgcaagcaccgttctcacgctggccgaacacgttcagccatattttcgcgggcggttatgcggcgggctactacagctacaagtgggccgaagtgctgtccgccgacgcctacgcggcgttcgaagaagccgcgcaatcggctagcggcagcgtgctcgatcaggcgaccggcatgcgttaccgcaaggagattctggaggtgggcggcagccgtccggcgatggaatcgttcaaggcattccgcggccgcgagccgaatatcgacgccttgctgcggcacaacggcatgacgccgggcgctgcgcattga

SEQ ID NO: 98221 - protein, 702 aa, Burkholderia fungorum LB400
MSTTASNHDNPLLDFSDLPRFGQIRPEHVTPALDVLLADASAAVERAAQPITPASWADVVEPVERATEPLSRAWSVVGHLNAVADTPELRAVYGENLPRVTEFWSSVGQNLALYEKYKALHASSDFESLTGERKKILGNALRDFRLSGAELPEDQKPHFAELQERQAALSKAFSDHVLDATNAYAYIVEAGAEAQLAGLPEDVIEAAREATEREGKTGYKFTLHFPSYFPVMQYSENRPMREAMYRAYVTRASELGPQYGNGKPEWDNTAVLAEQLKLRAEEAHMLGYNNFAEVSLAPKMAESPAQVMSFLEDLATRARPHAEQDWKELREFAANELGMSELQPWDMTFAAERLRQKRYSFSENEVKQYFPEDTVFKGLFKVTETLFGVRIRRDKADVWHPDVRFFRVENQDGGLVAQFYLDLYAREGKRGGAWMDDARGRHRHTHGGVQTPVAYLTCNFSAPVGGKPACFTHDEVITLFHEFGHGLHHMLTRVDELGVSGINGVEWDAVELPSQFMENFCWEWDVLSDMTSHVETARPLPRELFDKMLAAKNFQSGLGTLRQIVFSMFDMQLHTDFDASGTKSVTELASEINERFHVVPQAPFSRWPNTFSHIFAGGYAAGYYSYKWAEVLSADAYAAFEEAAQSASGSVLDQATGMRYRKEILEVGGSRPAMESFKAFRGREPNIDALLRHNGMTPGAAH

SEQ ID NO: 98222 - DNA, 2031 bp, Microbulbifer degradans 2-40
  CDS (1)..(2031)
atgcttagtgcagcgttattagttggattaagcgcatgcaatcaaaccaaacagcctattgacgaaaacttaaccagccaagcagctgcagcagaaaatgcttggtttagcccaaccgatgcagccgccgtaagctacttaaatgaatgtaaggccgaatacacaaccgctagcgagctttttgaaaccctccaaaatgctacacctgcagctagcgacatggcattactcgcagaaatagacaaactagacatagttatagatcgagtaataagcaaagccagcctatttagaaatgttcacccaaacgccgccctgcgcgaggccgccgataactgccaacaaaaagttatcgaattaattaccgaaataaacctctccaaaccgctgtacgccaaaatagccaaaatcgacacaagtcaattaagcgcgctagataaacgatacgtagaagaacttattcaagattacaagcgctctggcgtagacctagacgaaaaatcgcgcaaccggattcgcgcactacaagatgaaattgtggcactaggtcaaagctttaacaaaaatatccgcgaagatgtacgcagcattagcgttagctcaaccagtgagcttgaaggcttaccgcaagattacatagacgcacaccccgccggtgaagacggcaaaataaccctaaccacaagttaccccgattacattcccgtaatgcaatacgctaaaaacgatgcattgcgactcgcgttttacaaagagtttcgcaaacgcggctaccctgccaacgaaaaagtgttaaaagacctgttaataaaacgcgcagaactagcgaaaattttgggttatagcgattacgccagttacgtaaccgaagatttaatgattaaaaccccagaaaacgcccgcaattttataaacaaaataaatgtattagccaaaaagcaagcaaacgaagagtatcaactgctactaaaccgcttaaagcaaatagcccccaatgcaacccgcgttggcgactggcaaaaaacctaccttgaagaactagtaaaaacagaacagttcgatgtcgattcacaaaaaattcgagaatactttaactacaatgcggtaagggatggcatcttcgaccttaccgaatccatgtttggtgtaaccataaaaccgtggcaaacagaggtttggcacgagtctgtagaaagttacgaaatgtgggagggcgatcaccttgtgggtaaattcttcttagatatgcacccccgtgaaggcaaatataatcacgcggccgctttcggttaccaagacggcgtgaaaggcgttcaaccacctatcctcgcgctagtatgcaactttcctagcggcaccgacttaatggaacacagccaggttgaaacttttttgcatgagtttggccacttattacacggcttgtttggtggacatcaaccacgtatgtatttctctggcattaaaccagaacacgattttgtagaggcgccctcgcaaatgcttgaagagtgggtttgggatgccgatacgcttaaaacattcgccaaaaacgccgccggcgaaaccattccagacgacttaattgccaaaatgaatgcaggccgcaacttcggccgcgcgctgtttacacgccatcaaatgttttacgccgctgtttcgcttaactattacaccggcgaccctacagacatagatctaaccgaaacaatgaaagcattacagaaagagtattcgccatatgcctatgttgaagacacctactttcacgctagcttcgggcacctttacggttactctgccacctattacacctatatgtggtctctcgttatcgcatcagacatgtttagtgagttcgaaaaggcagggctgcgcaatcaggaagtagcaactcgttaccgcgacactgtgcttgctccaggcggtagtaaagatgcagcagaaatggttgaagatttccttgggcgcccatatagctttgaaacctttgctaaaggcctaagctctgataacgctaaagcgcactaa

SEQ ID NO: 98223 - protein, 676 aa, Microbulbifer degradans 2-40
MLSAALLVGLSACNQTKQPIDENLTSQAAAAENAWFSPTDAAAVSYLNECKAEYTTASELFETLQNATPAASDMALLAEIDKLDIVIDRVISKASLFRNVHPNAALREAADNCQQKVIELITEINLSKPLYAKIAKIDTSQLSALDKRYVEELIQDYKRSGVDLDEKSRNRIRALQDEIVALGQSFNKNIREDVRSISVSSTSELEGLPQDYIDAHPAGEDGKITLTTSYPDYIPVMQYAKNDALRLAFYKEFRKRGYPANEKVLKDLLIKRAELAKILGYSDYASYVTEDLMIKTPENARNFINKINVLAKKQANEEYQLLLNRLKQIAPNATRVGDWQKTYLEELVKTEQFDVDSQKIREYFNYNAVRDGIFDLTESMFGVTIKPWQTEVWHESVESYEMWEGDHLVGKFFLDMHPREGKYNHAAAFGYQDGVKGVQPPILALVCNFPSGTDLMEHSQVETFLHEFGHLLHGLFGGHQPRMYFSGIKPEHDFVEAPSQMLEEWVWDADTLKTFAKNAAGETIPDDLIAKMNAGRNFGRALFTRHQMFYAAVSLNYYTGDPTDIDLTETMKALQKEYSPYAYVEDTYFHASFGHLYGYSATYYTYMWSLVIASDMFSEFEKAGLRNQEVATRYRDTVLAPGGSKDAAEMVEDFLGRPYSFETFAKGLSSDNAKAH

SEQ ID NO: 98224 - DNA, 2058 bp, Microbulbifer degradans 2-40
  CDS (1)..(2058)
atgtctaaccctttgttaaatcatcagaacttgccagcattttctactgttaagcctgaacatgtggtgaatgcagtagaaacaattattaaagaaaatgagcaaactttagccgaagtgcttgcgcaagagggtacgccaacctgggaaaccctagtggcacccttagatgaaaaaagcgataagttagacaaggcttgggcggtagtgagccatctaaactcagtagctaacagtgatgagttgcgcgaagcttacgaggcgggggagcaattgcttacccagtactatgccaaaataggtcaaaacaaagcgctttatcaagcctacgaggcgctggcccaagagccatattttagcagcctcagccaagcccaaaagcaaactgtagaaaatgcgctgcgcaattttcgcttagcgggtgttgctctagaggccgaacagcaagcgcgttttaccgaaattcaatctgagctatctagcctaactacacagtttgccaacaacgtgatggatgcaacgcaaggttggtacaaacaggtaaccgacgaagcacacttagcaggtattcctgcaatggcgaaagaagctgcggccaatgcagccaaaaagaaagatgtgcaaggctgggtattcacacttgatatcccgtcttacttggcagtaataactcacgccgataaccgagcgctgcgcgaagaaatgtaccgcgcgtttgccacccgcgcctcgagcgaaagcccagtagcggatgagcaaaaagcaaaatgggacaacaccccgctgatagaaaaaattcttgctctgcgcttagaaaaagcgcaactgttagggtttaataattatgccgaagtatctattgctcccaaaatggcagagagcaccgagcaagtaattggctttttagaagacctagccgcaaaggccaaaccacaagccgcaaaagagaaagctacacttgagcagtttgctaaaaccgaactcggcctagatgaattaaacgcatgggatgtggcttacgcgtcggaaaaactaaaagaaaaaacctttaacgtttcacaagaagcattgcgtgaatattttccgctacaaaaagtacaggcgggtatgtttacgttggtagagaaactatttgatgtgcgtattcaagaaaataccgaatcagacacctaccacccagatgtaagttatttcgatatttatcgcaacgatacgttaattgccagtttttactgggatttattcgcccgcgagaaaaaacgcggtggcgcgtggatggccgatggccgcattcgtcgcaaaacggcagagggcttgcaaaaaccggttgcatttttaacctgtaattttaatggccccgttggcgataagcctgcgttattaacccacgacgaagtgaccacattattccatgagtttggtcacggcttgcaccacatgcttacccaaatagatatcccagcagtaagcggcattaatggcgtagcgtgggatgccgttgagttgcccagtcaatttatggaaaacttctgctgggaaaaagaagtactgccgttaatttctggccactacgccaccaacgaacctttgccagaagacatgcttaataacatgattgccggccgtaactttcaatcggctatgcaaatggtacgtcagttagagttttctttatttgattttgtgttgcataaagattttggcactgaacaatttagcgatgtgcaaagtgtgttagatactattcgcgataaagtttcggtaattgttccacccagctttaataaattccaaaacagttttacacatatttttgccggtggttatgcggcgggttattacagctataagtgggcagaggtgttatcggccgatgcgttcgcggcgtttgaagaagaaggtgtacttaacgaagcaaccggcaagcgctttttgcacagtatattagagcagggcggttcacagcaggcgatggtattgtttgagaatttccgcggtagaaaacccagtgtggacccgcttttgcgccattctggcattgtagaggtagcagcgtga

SEQ ID NO: 98225 - protein, 685 aa, Microbulbifer degradans 2-40
MSNPLLNHQNLPAFSTVKPEHVVNAVETIIKENEQTLAEVLAQEGTPTWETLVAPLDEKSDKLDKAWAVVSHLNSVANSDELREAYEAGEQLLTQYYAKIGQNKALYQAYEALAQEPYFSSLSQAQKQTVENALRNFRLAGVALEAEQQARFTEIQSELSSLTTQFANNVMDATQGWYKQVTDEAHLAGIPAMAKEAAANAAKKKDVQGWVFTLDIPSYLAVITHADNRALREEMYRAFATRASSESPVADEQKAKWDNTPLIEKILALRLEKAQLLGFNNYAEVSIAPKMAESTEQVIGFLEDLAAKAKPQAAKEKATLEQFAKTELGLDELNAWDVAYASEKLKEKTFNVSQEALREYFPLQKVQAGMFTLVEKLFDVRIQENTESDTYHPDVSYFDIYRNDTLIASFYWDLFAREKKRGGAWMADGRIRRKTAEGLQKPVAFLTCNFNGPVGDKPALLTHDEVTTLFHEFGHGLHHMLTQIDIPAVSGINGVAWDAVELPSQFMENFCWEKEVLPLISGHYATNEPLPEDMLNNMIAGRNFQSAMQMVRQLEFSLFDFVLHKDFGTEQFSDVQSVLDTIRDKVSVIVPPSFNKFQNSFTHIFAGGYAAGYYSYKWAEVLSADAFAAFEEEGVLNEATGKRFLHSILEQGGSQQAMVLFENFRGRKPSVDPLLRHSGIVEVAA

SEQ ID NO: 98226 - DNA, 2106 bp, Trichodesmium erythraeum IMS101
  CDS (1)..(2106)
atgagccctaatacaacagttacaaaaaaaacattactaattggtaagggattacccccttttgaatctataaaaccagaagatgtagtacccgcaataacagaattactgacagaattagaaaaagaactaatcaacttagaattaatagttaaaccaacttggaatgacctagtagaacctctacaaaaattagaagatcgtttaacctggagttggggaatagtaggacatttaatgggagttaaaaataatcctgaactacgaaaagcttatgatcaagtacaacccaaaatagtagagtttattaataaactaaatcaaagtaaacctctttatcaaacctttaaaaatttaagtaatagtgatagctggcaaaacctagattcaggacaaaaacgtatagttgaagctgccatcaaagatgcagaactttcaggagtaggtttaaaaggagaaaaacgagaacacttcaatgctattgaactagaactagcagaactttctactaaattttctaataatgttcttgatgctaccaaagcttttagcctaattttaactgaaaaagaagaagtagacggtttaccacccagtttgttaagtctagctgctcaagctgccagagataatggatccgagaatgctacaccagaaaacggaccttggcggataaccctcgactctcccagttttttacccttcatgcaacactgcaaaagacggcagttgcgagaacaactttataaagcctttattagtcgtgcttctagtgagaagttaaacaactatcctttaattgaacgtattctggagctacgtcagcaaaaaacagaaattttgggctttaatagttatgcagaattgagtcttgccagtaaaatggctcctagtgtggaagcagtagaaaagttattagaagaattacgcagtgttagttatgatgctgcagttaaagacttagaagaactaaaacagtttgctgccagccaaaatgcaccagaggccaaggagtttaaaccctgggatatgagcttttggtcagaaagactgcgagaagaaaaattttcctttactacagaagagttgcgaccatatttccccctgccacaggttcttgatgggttatttagtttagtcaagcgtatatttggcattaatattactgccgcagatggggaagctccagtatggcatgaagatgtgcgctattttaaaattagtgatgaaacaaacagacccattgcctatttttaccttgatgcttatagtcgtcctgctgaaaaacgaggtggtgcatggatggatgactgtataaatcgtgctaaaattgtagagaatggtcaaactactttgcgtttacctgtagcttatttacaatgtaatcaaacaccgcctgtagatggtaaacctagtttgatgaattttagtgaggtagaaactctgttccatgaatttggacatggtttacaacatatgctgacaacagttgactatggaggtgcttcaggtattaataacgtagagtgggatgcggtagagttacctagtcagtttatggaaaattggtgttatgaccgctccactttattcggaatggcgaaacattatgaaacaggggaggttttgccagaacattattatcagaaacttttggctgctagaaattatatgagcggtagtgcgatgttgcgccagttgcattttgctttagttgatattgagctccatcaccgttatcgaccagctggggaagaaacagtgctagatgtgcgtaagcgtgttgctgaaactactactgttttggaactattgccagaagactcatttttatgtgcatttgggcatatttttgctggtggttatgctgccggttattatagttataagtgggcggaggtattgagtgctgatgcttttgccgcttttgaagaggctggtttggaaaatgaacaggcgatcgctacttgtggtcagcagtttagggatacagttttagctttgggcgggagtctgcatccgatggaggtatttaaaactttccgaggtcgagaacctagtactgaacctttgttaaggcatagtggtttggtagctacagcttaa

SEQ ID NO: 98227 - protein, 701 aa, Trichodesmium erythraeum IMS101
MSPNTTVTKKTLLIGKGLPPFESIKPEDVVPAITELLTELEKELINLELIVKPTWNDLVEPLQKLEDRLTWSWGIVGHLMGVKNNPELRKAYDQVQPKIVEFINKLNQSKPLYQTFKNLSNSDSWQNLDSGQKRIVEAAIKDAELSGVGLKGEKREHFNAIELELAELSTKFSNNVLDATKAFSLILTEKEEVDGLPPSLLSLAAQAARDNGSENATPENGPWRITLDSPSFLPFMQHCKRRQLREQLYKAFISRASSEKLNNYPLIERILELRQQKTEILGFNSYAELSLASKMAPSVEAVEKLLEELRSVSYDAAVKDLEELKQFAASQNAPEAKEFKPWDMSFWSERLREEKFSFTTEELRPYFPLPQVLDGLFSLVKRIFGINITAADGEAPVWHEDVRYFKISDETNRPIAYFYLDAYSRPAEKRGGAWMDDCINRAKIVENGQTTLRLPVAYLQCNQTPPVDGKPSLMNFSEVETLFHEFGHGLQHMLTTVDYGGASGINNVEWDAVELPSQFMENWCYDRSTLFGMAKHYETGEVLPEHYYQKLLAARNYMSGSAMLRQLHFALVDIELHHRYRPAGEETVLDVRKRVAETTTVLELLPEDSFLCAFGHIFAGGYAAGYYSYKWAEVLSADAFAAFEEAGLENEQAIATCGQQFRDTVLALGGSLHPMEVFKTFRGREPSTEPLLRHSGLVATA

SEQ ID NO: 98228 - DNA, 2106 bp, Thiobacillus denitrificans ATCC 25259
  CDS (1)..(2106)
atggtcgtcgccatgaatacccccaagggctccaaccccctgctcgacttctccggcctgccccgcttcgccgagttcaagcccgaatacgtcaccccggcggtcgacgcgttgctggcggagtgccgcgccgcggtcgcccgcgccgaggccgccgacacgccggccgaatgggacgccttcgtcgccccgctcgaggatgcgaacgagaagctcggccgcgcctggggccaggcttcccacctgcactcggtcatggattcgcccgagttgcgcgaggtctacaacgccaatctgccgaagatcacggtctattacgccgaactcgggcagaacgaggccttgtacgccaaatacaaggccctcgccgcgagtcccgcgtttgccgcgctgtcgcccgcccgcaggaaagtcgtcgacaacgagttgcgtggcttccgtctcggcggcgccgagctgccggccgacaagaaggcgcgcttcatgcaggtgcaggaggaactcgcgcagttgtccaccaagttcgaggaaaacctgctcgacgcgaccaacgactacgcgctcatcatcgacgagaagggcgagctcgccggcattcccgacgacgtgctggaagccgcgcgcgccgcggccgaggccgccggcaccaccggctggaagttcacgctgcacatgccgtcctacctgccggtgatgcagtacgccgacagccgcgaacttcggcagatcctttaccgcgcctacgtcacccgtgcctccgagttcggcaagcccgagctcgacaacacgccgctgatcgcgcgcatcctcaagctgcgccgagagtccgccgagttgctgggtttcaagagctacgccgaggagtcgctcgaagccaagatggccgaatcgccgcgcgaggtgctggattttctcgacgagctcgccgcgcgtgcccgcccctacgcggagaaagactacaccgaactcaagaccttcgcccgcgacgaactgggcctggacgaggtcgaagcctgggacacgacctacgtctcggaaaaactgagcgtcgcgcgctacagcttctcggaccacgaagtgaagcagtatttccccgagccgcgcgtgctcgcaggcctgttccgactgatcgaaacgctgtacggcctgcacatccgcgaggacaacgcgccggtgtggcaccccgacgtgaagttctacacgctttacgaccgcgccggccagcgcatcggccagttctacctcgacctctacgcgcgcgcctcgaagcgcggcggcgcctggatggacgacgtcatcacccgccgtcgcctgccttcactcgatgggcgggcagagggcatgcagacgccggtggcctacctgaactgcaatttttctgcgccggtgggcgacacccccgacgggggcaagaaacccgcgctgttcacccacgacgaggtcatcacgctgttccacgagatgggccacggcctgcaccatctgctgacccagatcgaggagctgggcgtctccggaatcaacggcgtcgaatgggacgcggtcgaactgccgagccagttcatggaaaacttctgctgggaatgggacgtgctcaagcacatgaccgcccacgtcgataccggcgagccgctgccgcgcgtgctgttcgacaagatgctcgcggcgaagaacttccaggccggcctgcagacgctgcgccagatcgagttcgcgagcttcgacatgcatctgcacgacgatttcgacccgaacggcgtacgcaccgcgcaggatctgatcgacgacatccgcaagaaggtcgcggtcatcatcccgcccgcgtacaaccgcttccccaacaacttctcgcacatcttcgccggcggctacgcggccggctactacagctacaagtgggccgaagtcctgtcggccgacgcctatgcgctgttcgaggacgaggccgagggctacggcggcgtgctgaatcccgaggtcggccaccggttctggagcgagatcctggcgcagggcggcgcgcgcccggcgctcgagtcgttcaaggccttccgaggccgcgagccgacgatcgacgcactgctgcggcacaacggcatggcgtga

SEQ ID NO: 98229 - protein, 701 aa, Thiobacillus denitrificans ATCC 25259
MVVAMNTPKGSNPLLDFSGLPRFAEFKPEYVTPAVDALLAECRAAVARAEAADTPAEWDAFVAPLEDANEKLGRAWGQASHLHSVMDSPELREVYNANLPKITVYYAELGQNEALYAKYKALAASPAFAALSPARRKVVDNELRGFRLGGAELPADKKARFMQVQEELAQLSTKFEENLLDATNDYALIIDEKGELAGIPDDVLEAARAAAEAAGTTGWKFTLHMPSYLPVMQYADSRELRQILYRAYVTRASEFGKPELDNTPLIARILKLRRESAELLGFKSYAEESLEAKMAESPREVLDFLDELAARARPYAEKDYTELKTFARDELGLDEVEAWDTTYVSEKLSVARYSFSDHEVKQYFPEPRVLAGLFRLIETLYGLHIREDNAPVWHPDVKFYTLYDRAGQRIGQFYLDLYARASKRGGAWMDDVITRRRLPSLDGRAEGMQTPVAYLNCNFSAPVGDTPDGGKKPALFTHDEVITLFHEMGHGLHHLLTQIEELGVSGINGVEWDAVELPSQFMENFCWEWDVLKHMTAHVDTGEPLPRVLFDKMLAAKNFQAGLQTLRQIEFASFDMHLHDDFDPNGVRTAQDLIDDIRKKVAVIIPPAYNRFPNNFSHIFAGGYAAGYYSYKWAEVLSADAYALFEDEAEGYGGVLNPEVGHRFWSEILAQGGARPALESFKAFRGREPTIDALLRHNGMA

SEQ ID NO: 98230 - DNA, 2016 bp, Silicibacter sp. TM1040
  CDS (1)..(2016)
atgacaaatccgctgcttcgcgactggcaaacgccctttgggattgccccgttcgatcagatttccgacgaagactttgcgcctgcgcttgatgaggcgctaaaggcgcatactgcgcagatcgatgcgattgccaccaaccccgcgccgcccacattcgccaatgtgatcgaggctctcgagacgccatgccagccacttgaacaggtgctgtcggtgtttttctcggtggccggggcggacagcaacccggcgcgcgaggcgctccagcgcgcgttctctccgaatcttgcggcgcatttctcggccattactgccaataaggcactttatgcacgggtgcaggcggtgtgggaccaacgcgacactctggacctgaccgacgaacaggcccgtgtcctgatgctcacccatcgtgggtttgtgcgcggcggcgcggcgctcaatggcgcggaagatacccgcatgcaggagatcaaatcccgccttgcgacgcttggcaccaatttcacccagaacctgcttgcggatgagcgggactggttcatggagctctccgaggacgatcttgaggggcttcctgattttgttgtgaaggccgcacggaccgcgggggccgaaaaaggcgtttccgggccggtcattacgcttgcgcgctctatcgtgacgcctttcctgcagttctcgccgcgcagggacctgcgtgaaaaggcctttcgggcctgggctgcacgaggggcaaatggcggcgcacatgacaaccgggcgattgcggcagagatcctgtcgctgcgtgaagaacgggccaagctcttgggctataggaattttgcggcctacaagctggaaaccgagatggccaaaacgccggaggcggtgcgtgagctgttgatggatgtctgggggccagccaaggcgcaggcggacaaggacgccgaggtgttgacgcggatgatgcatgaggacggcatcaatggcgatctggcgccttgggattggcattactacgcagaaaaacgtcgcaagatagaacatgatctcgacgaagccgaactcaaaccatacctgcagctcgaccggatgattgaggcggcttttgcctgcgcaaatcgtctgtttggcctggaattcgcacctcttgatgtgccgctttatcacaaggactgccgcgcctgggaggttacgcgggaaggcaagcatctggcggtgtttattggggactatttcgcgcggggatcaaagcggtccggcgcgtggtgttcggctatgcgtgcgcaggcgaaattccccgaggaacagacgccaatcgtggtcaatgtctgcaactttgccaaaggcgacccggcgttgttgtcctatgacgatgcgcgcacgctgttccacgagtttggccatgcgctgcaccagatgctgtcgaatgtaacctatgagagtgtctccgggacctccgtggcgcgcgattttgtggaactcccgagccagctctatgagcattggctggaggtgcccgaggtactgcaggagtttgccacccatgcagagaccggcgcgccgatgccgaaggagatgctcgacaaggtgcttggggctgcgaccttcaacatggggttccagaccgtcgaatatgtggcgtccgcattggtggatctggaatttcatgatggcagcgcacccgaggatccgatggtcaaacaggccgaggttctcgcacagatcggcatgccggcagcgattgtcatgcgccatgctacgccgcagtttgcgcatgttttctcaggcgacgggtactcctcgggctactacagctatatgtggtcagaggtaatggacgccgatgcttttgaatcctttgaggaagccggcggcgcctttgatcctgcacgcgctgcggcgcttgaggcacacattctgtccaaagggggctctgaggatgccgctgagctgtatacggcgttccgggggcgacttccgggggtggacgcgcttttgaaagggcgtgggctggccgccaagtga

SEQ ID NO: 98231 - protein, 671 aa, Silicibacter sp. TM1040
MTNPLLRDWQTPFGIAPFDQISDEDFAPALDEALKAHTAQIDAIATNPAPPTFANVIEALETPCQPLEQVLSVFFSVAGADSNPAREALQRAFSPNLAAHFSAITANKALYARVQAVWDQRDTLDLTDEQARVLMLTHRGFVRGGAALNGAEDTRMQEIKSRLATLGTNFTQNLLADERDWFMELSEDDLEGLPDFVVKAARTAGAEKGVSGPVITLARSIVTPFLQFSPRRDLREKAFRAWAARGANGGAHDNRAIAAEILSLREERAKLLGYRNFAAYKLETEMAKTPEAVRELLMDVWGPAKAQADKDAEVLTRMMHEDGINGDLAPWDWHYYAEKRRKIEHDLDEAELKPYLQLDRMIEAAFACANRLFGLEFAPLDVPLYHKDCRAWEVTREGKHLAVFIGDYFARGSKRSGAWCSAMRAQAKFPEEQTPIVVNVCNFAKGDPALLSYDDARTLFHEFGHALHQMLSNVTYESVSGTSVARDFVELPSQLYEHWLEVPEVLQEFATHAETGAPMPKEMLDKVLGAATFNMGFQTVEYVASALVDLEFHDGSAPEDPMVKQAEVLAQIGMPAAIVMRHATPQFAHVFSGDGYSSGYYSYMWSEVMDADAFESFEEAGGAFDPARAAALEAHILSKGGSEDAAELYTAFRGRLPGVDALLKGRGLAAK

SEQ ID NO: 98232 - DNA, 2064 bp, Polaromonas sp. JS666
  CDS (1)..(2064)
atgaccaatcccctgctcgacttctccgacctcccgctgtttgaccgtatcctgcccgagcatgtgggcccagcggttgacgaattgctggtcaaggcggatgccgcgctggaggaggtgacagcgcccggcttcccggcctcctggaccggcattgcccgtgtgctggacgtggccaccgagaacctgggccgcgcctggggggcggtgagccacctaaacagcgtggccgacacgcccgagttgcgcgccgcctacaacgctgccctgccgcgcgtgaccgaattctggacacgcctgggtgccgatgaacgcctttacgccaaatacaaggccattgatgtggccacgctcaacgccgagcagcgtcaggcccacaaaaacgccatccgcaactttgtgctgtcgggcgcagagctcaccggtgccgccaaggaacgctttgccaaaatccaggaacgccaggccgaactgagccagaaattcagcgaaaacgcactggacgccaccgacgccttcgcctactacgccagcgcggatgaagtggccggcattcctgccgacgtgctgcagaccgcccgcgcgcaggccgaggccgagggcaagcccggctaccgcctcagcctgaagatgccgagctacctgcccgtcatgcagtttgcccacagcagcgcgctgcgtgaaactctctacagggcctacaccacccgcgccagcgaccaggcgccagcggaattcgcccggtttgacaacagcgccgtcatgcgcgaaattcttgcgctccgcctcgaggaagcccagttgctgggttaccggaatttcggcgaagtgtcgatcgtgcccaagatggccaaatcccccgatgaggtcatcggtttcctgcgtgacctggcccggcgcgcccgcccgtatgccgaaaaagacgtcgccgacctgcgcgcatttgcggccgaaacgttgagcctgagcgatccccaatcctgggacttcgcctacattggcgaaaagctcaaggaagcccgctatgccttcagcgagcaggaagtcaaacagtatttcactgcccccaaggtgctggcgggcctgttcaagatagtcgagaccctctttgaagtgactctccgcaaggattccgcacctgtctggacacccggcgtggcgttttatcgcattgaacgcaacggccagctggtaggccagttctacctggaccagccggcccgcaccggcaagcgcggcggggcctggatggacgatgtgcgcgcacgctggctgcgccccgacaacggcaagctgcaaacccccgtggcgcatctggtctgcaattttgccgacggcgtgggcggcaagcctgccctgctgacccatgacgacgcaaccacgctgttccacgaattcggccatggcctgcaccacatgctcacgcaggtcaacgagcgtgacgtttcgggcatcagcggtgttgaatgggatgcggtggagttgcccagccagttcatggaaaacttctgctgggagtgggatgtgctcaaacacatgacatcccatgtcgaaacgggcgaccccctgcctcgcgcgctgtttgaaaaaatgctggcggccaagaacttccagagcgggatgcagacgctgcgccaggtcgagttttcgctgttcgacatgctcctgcacaccgcgcacaacccttcggacaacctgatggacctgctcaatgaagtgcgcagggaagtggctgtgattccggctccgctctacagccgtaccgcacacaccttcagtcatattttttcgggtggctatgcagcgggttattacagttacaaatgggccgaggtgctgtcggctgacgcttatgctgcttttgaagagaccgcggccgcggcgcaagcctcaagcgcgggcgaggccgcaggcacaacgacagtgacggtgcaaacgggtagaaaataccgcgaggccattctggaagccggcggaagccgcccagccatggaatcgttcaaggccttcaggggccgggaaccttccattgacgcattgctgcgtcatcaaggcatgggttag

SEQ ID NO: 98233 - protein, 687 aa, Polaromonas sp. JS666
MTNPLLDFSDLPLFDRILPEHVGPAVDELLVKADAALEEVTAPGFPASWTGIARVLDVATENLGRAWGAVSHLNSVADTPELRAAYNAALPRVTEFWTRLGADERLYAKYKAIDVATLNAEQRQAHKNAIRNFVLSGAELTGAAKERFAKIQERQAELSQKFSENALDATDAFAYYASADEVAGIPADVLQTARAQAEAEGKPGYRLSLKMPSYLPVMQFAHSSALRETLYRAYTTRASDQAPAEFARFDNSAVMREILALRLEEAQLLGYRNFGEVSIVPKMAKSPDEVIGFLRDLARRARPYAEKDVADLRAFAAETLSLSDPQSWDFAYIGEKLKEARYAFSEQEVKQYFTAPKVLAGLFKIVETLFEVTLRKDSAPVWTPGVAFYRIERNGQLVGQFYLDQPARTGKRGGAWMDDVRARWLRPDNGKLQTPVAHLVCNFADGVGGKPALLTHDDATTLFHEFGHGLHHMLTQVNERDVSGISGVEWDAVELPSQFMENFCWEWDVLKHMTSHVETGDPLPRALFEKMLAAKNFQSGMQTLRQVEFSLFDMLLHTAHNPSDNLMDLLNEVRREVAVIPAPLYSRTAHTFSHIFSGGYAAGYYSYKWAEVLSADAYAAFEETAAAAQASSAGEAAGTTTVTVQTGRKYREAILEAGGSRPAMESFKAFRGREPSIDALLRHQGMG

SEQ ID NO: 98234 - DNA, 2319 bp, Caenorhabditis elegans
  CDS (1)..(2319)
atgttccgtaggatacccctcgggaggtttctgacgcgaaaaatccataatcaaaccaatgggctgattgttccaacaacaaatgttcaaaagcaacaaaaacgacagattctgttcaaaatggggaatgagacgccggcgcgagtggttggatattatgttgtatttcccgtaattcccgaggaaaccgtggagaacaactgcttcatgtacaatatcgctaaaaatgaagattggccgaaattggccaccgccgagcccagggaactgtatgaaggaaccgttcgaatgctcatggactacggagccactgtaatggagcacatggagcatcttgcaacgttaccagcagaagagcgaaagtttgaaaacgtcgtagaaccattgcttacggaggaatacgaggtcaatttcgctttccagacacttgtgctgaaaatgctcacggattggcctgattgtaaccgaaaactcttcgatgcggaccttcaccatatcaaaatcatgtgtgcccgcgatcaaatggagaagttaaccaacaaggacttccaggacgccatcaagcagctttatgaggcaaaagatggactttccgagtggcaatcgagactattggagtggtatttgctcgagataaaagcttctggattggacaaacacgacgataaaacgcgtaaggttctcggatcctggagcaaatttgtcgacgagtacaggagcaagtatatcaccggcgtgatgtcaaccaacgatcagcagacatttgtcgtgacggaccaaaaagtgataaaagatgcacctccacatgttttacagaagctcgctgttgatgaacaaaactgggaatcaggaccatggcgtggacgtatgacacctcacacaatctacccatttatgcaatattgtggagatcgtcaattgagagccaccgcatgggagaaatggacgagtaaagctggatttgatcatgatttctacaataattcaatcaatatcgaggagttgagacataataacgaaggactcgccaaaacgcttggatattcatctgttgctgagcaccgacttgcgaataaaatggctgcctcgccggagacagttagaggatttatcaatgctcttcaacgtagaatccggcctgtagtgattgatcgtatggagtcctggtccgcatgggctggacgttgtgagcttatcactggcgagcttcaggcctatgatatgccatatgtgtgcagaaaagaggcagagcatcattatgatgtcaacccactggacctaatgaatcacttcccattctggccaacattccaaaatataatgggagtcatcggacatattttcaatttggaattcaaagatatcaccgataagggactcgaaaaagcgcatgctgacgtccggatctactcggttggcgacaagttcagcggacaacactatggaagattatacattgatccatatgatcgacagaataaacgaggaggatggaatgttatgcttgcgagaccggaatccaaagaacgaggtctcgacaagattgtgtacttcatcggctcagcaattgctccaacttccaacggaccgtctcttctccatcaccagcagcttcagcaacttcttttccattttggccgaagtgtgcagcttcttctatcacaatctccataccgtgatatttcaattccatggtctccattctacgcatctgactgggatgcagctgacatgttcccaacattcttgcaaatgttcgtcacgaagcccaatctccttgcaacaattagctctccgcatcagatcacaaagcaatcgttgaccgaagagcacgcaaactcggtggctcttacgatctcacgagcatcactctgggaaacctaccgtaccctcttctggtcggactttgatctgtcgatttacgagatggaggacaggaagcaaaagttctggctggatatgtacaaacaaatgtatgaggagtatttcccgttcaaaagagccaaaaatgactatcaaccgtgctcattcacaccgatttttgctcttcaaccacatatgagcatgtattataggaagctgtgggctgagatgctcgccttagatatccatgagacatttgacgaggaagacaatgaagtgcaaacgggagaacgattgaaaacgacaatattgaatagaggaagtggagatgttgcgaaggaattgttcaaaagattccagggccgaaatccatcagtcggagccatctgtgatcactacgccccaccaatggccattcaagatgaaatggaaatgtcggagaatcagagacgatga

SEQ ID NO: 98235 - protein, 772 aa, Caenorhabditis elegans
MFRRIPLGRFLTRKIHNQTNGLIVPTTNVQKQQKRQILFKMGNETPARVVGYYVVFPVIPEETVENNCFMYNIAKNEDWPKLATAEPRELYEGTVRMLMDYGATVMEHMEHLATLPAEERKFENVVEPLLTEEYEVNFAFQTLVLKMLTDWPDCNRKLFDADLHHIKIMCARDQMEKLTNKDFQDAIKQLYEAKDGLSEWQSRLLEWYLLEIKASGLDKHDDKTRKVLGSWSKFVDEYRSKYITGVMSTNDQQTFVVTDQKVIKDAPPHVLQKLAVDEQNWESGPWRGRMTPHTIYPFMQYCGDRQLRATAWEKWTSKAGFDHDFYNNSINIEELRHNNEGLAKTLGYSSVAEHRLANKMAASPETVRGFINALQRRIRPVVIDRMESWSAWAGRCELITGELQAYDMPYVCRKEAEHHYDVNPLDLMNHFPFWPTFQNIMGVIGHIFNLEFKDITDKGLEKAHADVRIYSVGDKFSGQHYGRLYIDPYDRQNKRGGWNVMLARPESKERGLDKIVYFIGSAIAPTSNGPSLLHHQQLQQLLFHFGRSVQLLLSQSPYRDISIPWSPFYASDWDAADMFPTFLQMFVTKPNLLATISSPHQITKQSLTEEHANSVALTISRASLWETYRTLFWSDFDLSIYEMEDRKQKFWLDMYKQMYEEYFPFKRAKNDYQPCSFTPIFALQPHMSMYYRKLWAEMLALDIHETFDEEDNEVQTGERLKTTILNRGSGDVAKELFKRFQGRNPSVGAICDHYAPPMAIQDEMEMSENQRR

SEQ ID NO: 98236 - DNA, 2151 bp, Aspergillus fumigatus
  CDS (1)..(2151)
atggctcccgaacatctacgtcggccgccgcaggccccgcccctctttaccgcgactgctcagtccatcgtcgacgatgccaagcgcctcatcgagacatcccgcaaagtgcgagacaacatcgttgcgaatgtcaagcctgagtccgcgactttcgattcggtgctgaagcctctggctcatgatgagaataccatggcgctagaatcccacattctgagcttctaccaggctgtgtcgacggagcaggagctgcgggatgcgtcatccaaggcagaggaattgatggacgagttcttcattgagactgtgatgcgtgaagacgtattcaagctcgtcgatgctgtgctgaagaagaacgagagtctcgaccccgagtcccggagactgctggagaaggaacacaaggattacatccgcaatggcttgggccttccagccggaccgaagcgggatcgcttcaaggagatcaagaagcgtctgagccagattagcattgaattccagaagaacctgaacgaggagaacggtggaatctggttcacgcgcgaggagctcgacggcgtgccagaggacgttctatctggtttgaagaagggcgagggcgagcatgaaggcaagctctggttgaccttcaagtatcccgatctgttcccgaccatgaagtatgcgaagaacgcggagacgcgcaagcggctgatgatcgagaacgagaacaagtgcaaccagaacgtgcctctgttccgggaggccgtcatcctgcgtgatgaggccgctcgtctgcttggataccccaaccacgccgcgttccgcattgaagataagatggctaagaccccaaagacggttgacgacttcttaggagacttgcggtcgcgtctgactgctggagggcacaaagagattaaggctttgttggagctcaagaaagcagatctcgagtctcgcggcgagcccttcgatggccgctactatctgtgggaccaccggttctacgaccgcctcatgctcgagaaggattactcgctggatcagcaactgatcgctgagtactttcccctgcagacgaccattgagggcatgctgaagatattcgaagagctgtttggtcttgttttcgtcgagattaccggtgaggatcgtgaaaaggttgcgcccactggcaagggaagcgacatcgtctggcacgaagatgtccaggtctttagcgtctggaacgacgagggcgagggcagtgggttcgtgggctacctctacttggacctgttcccccgccccggcaagtatggccacgcggccaacttcaatctccagccgggcttcatcgacgctgacggcaagcggcgctacccggccactgcattggtgtgcaatttcaccaagcccacggccaagaaacctagtctcctcaagcacgacgaggtggtgactctgttccatgagcttggacacggaatccacgacctcgtctccaggacgatctactcgcgcttccacgggaccagcactgtccgggactttgttgaagctcccagtcagatgctggagaactggtgctggacaccgtcccagctcaagtccctgagcaagcactactctaccctgtcccctgagtaccttgccggctggcaagaacaggccaacggcaagccccagccgcccgagcgcattcccgacgaaatcatcgagaacctgatccgcaccaagcacgtcaacgacgcgctgttcaacctccgccagctgcactttggcatcttcgacatgacggtgcacgaagctgagagccacgagcagatccagaagctgcccatctccaccacatacaaccagttgcgtaagcagatcgcgctgcaggacggccccgaggtcctaggaatgggcgacgaatggggccacggcgaagcaacctttggccacttgattgggggctatgatgccggatactacggatatctcagctcccaagtatactcgaccgacatgttctacactgtcttcaaggacgatccaatgaacccagccgccggccgcagataccgctacggcgtcctcgagaagggcggcagccaggacgagatgaagaccttgaccgacttcctcggccgcgagcccaagaccgacgccttttacaaggaattgggactggcctag

SEQ ID NO: 98237 - protein, 716 aa, Aspergillus fumigatus
MAPEHLRRPPQAPPLFTATAQSIVDDAKRLIETSRKVRDNIVANVKPESATFDSVLKPLAHDENTMALESHILSFYQAVSTEQELRDASSKAEELMDEFFIETVMREDVFKLVDAVLKKNESLDPESRRLLEKEHKDYIRNGLGLPAGPKRDRFKEIKKRLSQISIEFQKNLNEENGGIWFTREELDGVPEDVLSGLKKGEGEHEGKLWLTFKYPDLFPTMKYAKNAETRKRLMIENENKCNQNVPLFREAVILRDEAARLLGYPNHAAFRIEDKMAKTPKTVDDFLGDLRSRLTAGGHKEIKALLELKKADLESRGEPFDGRYYLWDHRFYDRLMLEKDYSLDQQLIAEYFPLQTTIEGMLKIFEELFGLVFVEITGEDREKVAPTGKGSDIVWHEDVQVFSVWNDEGEGSGFVGYLYLDLFPRPGKYGHAANFNLQPGFIDADGKRRYPATALVCNFTKPTAKKPSLLKHDEVVTLFHELGHGIHDLVSRTIYSRFHGTSTVRDFVEAPSQMLENWCWTPSQLKSLSKHYSTLSPEYLAGWQEQANGKPQPPERIPDEIIENLIRTKHVNDALFNLRQLHFGIFDMTVHEAESHEQIQKLPISTTYNQLRKQIALQDGPEVLGMGDEWGHGEATFGHLIGGYDAGYYGYLSSQVYSTDMFYTVFKDDPMNPAAGRRYRYGVLEKGGSQDEMKTLTDFLGREPKTDAFYKELGLA

SEQ ID NO: 98238 - DNA, 2088 bp, Oryza sativa
  CDS (1)..(2088)
atgtctctccggaggcgggagcgccgggtcatcgccgcggccggcgcggcggcgctcgtcgccgtcggcctcaacctcgccttctccgccgtcgccgcccaccgccgcaggaagcggcgagagctcccagggtttactgcgcaagtcaacctctcagctgctgacatcaagagattagctgatcgcgtcgtttctaagtcgaaggaaacatacgacgctgtggctgcggttcccctagataaagtcagcttctctaatgtcattgcacctctggcggaattagatgctcagcagttcccactggttcaagcctgtgtgcttcctagaatggtctcaccgtctgatgatgtacgaagggccagtgcagaagcagagaaacgattggattctcacttccagcagtgcaggcagcgtgaagatgtgtatcgtgtcataaaggcattcacacagaaaggtgaaagaataggccttgaagcaacaagatttgtccagtgcatggtaagagagtttgaacgcaatggtgctaaactaactcaaagcaagaaaacggagatggagaaactgaaatctcacattgatgacttaagtttgaagtatattcaaagcttaaatgattccacaaaatttcttctattgaacgaggaagacctggctgggatgccactagagttcttaaaggaactggaaaatacaaatgggaagtggaaggttctgctgaccagttatcatgttactccaattcttgagcattgcaaggttggctctaccaggaaactgattgctgttgcttatggccagaaaggtggaaaagagaatatagccatcctggaaaaattggtccagctaagacaccggcttgctagattgctggggtatcccaattatgctgattatgctattgaacctagaatgccgaggacgtcaaggaaggtcttggagtttttggaggagatgtcagaacaattaaatggcctagctaatagggagctcagcgtactcaaagatctgaagatggaggaggagggtgatgctcaatttagcgtggaagacctgttatactacatgaaaagagctgaggagctcaaggttgatcttgatattggtgaaattaaacaatttttccctgttgacctggtcatatcaggaatattgaagatgtttcaagatctgtttgcactgcgatttgaggaaatgaaggatgctgagacttggcacgatacagttcgtctcttttctgtctgggatgcaagttcaagtgatcttttgggttacttttttctggatatcttttccagggaaggaaaatatgcacatacctgcgtcgtggcacttcagaatagatgcctgtgttctaatggcacaagaaaggttccagttgcagttctattgtctcaatgcccgaaagagtttgatgggaattcagcactgctgaggttcccagaagttgtaaggatattccatgaattcagtcatgtggtccatcatatctccaacagagccaccttttctagattttcgggtcttcaactggagggggattttgctgaaattccaagtctgttacttgagaattggtgctatgagaacatttctctaaaaatgatgtctggcttccatcaggacattacgaagtctatcactagtgaggcttgccaatcactgaaaagaaggcgtgacatatttgctggcctgaaactgaaacaagagatccttttgtgccttgttgatcagataatacatacaggcgaaaatgtgaacattgatgacttaatcaaggatcttcatccaaaggtaatgctaggtatacctttgttggaagggaatagcccagcttcatgttttccacgtattgctattggctatgatgctgtgtgctacagttacatatggagtgaggtgtttgcggctgatctgtttgcatcaaaatttaaagacgacttgctaaatcagcatgcggggttgcggtttagaaataaggtattggctccaggaggctcgaaaaatccccttgatatcatatctgactaccttggacgagaaccatcattgcaagctttcattcagagccgaacgaggaacagtctgtga

SEQ ID NO: 98239 - protein, 695 aa, Oryza sativa
MSLRRRERRVIAAAGAAALVAVGLNLAFSAVAAHRRRKRRELPGFTAQVNLSAADIKRLADRVVSKSKETYDAVAAVPLDKVSFSNVIAPLAELDAQQFPLVQACVLPRMVSPSDDVRRASAEAEKRLDSHFQQCRQREDVYRVIKAFTQKGERIGLEATRFVQCMVREFERNGAKLTQSKKTEMEKLKSHIDDLSLKYIQSLNDSTKFLLLNEEDLAGMPLEFLKELENTNGKWKVLLTSYHVTPILEHCKVGSTRKLIAVAYGQKGGKENIAILEKLVQLRHRLARLLGYPNYADYAIEPRMPRTSRKVLEFLEEMSEQLNGLANRELSVLKDLKMEEEGDAQFSVEDLLYYMKRAEELKVDLDIGEIKQFFPVDLVISGILKMFQDLFALRFEEMKDAETWHDTVRLFSVWDASSSDLLGYFFLDIFSREGKYAHTCVVALQNRCLCSNGTRKVPVAVLLSQCPKEFDGNSALLRFPEVVRIFHEFSHVVHHISNRATFSRFSGLQLEGDFAEIPSLLLENWCYENISLKMMSGFHQDITKSITSEACQSLKRRRDIFAGLKLKQEILLCLVDQIIHTGENVNIDDLIKDLHPKVMLGIPLLEGNSPASCFPRIAIGYDAVCYSYIWSEVFAADLFASKFKDDLLNQHAGLRFRNKVLAPGGSKNPLDIISDYLGREPSLQAFIQSRTRNSL

SEQ ID NO: 98240 - DNA, 2115 bp, Pongo pygmaeus
  CDS (1)..(2115)
atgatcgcccggtgccttttggctgtgcgaagcctccgcagagttggtggttccaggattttactcagaatgacattaggaagagaagtgatgtctcctcttcaggcaatgtcttcctatactgtgactggcagaaatgttttaagatgggatctttcaccagagcaaattaaaacaagaactgaggagctcattgtgcagaccaaacaggtgtacgatgctgttggaatgctcggtattgaggaagtaacttatgagaactgtctgcaggcactggcagatatagaagtaaagtatatagtggaaaggaccatgctagactttccccagcacgtatcctctgacaaagaggtacgagcagcaagtacagaagcagacaaaagactttctcgttttgatattgagatgagcatgagaggagatatatttgagaggattgttcgtttgcaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagatagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccattgcgggccaaggttgccaaactactcggttatagcacacatgctgactttgtccttgaaatgaacactgcaaagagcacaagccgcgtaacagcctttctagatgatttaagccagaagttaaaacccttgggtgaagcagaacgagagtttattttgaatttgaagaaaaaggaatgcgaagacaggggttttgaatatgatgggaaaatcaatgcctgggatctgtattactacatgactcaaacagaggaactcaagtattccatagaccaagagttcctcaaggaatacttcccaattgaggtggtcactgaaggcttgctgaacacctaccaggagttgttgggactttcatttgaacaagtgacagatgctcatgtttggaacaagaatgttacactttatactgtgaaggataaagctacaggagaagtattgggacagttctatttggacctctatccaagggatagaaaatacaatcatgcggcctgcttcggtctccagcctggctgccttctgcctgatggaagccggatgatggcagtggctgccctcgtggtgaacttctcacagccagtggcaggtcgtccctctctcctgagacacgatgaggtgaggacttacttccatgagtttggtcacgtgatgcatcagatttgtgcacagactgattttgcacgatttagtggaacaaatgtggaaactgactttgtagaggtgccatcgcaaatgcttgaaaattgggtgtgggacgtcgattccctccgaagactgtcaaaacattataaagacggaagccctatttcagacgatctgcttgaaaaacttgttgcttctaggctgatcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattacggatatctttggagtgaagtattttccatggatatgttttacagctgttttaaaaaagaagggataatgaatccggaggttggaatgaaatacagaaacctaatcctgaaacctgggggatctctggacggcatggacatgctccacaatttcttgaaacgtgagccaaaccaaaaagcgtttctaatgagtagaggcctgcatgcttcgtga

SEQ ID NO: 98241 - protein, 704 aa, Pongo pygmaeus
MIARCLLAVRSLRRVGGSRILLRMTLGREVMSPLQAMSSYTVTGRNVLRWDLSPEQIKTRTEELIVQTKQVYDAVGMLGIEEVTYENCLQALADIEVKYIVERTMLDFPQHVSSDKEVRAASTEADKRLSRFDIEMSMRGDIFERIVRLQETCDLGKIKPEARRYLEKSIKMGKRNGLHLPEQVQNEIKSMKKRMSELCIDFNKNLNEDDTFLVFSKAELGALPDDFIDSLEKIDDDKYKITLKYPHYFPVMKKCCIPETRRRMEMAFNTRCKEENTIILQQLLPLRAKVAKLLGYSTHADFVLEMNTAKSTSRVTAFLDDLSQKLKPLGEAEREFILNLKKKECEDRGFEYDGKINAWDLYYYMTQTEELKYSIDQEFLKEYFPIEVVTEGLLNTYQELLGLSFEQVTDAHVWNKNVTLYTVKDKATGEVLGQFYLDLYPRDRKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPISDDLLEKLVASRLINTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAS

SEQ ID NO: 98242 - DNA, 2142 bp, Homo sapiens
  CDS (1)..(2142)
atgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctagcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataa

SEQ ID NO: 98243 - protein, 713 aa, Homo sapiens
MLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPSMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 98244 - DNA, 2022 bp, Aeromonas hydrophila
  CDS (1)..(2022): transl_table=11
atggactcgctgccccctttcagccagatccagcccgatcaggtccagcctgccgtgacgcaggccatcgctgattgcaaacagaagatcagcgatgtgctgggccagcgcgacccgcacacctgggacagcctgatcgccccgctggaagaggtcaacgaccgcctggcgcggatctggtcgccagtcagtcacctcaactccgtactcaacagcgaagcgctgcgcgcggcccacgacgcctgcctgccgctgctgtctgaattccagacctatgtcggccagcacgaggggctctatcaggcctatcgcgaactggccgagagcgacgacttcccgctgctgagcggcgcccagcgcaaggagatccagaacaccctgcgcgattttcgtctgtccggtatcggtctgcccgccgaggcgcagcagcgctacggcgagatccaggcccgcctctccgagctggcttcccgcttcagcaacaacgtgctggacgcgacccagggctggaacaagctggtgaccgacgaggccgagctggccggtttgccgcagagcgcacaggccgccgcccgccagctggccgagctgaagggcaaggagggctggctgttcaccctggacatcccctcctacctgccggtgatgatgtatgccgacaaccgtgcgctgcgtgccgagctgtatgaggccttcaccacccgcgcctcggatcagggccccaacgccggcaagtgggacaactccgccatcatgaccgagctgcttgccctgcgccgcgagctggcccaactgctcggctttgccaactacgccgagctctccctggccaccaagatggcggacaagcccgagcaggtggtgaacttcctcaccgatctggcggccaagtctctgccgcagggcaaggccgagctggaagagatccgcgccttcgccgccgagcaacacggtcagcgcgagctggccgcctgggatctcgcctactacgccgagaagctcaagcagcacaagttctccatctccgacgagcagctgcgtccctacttccccgccagcaaggtggtgaaggggctgttcgaggtggtcaagcgggtgtttggcatgaaggtgcgcgagcgcctcggcatcgacacctggcacccggacgtgcgcttctacgacatcttcgacgccgaggacgagctgcgtggcagcttctacctcgacctctatgcccgcgagcacaagcagggcggcgcctggatggatgtctgcctgggtcgtcgctaccgtcaggatggatccttgcaaaagccggtggcctacctgacttgcaacttcaacggtccggtggacggcaaacccgccctgttcacccacaacgaagtggtcaccctgttccacgagttcggccacggcattcaccacatgctgacccgtatcgacgtggccggcgtggccggtatcaacggcgtggcctgggatgcggtggagctgccgagccagttcctcgagaactggtgctgggagtccgaggcgctggccttcatctccggccatcacgagaccggcgagccgctgcctgccgatctgctggagaagatgctgaccgcccgcaacttccaggcggcgatgcagatgctgcgccagctggagttcgccctgttcgacttccgtctgcaccaggagtttgacccggccagcgcggatcagatcccggcgctgctggatgaggtgcgcagccaggtggcggtgatgacgccgccggcgttcaaccgcttccagcacagcttctcccacatcttcgccggcggttatgcggcgggctactacagctacaagtgggccgaggtgctctctgcggatgccttctcccgcttcgaggaggaggggatcttcaacccggccaccggtcagtccttcctgaagaacatcctggaaaagggtggctccaaggagccgatggagctgttccgagccttccgtggccgcgagcctcaggtggatgcgctgctccgtcacagcgggattgccgcgtga

SEQ ID NO: 98245 - protein, 673 aa, Aeromonas hydrophila
MDSLPPFSQIQPDQVQPAVTQAIADCKQKISDVLGQRDPHTWDSLIAPLEEVNDRLARIWSPVSHLNSVLNSEALRAAHDACLPLLSEFQTYVGQHEGLYQAYRELAESDDFPLLSGAQRKEIQNTLRDFRLSGIGLPAEAQQRYGEIQARLSELASRFSNNVLDATQGWNKLVTDEAELAGLPQSAQAAARQLAELKGKEGWLFTLDIPSYLPVMMYADNRALRAELYEAFTTRASDQGPNAGKWDNSAIMTELLALRRELAQLLGFANYAELSLATKMADKPEQVVNFLTDLAAKSLPQGKAELEEIRAFAAEQHGQRELAAWDLAYYAEKLKQHKFSISDEQLRPYFPASKVVKGLFEVVKRVFGMKVRERLGIDTWHPDVRFYDIFDAEDELRGSFYLDLYAREHKQGGAWMDVCLGRRYRQDGSLQKPVAYLTCNFNGPVDGKPALFTHNEVVTLFHEFGHGIHHMLTRIDVAGVAGINGVAWDAVELPSQFLENWCWESEALAFISGHHETGEPLPADLLEKMLTARNFQAAMQMLRQLEFALFDFRLHQEFDPASADQIPALLDEVRSQVAVMTPPAFNRFQHSFSHIFAGGYAAGYYSYKWAEVLSADAFSRFEEEGIFNPATGQSFLKNILEKGGSKEPMELFRAFRGREPQVDALLRHSGIAA

SEQ ID NO: 98246 - DNA, 2124 bp, Oryza sativa
  CDS (1)..(2124)
atgaatcaactgagtgcctccgcaatgctctcccgcgcagcctctctccgccgcgccgcggcggcggccttctccaccgccgcggcgaggccggagaccgggctgtacggcttcgatgtgctgcgcacggccaagggcttccgccgcttcgtcgacgacgccatcgagaggtcggacgagctcgtggcctacatcgggcagctgccgccgtccgcggagattgtccgcgccatggatgagatatcgaacactgtctgctcagttattgattcggcagagctgtgcaggaatacgcacccagataaggaatttatggatgaggcagataaggcatcaatgaggatttatgaacatcttcaatatctgaataccaatactactttgtacaatgcaatacttaaagctgagagcgaaggtgtcatgctcacagaggaagctcgaagggcagccaccaccttgcgtgttgactttgagaaagggggaattcatcttcctaaagataaactcgaacatgttaatcatctgaaccttgagattgcccagctgggtcgaaagttcagtgaaaatgttatgaacaaaccaggttttgtggatatatatccagcttcgcgcattccaagaaatatgcaacgccattttaaatccattcaccgtattaaaccttggggcgatgaggaacaaagaaatcaaatggacactacaaagcaaaagggtctaaggatagtcactgattcaggaactctatcaacagcactgagatgggtctcagatgaggaaatcaggaaacaggtatacctggtaggaaactctgaacctcgtgaaaacattacagttcttggcaagcttataaatgcacgtgacgagcttgcgaagactatgggatgcaaatcatatggtgattttgctattcgtcctaacatggctgcatctgtagatgtcgtgatgtcatttctcaaagatttgagtggcgtggttaggcataaagctggtgaggaatttaaacgtatacaggacttcaagagaaatgtatgcaatgaaaagagtgctaaacttgaaccctgggatgaggattacttcattggaatgatgaaatcagctgtacataacctggatgtctcagtggttgcagcatactttccattgtcccagtgcctaaagggcttaaacgtgctggtggaatcattatttggtgccacatttcatcaaattcctatgggggacggcgagtcatggcatccagatgtgatgaagttgtctctccatcatcctgatgagggcaatttaggatttatgtatcttgatctgtactccagaaagggtaaatatccagggtgtgctcactttgctatcagaggggggcgacgattgcaagactcaaattaccagcttccaatcgttgctctagtttgcaatttttcaagttcgagcaaaataatggcaaggcttaaccattgggatgttgaaactctgtttcatgagtttggccatgcccttcattctctactctcaagaacggagtatcaacatttctctggtactagagttgctcttgatgtggctgaaatgccatcaaacctctttgagttttatgcatgggattatcgtgtcttgaggaaatttgctgtagatgaaacaactggtgatccaataccagaaaagttggtaaaggcacttaatgcttctcggaacatgtttccagcaacggagctgcagcgtcagattttctattctataatggacttgactttgtttggggagcaaggatccaagccaatggacacaatttctactgtagctgatttgaggagaaagcatacaagttggaaatgtgtagaaggcacacactggcatactagatttactcatctgataaattatggcgctggctactatagttatctttatgctagatgttttgccacaactatatggcaagaagtatgccaaggtgatccattatcccgcagcacgggtagtgcacttagggacaaatttttgaagcatggtggagctaaggatccttctgccctgttaaaggatttcgtaggtgattccattattataaactctggaggaggaataatccctgacattagctccttgtgtaaagaagtcggtttgtga

SEQ ID NO: 98247 - protein, 707 aa, Oryza sativa
MNQLSASAMLSRAASLRRAAAAAFSTAAARPETGLYGFDVLRTAKGFRRFVDDAIERSDELVAYIGQLPPSAEIVRAMDEISNTVCSVIDSAELCRNTHPDKEFMDEADKASMRIYEHLQYLNTNTTLYNAILKAESEGVMLTEEARRAATTLRVDFEKGGIHLPKDKLEHVNHLNLEIAQLGRKFSENVMNKPGFVDIYPASRIPRNMQRHFKSIHRIKPWGDEEQRNQMDTTKQKGLRIVTDSGTLSTALRWVSDEEIRKQVYLVGNSEPRENITVLGKLINARDELAKTMGCKSYGDFAIRPNMAASVDVVMSFLKDLSGVVRHKAGEEFKRIQDFKRNVCNEKSAKLEPWDEDYFIGMMKSAVHNLDVSVVAAYFPLSQCLKGLNVLVESLFGATFHQIPMGDGESWHPDVMKLSLHHPDEGNLGFMYLDLYSRKGKYPGCAHFAIRGGRRLQDSNYQLPIVALVCNFSSSSKIMARLNHWDVETLFHEFGHALHSLLSRTEYQHFSGTRVALDVAEMPSNLFEFYAWDYRVLRKFAVDETTGDPIPEKLVKALNASRNMFPATELQRQIFYSIMDLTLFGEQGSKPMDTISTVADLRRKHTSWKCVEGTHWHTRFTHLINYGAGYYSYLYARCFATTIWQEVCQGDPLSRSTGSALRDKFLKHGGAKDPSALLKDFVGDSIIINSGGGIIPDISSLCKEVGL

SEQ ID NO: 98248 - DNA, 2139 bp, Saccharomyces cerevisiae
  CDS (1)..(2139)
atgcgattgttgctgtgcaagaattggtttgcgtcacctgtaatctcaccactactgtatacccgctccttatattcgatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcaccttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaggatgttaagaaacttaaccagggtgcagatccaaactactacatttgggaccaccgttactacgataacaaatatttgttagaaaacttcaatgtggacctagaaaagatttctgaatattttccaccagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaa

SEQ ID NO: 98249 - protein, 712 aa, Saccharomyces cerevisiae
MRLLLCKNWFASPVISPLLYTRSLYSMANTTSFPIAPQAPPNWSFTPSDISGKTNEIINNSNNFYDSMSKVESPSVSNFVEPFMKFENELGPIINQLTFLQHVSSDKEIRDASVNSSMKLDELNIDLSLRHDIFLQFARVWQDVQSKADSVERETFKYVEKSYKDYIHSGLELDEGNRLKIKEIKKKISVNSINFSKNLGEQKEYITFTKEQLEGVPDSILTQFETIKSDKDSNETLYKVTFKYPDIFPVMKLASSAQTRKQAFLADQNKVPENEAILLDTLKLRDELASLLGYDTYANYNLYDKMAEDSTTVMNFLNDLKDKLIPLGRKELQVLQDMKAEDVKKLNQGADPNYYIWDHRYYDNKYLLENFNVDLEKISEYFPPEATITGMLEIYETLFNLKFIETKDSQNKSVWHDDVKQIAVWNMDDPKSPNFVGWIYFDLHPRDGKYGHAANFGLSSSFMIDDTTRSYPVTALVCNFSKSTKDKPSLLKHNEIVTFFHELGHGIHDLVGQNKESRFNGPGSVPWDFVEAPSQMLEFWTWNKNELINLSSHYKTGEKIPESLINSLIKTKHVNGALFTLRQLHFGLFDMKVHTCKDLQNLSICDTWNQLRQDISLISNGGTLSKGYDSFGHIMSDSYSAGYYGYLWAEVFATDMYHTKFAKDPLNAKNGIQYRDIVLARGGLYDINDNLKEFLGREPSKDAFLKELGLQN

SEQ ID NO: 98250 - DNA, 2232 bp, Trypanosoma brucei brucei
  CDS (1)..(2232)
atgtgttcttgtttagtctcctcttgggatttgttgatcggttcttttctttcacctgtttcctgtttcatacttttattaacataccaacttgatcccaccactttttggcgtgcatgtgtgcgtttgtactactttgttccaaagaattctacacacttatctaaggggttgatgacgtcgagactgtttgcggatatcgttgatgcaagcaaatgtgctaagtttttccctaagaccccttctgcggttcaagaggtcgcagctgaggcaaagaggagggcactggagaaacttgaaagaatttattccctttccagtgcgtctcgaacattcttaaatacggcctctgtagcagacgttgctgcggcggagattggcgtgtcagcttctttgctttccgttgcgatgaacgtttctcctgacgaggccacacggcaggaagcgaaacagcaaatggttgatctacaatcgttttcaattgatctctttgaatcaaacaagcgtctttttgaatcacttaaagccgtttctcaaagtaatacatacagggatgaatatgtaaatggcgggcgggacagggagtattcatattggctcgatgaggaacttaagggttacaagcgaaaaggaatggagctaccggacagcgaattggagaaagttgtgtcgcttcaaaaggaactttcatctttatgtacaactttttctcggaacataagtgaggacaaaagcgagattgttgtctcagctgaggagttggcaggagtacctgaaaacgttgtaagtggtctcagtaagactaaggatggattgtttgtcttaaaaatggattatccgacccttttttcagtgatgaaaatttgtgaagtcgcctctactcgtcgggaaatgtcgcgtgccgcgagcaacaaggcttatcctgaaaatttatgtgttctcagagagattgtcacgaagcggcagaaactggcggagcttctcaaattttcttccttcagcgaacttaatcttgacgacaagatggtcaaatctcctgaggcagcgcgagcatttatcgatgacctcgtcccgcgcttgcaggagaagtggaaatcggagcttgagctaatactaagaaatttacacagcagctgtgctctgactgaagatggaaggctcagggactatgatgtgccgtttatgattaatcaggttaaaaaattcaaattcaacgtcagtgagacggatcttcaggagtactttcctcttgacacaaccgtgaaaggactctttgatatatatgaaagatttttcgatgttacctttacccgcgttgataacggtgacgagctttggcataaggacgcatttacgcttcatgtgttaaacaataaaacaaaggacacactgggccatgtggtgcttgatttatttcctcgtgagggtaaattttcacacgcctgttgtatctctgttgttcctcccgttttgttggagggctctgagagcaagttttctcctgcgttatccgtggttcttgccaatttccctgcaccgtccgccgaacgtccgtctctttttcttcatgatgatgtggttacctttttccatgagtttggacacgctattcattctctctttggacggagtaaaatggctacgtttgcgggtacccgcgtgaagagggacttcgtcgaacttccatcgcagatgcttgaagaatgggtttgggaagttgatattctcaggaatatatcttgccattacaaaacaaaagagaagttacctactgaacttgttgaatcaaaggttaacacccgaaatactttcagtggtcgggattccctaagacaactggagtttgcttcgtattctctggagttgttcagtgccccatttgccagagtgaaggacataaaggagatggacacttctgcacttatggctgacattcgcagccgaataaatccacacattaagtatgatgatgaaactcactttgaatgcagtttcggccaccttaccggctacggagctggatactacggttacatgtggtccaaggtgtttgctcttgatgtgtatgactttatcaagaataatgggggtttattgaaccctgccgtaggggagagatatgtttctgaaataattggtgtgggaggtggaaaagatccaagtgagatgctgagaaacttcctcgggagagaaccaagcagcgacgcttttttcaaaagccttggtgtataa

SEQ ID NO: 98251 - protein, 743 aa, Trypanosoma brucei brucei
MCSCLVSSWDLLIGSFLSPVSCFILLLTYQLDPTTFWRACVRLYYFVPKNSTHLSKGLMTSRLFADIVDASKCAKFFPKTPSAVQEVAAEAKRRALEKLERIYSLSSASRTFLNTASVADVAAAEIGVSASLLSVAMNVSPDEATRQEAKQQMVDLQSFSIDLFESNKRLFESLKAVSQSNTYRDEYVNGGRDREYSYWLDEELKGYKRKGMELPDSELEKVVSLQKELSSLCTTFSRNISEDKSEIVVSAEELAGVPENVVSGLSKTKDGLFVLKMDYPTLFSVMKICEVASTRREMSRAASNKAYPENLCVLREIVTKRQKLAELLKFSSFSELNLDDKMVKSPEAARAFIDDLVPRLQEKWKSELELILRNLHSSCALTEDGRLRDYDVPFMINQVKKFKFNVSETDLQEYFPLDTTVKGLFDIYERFFDVTFTRVDNGDELWHKDAFTLHVLNNKTKDTLGHVVLDLFPREGKFSHACCISVVPPVLLEGSESKFSPALSVVLANFPAPSAERPSLFLHDDVVTFFHEFGHAIHSLFGRSKMATFAGTRVKRDFVELPSQMLEEWVWEVDILRNISCHYKTKEKLPTELVESKVNTRNTFSGRDSLRQLEFASYSLELFSAPFARVKDIKEMDTSALMADIRSRINPHIKYDDETHFECSFGHLTGYGAGYYGYMWSKVFALDVYDFIKNNGGLLNPAVGERYVSEIIGVGGGKDPSEMLRNFLGREPSSDAFFKSLGV

SEQ ID NO: 98252 - DNA, 2046 bp, uncultured bacterium
  CDS (1)..(2046): transl_table=11
atgaccacacccaacccactgctcgacacctccggcctgccgcccttctcgaccatccagccggcccacgtcacgcccgccgtggacgtgctgctgaaggaagccgaagcagccttggacaaggtcaccggcccggacgtgcctcctgactacgacaccctctcgctgctgctggacgtggccacagaacgcctgggccgcgcctggggtgccgtcggccacctcaatgccgtggccgacacgcccgaaatccgcgccgcctacaacgagaacctgccccgcctgaccgagttctacacgcgcctgggcgctgacgagcgcctctacgccaagtacaaggccctgtcgctcacgcctgagggccagcgcctgagccccgcccgccaccgcgcgcttgacaatgccctgcgcggcttcgtgctgggtggcgccgagctgcaaggcgatgccaagaagcgcttcgccgagatccaggaaaagcaggccgaactgtcgcaagcgttttccgagcacgtgatggacgcgaccgacgcctacagctactacgccaccgccgacgaactggccggcgtgcccgccgacgtggtcgaagctacacgcgccgccgcgcaagccgaaggcaaggaaggccacaagctgaccctgcacatgccctgctacctgccggtcatgcaatacgccacccaccgccccttgcgcgaaacgctctaccgcacctacgccacccgcgccagcgaaaccggcccggccgaacgcgacaacaccgcgctgatccagcagatcatcgccctgcgccaggaagaatccgccctgctcggctacgccagcttcgccgacgtgtccctggtgcccaagatggcgaccagcccgcagcaggtcaccgatttcctgcgcgacctggcccgccgtgcccgcccctatgccgagaaggacatggcagagctgcgcgatttcgcccgcaccgaactgaacctgtccgacctgcaatcctgggacatcgcctttgccagcgaaaagctcaaggaagcccgctacgccttcagcgaccaggaagtcaaacagtacttcaccgagcccaccgtgctcgccggcctgttcaagctgatcgaaaccctgttcgatgtgaccctgaagcccgacagcgcccccgtctggcacgagtcggtgcgcttcttccgcatcgaacgcgccggcaacctggtcggccagttctacctcgatctgtatgcgcgctccggcaagcgccccggcgcctggatggacgacgtgcgcggccgctgggctcgcccggatacccaccagactcagacccccgtggcgcacctggtctgcaacttcgcttcgggcgtgggcggcaaaccagccttgctcacgcacgacgacgtgaccaccctcttccacgaattcggccacggcctgcaccacatgctgaccaaggtggacgacatcggcgtctcgggcatcagcggcgtcgagtgggacgcggtggagttgcccagccagttcatggaaaatttctgctgggagtgggacgtggttcagcagttgaccagccacgtggacaccggcaagcccctgccgcgcgagctgttcgacaagatgaacgccgccaagaacttccagagcggcatggccaccttgcgccaggtggaattctcgctgttcgacatgcgcctgcatgccgaggctggcgccgaccagcgcgtccaggccatcgtcgacgaagttcgccaggaagtcgcggtcaacatcccaccggcgttcaaccgctttcaacacagcttttcacacatctttgcaggcggctatgctgcgggctattacagttacaagtgggccgaggtgttgtcggcggatgcgtatgccgcttttgaagaggccgcgtccggtcaagacggcgtgctgaaccaggaagtgggccgccgttaccgggaggccatcctggaagccggtggcagccgatcggccatggacaacttcaaggccttccggggccgcgagcccagcatcgacgcccttttgcgccaccaaggcatgagcagctga

SEQ ID NO: 98253 - protein, 681 aa, uncultured bacterium
MTTPNPLLDTSGLPPFSTIQPAHVTPAVDVLLKEAEAALDKVTGPDVPPDYDTLSLLLDVATERLGRAWGAVGHLNAVADTPEIRAAYNENLPRLTEFYTRLGADERLYAKYKALSLTPEGQRLSPARHRALDNALRGFVLGGAELQGDAKKRFAEIQEKQAELSQAFSEHVMDATDAYSYYATADELAGVPADVVEATRAAAQAEGKEGHKLTLHMPCYLPVMQYATHRPLRETLYRTYATRASETGPAERDNTALIQQIIALRQEESALLGYASFADVSLVPKMATSPQQVTDFLRDLARRARPYAEKDMAELRDFARTELNLSDLQSWDIAFASEKLKEARYAFSDQEVKQYFTEPTVLAGLFKLIETLFDVTLKPDSAPVWHESVRFFRIERAGNLVGQFYLDLYARSGKRPGAWMDDVRGRWARPDTHQTQTPVAHLVCNFASGVGGKPALLTHDDVTTLFHEFGHGLHHMLTKVDDIGVSGISGVEWDAVELPSQFMENFCWEWDVVQQLTSHVDTGKPLPRELFDKMNAAKNFQSGMATLRQVEFSLFDMRLHAEAGADQRVQAIVDEVRQEVAVNIPPAFNRFQHSFSHIFAGGYAAGYYSYKWAEVLSADAYAAFEEAASGQDGVLNQEVGRRYREAILEAGGSRSAMDNFKAFRGREPSIDALLRHQGMSS

SEQ ID NO: 98254 - DNA, 2322 bp, Coprinellus disseminatus
  CDS (1)..(2322)
atgctcggtcgagctgcgtgcaaagttcttcacagacatgctctgaagaatccatatcgtttccggggctgcctggtagcccagaaggaaacaacgcgacagctcgcgacacatgttcagcaccatttaccagcttcagcagatgaccggctgcttgtcgacctgtttgaccaaccaggagcgtcaacgtcgaaatcctccttcgcttcgacaggccttttcggtcaccccacgctcacgcacccaggggcactcatatctctggccgaagcaactctcgtacgagcgcaactgctgacggaacgaatactacgggcgagggaatcgagagatgaactagtgaaggtcgtcaagaacttggatcgtctcagcgacatgctctgtggagtcattgacctcgcagaacttgttcgaaacgctcatccagaacgactttggatggaagctgcgaatcacgcgtacgaaaccctatgtgaatttatgaacgttttgaatacccatgttgggctctatgaagttctcaaggtggtcctttcggatccgtccatagtcaaaacgctaagtccagaagcgtatcaaactgcactcatcttttggcgcgacttcgagaaatctgctatcgatttaccccctgctgaacgccagaaatttgtttctttgtcctctgatatcctttcactcggccgccagttcttggaaaatgccaacactccccgtccccccacctcaatcaaagcatcccacttggcaggattgaaggaccagggaatgggtgtacgactgcagctccaagcccggtttaccaaaaaggatttgcaagtctaccctgggtccctgcaggctcagatgatcatgcgttcggctccagaagaggaacctcgcaggcgaatatacattgcttctaattcgagcacaccggagcagatctcagttctagaagccctcctacgcaaaagggcagaacttgcccaattgattggccgacctagtttcgctcatttaactctagacgataagatggccaagacgccagagaacgtatccaacttcctagacgcactgatggaccatacacgaccatttgctcgacgagctctgcacaccttggcacagagaaagcaggctcaccacaacctaccctcgttacccgttgttcaagcatgggaccgcgacttctactgtccccctgacccccctgctcctcctatacccctcccacccctgactctcggcacagtgttcatgggcctctcacgactattccgtcatctgtacggtgtctctcttcggccagcaaagtccgcctcgggcgagacttggcatgctgacgttcagaagctcgaagttgtggacgagaaccagggcatcattggatggatttatgcagacttgtttgcgaggagaaataaagctagtggggctgcacactatactgtacggtgctcgaggcgtgccgatgacgatgacgaggctggagacctgacgttggaaggagaggggcatcggatccaggagtcacaggcatttgagtcggtgaagaggcacaggctccctaaccaggacggcgtatatcagctgccactggttgtgcttctcactgagtttgcgaggccttcaatatctcggggacctacggtgctggagtggtacgaggttcttaccctgttccatgagatgggacacgcaatgcattccatgcttggtcgcaccgagtaccagaacgtctccgggacgcgctgtgcaaccgattttgtggagctcccttcaattcttatggaacacttcctcaactcacccactgttctctcactctttgacgcggacagcactaccaccctgcgggcaactgggaacaaccacgcagatccatgccattccatcgacacatattcccagattctgctcgccgctgtggatcaacgataccactccccttccgccctcgacccctccttcgattcgacagctgaacttgcaaacttacacaacactcggggtctgatgccgtatgtgccagagacgtccttccagacccagtttgggcacctttttggatacggtgcgacatactattcctacctcttcgaccgagcaatcgcatcccgggtgtggtcgaaggtctttgctgagaacccgctggataggagcaggggagaaaggttgaggggtgaagtgttgatgcatgggggagcgagggatccttggcatatggttagcgcattgatgaagatgccagagctcgagagtggggatgctgaggcgatgcgggaggttgggaagtggaggattgaggatgaggttgggatatccgggaggcattga

SEQ ID NO: 98255 - protein, 773 aa, Coprinellus disseminatus
MLGRAACKVLHRHALKNPYRFRGCLVAQKETTRQLATHVQHHLPASADDRLLVDLFDQPGASTSKSSFASTGLFGHPTLTHPGALISLAEATLVRAQLLTERILRARESRDELVKVVKNLDRLSDMLCGVIDLAELVRNAHPERLWMEAANHAYETLCEFMNVLNTHVGLYEVLKVVLSDPSIVKTLSPEAYQTALIFWRDFEKSAIDLPPAERQKFVSLSSDILSLGRQFLENANTPRPPTSIKASHLAGLKDQGMGVRLQLQARFTKKDLQVYPGSLQAQMIMRSAPEEEPRRRIYIASNSSTPEQISVLEALLRKRAELAQLIGRPSFAHLTLDDKMAKTPENVSNFLDALMDHTRPFARRALHTLAQRKQAHHNLPSLPVVQAWDRDFYCPPDPPAPPIPLPPLTLGTVFMGLSRLFRHLYGVSLRPAKSASGETWHADVQKLEVVDENQGIIGWIYADLFARRNKASGAAHYTVRCSRRADDDDEAGDLTLEGEGHRIQESQAFESVKRHRLPNQDGVYQLPLVVLLTEFARPSISRGPTVLEWYEVLTLFHEMGHAMHSMLGRTEYQNVSGTRCATDFVELPSILMEHFLNSPTVLSLFDADSTTTLRATGNNHADPCHSIDTYSQILLAAVDQRYHSPSALDPSFDSTAELANLHNTRGLMPYVPETSFQTQFGHLFGYGATYYSYLFDRAIASRVWSKVFAENPLDRSRGERLRGEVLMHGGARDPWHMVSALMKMPELESGDAEAMREVGKWRIEDEVGISGRH

SEQ ID NO: 98256 - DNA, 2100 bp, Drosophila melanogaster
  CDS (1)..(2100)
atgctagaatttggtcgaacattgctgcgctggagaacgcggcactgcagtcgcagagtctctacgtggacgccgctggctacggcgtttaatgcgccaccggctaggcggatcaacttcacccacgacgatgttggcctctttggcatgcccgaactgcggagttttgagggcttctatctccttcgagacaatgtggaaagccggacgcaggagctgatctcggaggccacctccgatcaacgacgtcgaaagatggtcgacatttttgacgagctttctgactcattgtgcaaggtggcggacctcgcagagtttgttcgtatcgcgcatcctcagagcagatacacccaagcagcagagcaggcctgcataagcatttgcggaatggtcgagagccttaacacgcataagcccatctataaggctttaagccacgtagtggatcatggagataagctgcccaccagcgaagtggacagacatgtgtcgcgtttgttccttttcgactttgagcagtgtggaattcacttgcccgaggaggaacgtatgcgtgttgtgcggctaaatgactatattcttcagctcggccagaagttcatgagtggagctgtgcaacctagtgttcttccacgcagccaagtccctgagtcctttcgtaactactttcctacctctggggaaaatgtaattatcactggactgtgcacaaacgcagagaacgtccagatgcgggaggctgcctaccggttgtacctgcagccgtcaaagagccaggaggatcttctccgagacctactgctttgccggcatgaactggcgcgtagctgtggcttcgatacatatgcacaccgggcactcaaaggtagcacgatggagaaacccgaagtggtacgagagtttatcgacgagctgtcggaaaagctgcgaccgcgcgcagattgcgatttcgccctgatgtcacaaatgaaacgccgtgaaggcgggaaggcggatgcaagagccgaagtttgggatacgccgtattataccaaccagctgaggcggcaattatttgaggagcacgccaacgagttcctgccatatttctctcttggtggttgcatggaaggtctggacaatttgctacacgcgctttacggtatccgtttgcagaacacagatttaaagccaggcgaggcctggcacaacgacatctacaagctcgccgttgtccacgagagggaaggactgctaggctacatttactgtgacttctatgagagagtggggaagccaaatcaggactgtcacttcaccatccagggcggcaaacgtatgccggacggctcctaccagctccccgtggtggtggtcatgctgggtctagcgcaaccgcggtggagtggaccgacgcttctgtcaccagcgcgattggacaacctgtttcacgaaatgggtcacgcaatgcattcgatgctagctcgcaccgagcatcagcatgtgacgggaacgcgctgttccacggacttcgctgaggtccccagtgtgctcatggagtactttgcgggcgatccccgtgtgttgcgaaccttcgcccgccactttcagacccacgaacccatttccgaggacatgctaagacgcctgtgtgcttccaagaatctgttcgccgctagcgagacccaacttcaggttttctactcagcgctggaccaggaatatcacggagcatcggcgcggcatggcgaaagcagcacagacaccttgcgctcagtacaggatcattactacggacttccctacgtagataacactgcgtggcaactgcggttttcccacctagttggctacggagccaagtattatgcctatcttgtttcgaaaacaatcgcttcctggatctggcagacgtactttgaagccaacccattcaatcgtcaggctggtgagaaatatcgggccgaaattctggcccacggaggagcagttcccagccgtaagttggtggccaactttctgcagcgcgagatgacacccagtgttttggccgacagtcttatcacagagattgacaccgacgagtcgaaaatcaaagaccttatgataacaagaacttaa

SEQ ID NO: 98257 - protein, 699 aa, Drosophila melanogaster
MLEFGRTLLRWRTRHCSRRVSTWTPLATAFNAPPARRINFTHDDVGLFGMPELRSFEGFYLLRDNVESRTQELISEATSDQRRRKMVDIFDELSDSLCKVADLAEFVRIAHPQSRYTQAAEQACISICGMVESLNTHKPIYKALSHVVDHGDKLPTSEVDRHVSRLFLFDFEQCGIHLPEEERMRVVRLNDYILQLGQKFMSGAVQPSVLPRSQVPESFRNYFPTSGENVIITGLCTNAENVQMREAAYRLYLQPSKSQEDLLRDLLLCRHELARSCGFDTYAHRALKGSTMEKPEVVREFIDELSEKLRPRADCDFALMSQMKRREGGKADARAEVWDTPYYTNQLRRQLFEEHANEFLPYFSLGGCMEGLDNLLHALYGIRLQNTDLKPGEAWHNDIYKLAVVHEREGLLGYIYCDFYERVGKPNQDCHFTIQGGKRMPDGSYQLPVVVVMLGLAQPRWSGPTLLSPARLDNLFHEMGHAMHSMLARTEHQHVTGTRCSTDFAEVPSVLMEYFAGDPRVLRTFARHFQTHEPISEDMLRRLCASKNLFAASETQLQVFYSALDQEYHGASARHGESSTDTLRSVQDHYYGLPYVDNTAWQLRFSHLVGYGAKYYAYLVSKTIASWIWQTYFEANPFNRQAGEKYRAEILAHGGAVPSRKLVANFLQREMTPSVLADSLITEIDTDESKIKDLMITRT

SEQ ID NO: 98258 - DNA, 2043 bp, Aeromonas hydrophila
  CDS (1)..(2043): transl_table=11
atgactaaccctttgctgacaatggactcgctgcccccgttcagccagatccagcccgaccaggtacagcctgccgtgacgcaggccattgccgattgcaaacagaagatcagcgatgtgctggcccagcgcgagccccacacctgggacagcctgatcgccccgctggaagaggtaaatgaccgtctgtcccggatctggtcgccggtcagtcacctcaactccgtgctcaacagcgaggcgctgcgcgaggcccacgacgcctgcctgccgctgctgtccgaattccagacctatgtcggtcagcacgaagggctctatcaagcctacctggccctctccgagagcgacgatttccccctgctgagcgccgcccagcgcaaggagatccagaataccctgcgcgattttcgcctgtctggcatcggcctgcccgccgaggcacagcagcgctacggcgagatccaggcccgcctctccgagctggcctcccgtttcagcaacaacgtgctggacgcgacccagggttggagcaagctggtgaccgacgaggccgagctggccgggctgcctgcgagtgcacaggccgccgctcgccagctggccgagctgaagggcaaggaaggctggctgttcactctggacatcccctcctacctgccggtgatgatgtatgccgacaaccgcgccctgcgcgccgagctgtacgaggccttcaccacccgcgcctccgaccagggccccaatgccggcaagtgggacaactccgccatcatgaccgagctgctcgccctgcgccgcgagctggcccagctgctgggctttgccaactacgccgagctctcccttgccaccaagatggcggacaagccggagcaggtggtgaacttcctcaccgatctggcgcgccgctccctgtcgcagggcaaggccgagctagaagagatccgcgccttcgccagcgaacagcacggccagaacgagctggcggcctgggatatcccctattacgccgagaagctcaagcagcacaagttctccgtctccgacgagcagctgcgcccctacttccccgccagcaaggtggtgaaagggctgttcgaggtggtcaagcgggtgttcggcatgaaggtgcgcgagcgcctcggcatcgacacctggcacccggacgtgcgcttctacgacatcttcgatgccgaggatgagctgcgtggcagcttctacctcgacctctatgcccgcgagcacaagcagggcggtgcctggatggatgtctgcctgggtcgtcgctaccgtcaggacggttcgctgcaaaagccggtggcctacctgacctgcaacttcaacggcccggtggacggcaaacccgccctgtttacccacaacgaagtggtcaccctgttccacgaattcggccacggcattcaccacatgctgacccggatcgacgtggccggcgtggccggtatcaacggcgtggcctgggacgcggtggagctgccgagccagttcctcgagaactggtgctgggagtccgaggcactggccttcatctccggccatcacgagaccggcgagccgctgcctgccgatctgctggagaagatgctgcccgcccgcaacttccaggcggccatgcagatgctgcgccagctggagttcgccctgttcgacttccgtctgcaccaggagtttgacccggccaatgcggatcagatcccggcgctgctggacgaggtgcgtcgagaggtggcggtgatgacgccgccggcgttcaaccgcttccagcacagcttctcccacatcttcgccggcggttatgcggcgggctactacagctacaagtgggcggaagtgctctccgccgacgccttctcccgcttcgaggaggaggggatcttcaacccggtgaccggccactccttcctgaaaaacatcctggagaagggcggttccaaggagccgatggagctgttccgcgccttccgtggccgtgagcctcaggtggatgccttgctgcgccacagcgggattgccgcatga

SEQ ID NO: 98259 - protein, 680 aa, Aeromonas hydrophila
MTNPLLTMDSLPPFSQIQPDQVQPAVTQAIADCKQKISDVLAQREPHTWDSLIAPLEEVNDRLSRIWSPVSHLNSVLNSEALREAHDACLPLLSEFQTYVGQHEGLYQAYLALSESDDFPLLSAAQRKEIQNTLRDFRLSGIGLPAEAQQRYGEIQARLSELASRFSNNVLDATQGWSKLVTDEAELAGLPASAQAAARQLAELKGKEGWLFTLDIPSYLPVMMYADNRALRAELYEAFTTRASDQGPNAGKWDNSAIMTELLALRRELAQLLGFANYAELSLATKMADKPEQVVNFLTDLARRSLSQGKAELEEIRAFASEQHGQNELAAWDIPYYAEKLKQHKFSVSDEQLRPYFPASKVVKGLFEVVKRVFGMKVRERLGIDTWHPDVRFYDIFDAEDELRGSFYLDLYAREHKQGGAWMDVCLGRRYRQDGSLQKPVAYLTCNFNGPVDGKPALFTHNEVVTLFHEFGHGIHHMLTRIDVAGVAGINGVAWDAVELPSQFLENWCWESEALAFISGHHETGEPLPADLLEKMLPARNFQAAMQMLRQLEFALFDFRLHQEFDPANADQIPALLDEVRREVAVMTPPAFNRFQHSFSHIFAGGYAAGYYSYKWAEVLSADAFSRFEEEGIFNPVTGHSFLKNILEKGGSKEPMELFRAFRGREPQVDALLRHSGIAA

SEQ ID NO: 98260 - DNA, 2145 bp, Arabidopsis thaliana
  CDS (1)..(2145)
atgtcttccgccgccgctgccgccgtggaatccgtcgtctccgacgagactctttcctcgaatcctctcttgcaggacttcgatttccctccgtttgattccgttgatgccagtcatgttcgtcctgggattcgtgctctattgcagcatctcgaagctgaattggaggagctagagaaatctgtggagccaacatggccaaaactggtggaaccattagagaaaatcgttgatcggttaactgttgtttggggaatgatcaatcaccttaaggctgtcaaggacacacctgagctacgtgctgccatcgaagacgttcagccagagaaagtgaagttccagctcaggttggggcaaagcaagcctatttacaatgcctttaaagctattcgtgaatctcctgattggtcatcgctcagtgaagctcgtcaacgcttagtagaagctcaaataaaggaggcggttctcattggtattgctcttgatgatgaaaagagagaagagtttaataaaattgaacaggaactcgaaaaactttcccataagttttctgagaatgttttggatgcaacaaagaaatttgaaaagttgataacagacaagaaagagatcgagggattgcctccatctgctcttgggctattcgcacaagcagctgtctccaagggccatgaaaatgcaactgctgagaatggaccatggatcattacactggatgctcctagttatcttcctgtcatgcaacatgctaaaaaccgtgctctgcgtgaggaagtctaccgtgcttacctatctcgtgcctcttctggcgatttggataatacggcaattattgaccagattttgaagcttcgcttggaaaaagctaagcttcttggttacaacaattacgctgaggtaagcatggctatgaaaatggctactgttgagaaagcagcagagcttttagagaagcttcgtagtgcatcctgggatgcggctgttcaagacatggaagacctcaagagtttcgcaaagaaccagggtgctgcagaatctgacagtatgactcattgggacaccactttctggagtgagaggcttcgtgaatccaaatacgatattaatgaggaagaactacgtccatacttctcactgccaaaggttatggatggacttttcagtctagctaagacactttttggaattgatattgaaccagcagatggtttagctccggtctggaacaatgatgttcggttctaccgcgtcaaagattcttctgggaacccaatcgcttacttttactttgatccatactctcgcccgtcagagaaaagaggtggcgcttggatggatgaggttgtttcccgtagccgagtcatggctcagaaaggctcttctgttaggctgcctgttgcacacatggtctgcaaccaaactccaccagtaggtgacaagccaagccttatgacattccgtgaggtagagacagtatttcatgaatttggacatgctcttcagcacatgcttacgaagcaggatgaggggctagttgctggtatccgaaatatcgagtgggacgcggttgaattaccatcacagtttatggagaattggtgctaccacagggacactttaatgagcattgctaagcattacgaaacaggagaaacactcccagaggaagtatacaagaaactcctggccgcaagaacattccgtgcagggtcctttagtcttcgtcagttgaaatttgccagtgttgatcttgagctgcacacaaaatacgtaccaggaggaccagagtccatctatgacgtagatcaaagggtatcagtaaaaacccaagttatccctccacttcctgaggatagatttctctgtagcttcagtcacatctttgccgggggatatgcagctggatattacagttacaagtgggcagaagttttgtctgctgatgcattttcagcatttgaagacgctggactagacgacatcaaggctgttaaagaaacaggacagagattcagaaacaccatacttgcacttggaggagggaaagcgcctcttaaggtgtttgttgagtttagaggacgagaaccttcacccgagcctcttctcagacacaatggactcttggctgcctctgcttctgcttaa

SEQ ID NO: 98261 - protein, 714 aa, Arabidopsis thaliana
MSSAAAAAVESVVSDETLSSNPLLQDFDFPPFDSVDASHVRPGIRALLQHLEAELEELEKSVEPTWPKLVEPLEKIVDRLTVVWGMINHLKAVKDTPELRAAIEDVQPEKVKFQLRLGQSKPIYNAFKAIRESPDWSSLSEARQRLVEAQIKEAVLIGIALDDEKREEFNKIEQELEKLSHKFSENVLDATKKFEKLITDKKEIEGLPPSALGLFAQAAVSKGHENATAENGPWIITLDAPSYLPVMQHAKNRALREEVYRAYLSRASSGDLDNTAIIDQILKLRLEKAKLLGYNNYAEVSMAMKMATVEKAAELLEKLRSASWDAAVQDMEDLKSFAKNQGAAESDSMTHWDTTFWSERLRESKYDINEEELRPYFSLPKVMDGLFSLAKTLFGIDIEPADGLAPVWNNDVRFYRVKDSSGNPIAYFYFDPYSRPSEKRGGAWMDEVVSRSRVMAQKGSSVRLPVAHMVCNQTPPVGDKPSLMTFREVETVFHEFGHALQHMLTKQDEGLVAGIRNIEWDAVELPSQFMENWCYHRDTLMSIAKHYETGETLPEEVYKKLLAARTFRAGSFSLRQLKFASVDLELHTKYVPGGPESIYDVDQRVSVKTQVIPPLPEDRFLCSFSHIFAGGYAAGYYSYKWAEVLSADAFSAFEDAGLDDIKAVKETGQRFRNTILALGGGKAPLKVFVEFRGREPSPEPLLRHNGLLAASASA

SEQ ID NO: 98262 - DNA, 2172 bp, Arabidopsis thaliana
  CDS (1)..(2172)
atggcttctgaagatactctctcctcgaatcctctattgcagaattttgacttccctccgtttgactccgttgatgctcaccatgtcagacctgggattcgtgctctgttgcagcagctcgaagctgaattggagcagctagaaaaagctgtagagccttcatggccaaaactagtggagccattagagaagattattgatcggttatctgttgtttggggaatgatcaatcatcttaaggctgtcaaggacacacctgagcttcgtgctgccattgaagaagttcaggattcgttttcttgttttcctaacaatactttcatctacactctacagccggagaaggtgaagttccagctcaggttgggacagagcaaacccatttacaatgcatttaaggctattcgagaatctccagactggaattcattgagcgaagctccccaaataaaggaggcggttctgagtggtattgctcttgaagatgataagagggaagaatttaacaaaattgaacaggaacttgaaaaactttctcataagttttctgagaatgttttggacgctacaaagaagtttgaaaagttgataacagacaagaaagagattgaggggttgccaccatctgcacttggattgttcgcacaagcagctgtttccaagggccatgaaactgcaactgctgacactggaccatggctcattacactcgatgctcctagttatcttcccgttatgcaacatgccaaaaaccgagctctgcgcgaggaagtctaccgtgcttacttatcccgtgcctcttcgggtgatttagataatacagcaattatcgaccaaatcttgaagcttcgactggaaaaggctaagcttcttggttacagaaattatgctgaggtaagcatggccacgaaaatggctactgtggagaaagcagatgagctactagaaaagcttcgcagtgcttcatgggatccggctgttcaagacatagaagaccttaagagttttgcgaagaaccaaggtgctgcagaggctgacagtttgactcactgggacatcactttctggagtgagaggcttcgtgaatccaaatacgatattaatgaggaagaactgcgaccttacttctcattgccaaaggttatggatgcgttattcggtctagctaagacactatttggaattgatgttgtgccagcagacggtgtagcgccggtctggaacagcgatgttaggttctactgtgtcaaagattcttctggaaatccaactgcttatttctactttgatccctactctcgcccttcagaaaagagagacggcgcttggatggatgaagttttttctcgtagccgagtcatggcccagaagggttcctccgttagactccctgttgctcaaatggtctgcaaccaaactccacctgttggtgacaagccaagccttatgacattccgtgaggtagagactgtgttccatgaatttggccatgctcttcagcatatgcttaccaaagaggatgaggggctagtggctggtatccggaatatcgagtgggatgcagttgaattaccgtcacagtttatggagaactggtgctaccacagggataccttaatgagcattgctaagcattatcaaacaggagaaactcttcccgagaatgtatacaagaagctactggctgcaagaacattccgtgcagggtcccttagtcttcgccagttgaagtttgctacagttgatctggagctgcacacaaaatacatgccaggtggggcagagaccatctacgaagttgatcaaagggtgtccataaaaacacaagtgatccctccacttcctgaagatagattcctctgtagcttcagtcatatatttgcagtttgtttcacttgttcaccttctcatgtcttgtcaggtggttatgcagctggatactacagttacaagtgggcggaggttttgtctgcagatgcgttttcagcttttgaagatgctgggttggatgacattaaggctgtcaaagaaacaggacagagattcagaaacactatacttgctctgggaggaggaaaagctcctctaaaagtgtttgtggagttcagaggacgagaaccttccccagagcctctgctcagacacaatggactcttggctgcttctgcttga

SEQ ID NO: 98263 - protein, 723 aa, Arabidopsis thaliana
MASEDTLSSNPLLQNFDFPPFDSVDAHHVRPGIRALLQQLEAELEQLEKAVEPSWPKLVEPLEKIIDRLSVVWGMINHLKAVKDTPELRAAIEEVQDSFSCFPNNTFIYTLQPEKVKFQLRLGQSKPIYNAFKAIRESPDWNSLSEAPQIKEAVLSGIALEDDKREEFNKIEQELEKLSHKFSENVLDATKKFEKLITDKKEIEGLPPSALGLFAQAAVSKGHETATADTGPWLITLDAPSYLPVMQHAKNRALREEVYRAYLSRASSGDLDNTAIIDQILKLRLEKAKLLGYRNYAEVSMATKMATVEKADELLEKLRSASWDPAVQDIEDLKSFAKNQGAAEADSLTHWDITFWSERLRESKYDINEEELRPYFSLPKVMDALFGLAKTLFGIDVVPADGVAPVWNSDVRFYCVKDSSGNPTAYFYFDPYSRPSEKRDGAWMDEVFSRSRVMAQKGSSVRLPVAQMVCNQTPPVGDKPSLMTFREVETVFHEFGHALQHMLTKEDEGLVAGIRNIEWDAVELPSQFMENWCYHRDTLMSIAKHYQTGETLPENVYKKLLAARTFRAGSLSLRQLKFATVDLELHTKYMPGGAETIYEVDQRVSIKTQVIPPLPEDRFLCSFSHIFAVCFTCSPSHVLSGGYAAGYYSYKWAEVLSADAFSAFEDAGLDDIKAVKETGQRFRNTILALGGGKAPLKVFVEFRGREPSPEPLLRHNGLLAASA

SEQ ID NO: 98264 - DNA, 2058 bp, Xenopus laevis
  CDS (1)..(2058)
atgctttacattacacaagatcacacgatgaatccccagtttaagaatgatggaaaccgtctcagatgggatctgactccgaaacagattgagatactgactggtgaggtcattgagcaaacaaagagagtttatgaccaggttgggagcctagacctgagcagtgtcacctatgacaacacactaaaggtcctggctgatgtggaagtggagtattcagggaagaggagcatgcttgattttccacagcatgtatctccctcaaaagaaatccgtgcagtaagcactgcggctgataagaaactgtcagagtttgatgttgaacaaagcatgagggaggatgtttacagaagaattgaacatttgcagaccattataccatctaatactctaaaacctgaagcaaagcgatggctagaaagagtgatcaaactgagccagaggaatggactgaatctcccttcagacacccaggagaaaattaaatccattaagaaaaagatgagtacactctccattgatttcaacaagaatttaaatgaagatatcacattcctcaccttcacaaaggaagaactcggaggtctcccagatgattttctgaattccctggagaaggcaggtgatgggaagttaaaaattacattaaaatatccacattatttccccctgatgaaaaagtgttttattcctaatactcgacagaaggtggaagctgctttcaattcccgttgcaaagaggaaaatagcaggatacttcaagagttagtgcaactaagggaacaaaatagcagtattcttggctttaaaacacatgctgattttgttctggagatgaatatggcaaagaacagtgtgactgtggcaagttttttggaggaattgtctcaaaaattgaagccgcttggtgagcaggaaaggtctatcatgttagaacttaagaagaatgagtgtaaaaaacgtgggctgaattttgataaccagatcaatgcctgggatatgcgttattatatgaaccaagttgaggagacttcatacaatgtggatcagaacttcttgaaggaattttttccaattgaggtagttactactggtctcctgggcatatatcaggagttgttgggattgaactttgtcttagaaaagggtgctgctgtttggcatgaagatgtgtctttgtactcagtaagggatgccacaaccggacaactcataggaaagttctatttggacttatatccacgggaagggaaatattcacatgcagcatgctttgggctccagcttggatgtttactgcctgatggcaccaggcagatctctgtggctgctatggttgccaactttactaagcccacacaagatgctccctctctactacaacatgatgaagtagagacatatttccatgagtttggacacgttatgcaccagttatgtgctcaggcagaatttgtactgttcagtggaacaggtgtagagagagattttgtagaagctccttctcagatgctggaaaactgggtttgggaaagggaatctttgcaacgtatgtcacaacattacaaatctggtcaagcaattcctaaagaggtattggagcatcttataaaatcccggctggcaaacacaggtctcctaaaccttcgacagatcgttcttgccaagatagatcaggtgctgcacacacagattggcgtagatcctgttgaggaatatagcaagttatccaatgagatacttggaatcccagctacacctggtacaaatatgctagccagctttgcacatctggcaggaggatatgatgctcagtattatggatacctatggagtgaggtatattctatggacatgttctacacacgttttaaacaggaaggaatcatgagcaagaaggttggtgcagattataggaactgtattctgaagccagggggatcactggatgccactgaaatgctaaggaacttcctaggtcgtgacccaaagccagaagcatttctccaaagtaaaggactggctaatgttaatgctcctgcaccccatgctagctga

SEQ ID NO: 98265 - protein, 685 aa, Xenopus laevis
MLYITQDHTMNPQFKNDGNRLRWDLTPKQIEILTGEVIEQTKRVYDQVGSLDLSSVTYDNTLKVLADVEVEYSGKRSMLDFPQHVSPSKEIRAVSTAADKKLSEFDVEQSMREDVYRRIEHLQTIIPSNTLKPEAKRWLERVIKLSQRNGLNLPSDTQEKIKSIKKKMSTLSIDFNKNLNEDITFLTFTKEELGGLPDDFLNSLEKAGDGKLKITLKYPHYFPLMKKCFIPNTRQKVEAAFNSRCKEENSRILQELVQLREQNSSILGFKTHADFVLEMNMAKNSVTVASFLEELSQKLKPLGEQERSIMLELKKNECKKRGLNFDNQINAWDMRYYMNQVEETSYNVDQNFLKEFFPIEVVTTGLLGIYQELLGLNFVLEKGAAVWHEDVSLYSVRDATTGQLIGKFYLDLYPREGKYSHAACFGLQLGCLLPDGTRQISVAAMVANFTKPTQDAPSLLQHDEVETYFHEFGHVMHQLCAQAEFVLFSGTGVERDFVEAPSQMLENWVWERESLQRMSQHYKSGQAIPKEVLEHLIKSRLANTGLLNLRQIVLAKIDQVLHTQIGVDPVEEYSKLSNEILGIPATPGTNMLASFAHLAGGYDAQYYGYLWSEVYSMDMFYTRFKQEGIMSKKVGADYRNCILKPGGSLDATEMLRNFLGRDPKPEAFLQSKGLANVNAPAPHAS

SEQ ID NO: 98266 - DNA, 2070 bp, Homo sapiens
  CDS (1)..(2070)
atgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctga

SEQ ID NO: 98267 - protein, 689 aa, Homo sapiens
MKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 98268 - DNA, 2046 bp, Haemophilus influenzae
  CDS (1)..(2046): transl_table=11
atgtctatgtcaaatccattacttaacattcaaggcctaccgccattttcacaaatcaagccagaacacattcgaccagctgttgaaaaattaattcaagattgtcgcaatacgatagaacaagtgttaaaacaaccgcactttacttgggaaaatttcattttgcctttaacggaaactaatgatcgcttaaatcgtgcttggtcgcccgtttctcatctcaattcagtaaaaaatagcactgaattacgtgaagcctatcaaacgtgcttgccgttactttctgaatacagcacttgggttggtcagcataaggggctttataatgcctatttagcgttaaaaaatagtgctgaatttgccgattattcgattgcacaaaagaaagccattgaaaattcactgcgtgattttgaactttcaggcattgggctttccgaagagaaacaacaacgttatggcgaaattgtggcacgcttatcggaattaaattcacaatttagcaataacgtattagatgccaccatgggttgggaaaaactcattgaaaacgaagcagaacttgctggtttacctgaatccgcactacaagctgcacaacaatctgccgaaagtaaaggattaaagggctatcgttttacgttagaaatcccaagttatttgcctgtgatgacttactgcgaaaatcgtgcattgcgtgaagaaatgtaccgtgcttatgcaacacgtgcctctgaacaaggccctaacgctggcaaatgggacaacagtaaagttatggaagaaattctgacgttacgcgttgaactggcaaaattactcggttttaatacttataccgaactttcacttgccacaaaaatggcagaaaacccacaacaagtgcttgatttcttagatcatcttgccgaacgtgccaaaccacaaggcgaaaaagaactgcaagaattgaaaggttactgcgaaaaagaatttggtgtcactgaacttgcaccttgggatattggtttttacagcgaaaaacaaaaacaacatttatacgccattaatgatgaagaacttcgcccatattttccagaaaatcgcgtgatttcaggattgtttgaattaattaaacgcatttttaatattcgtgcagtggaacgcaaaggtgtggatacttggcataaagatgtacgtttctttgatttaatcgatgaaaatgatcaactccgtggcagtttctatcttgatttatatgcacgcgaacacaaacgtggtggtgcgtggatggatgactgtatcggacgtaagcgtaaactggatggcagcattgaaacgcctgtggcttatttaacctgtaacttcaacgcaccgatagggaataaaccagcgttatttactcacaatgaagtcaccacgctattccacgaatttgggcacggaatccatcatatgctcacgcaaattgatgtatccgatgtggcgggaataaatggcgtgccttgggatgctgtggaattaccaagtcaatttatggaaaactggtgctgggaagaagaggctttggcgtttatttcaggacattacgaaacaggcgagccgttgccaaaagaaaaactcacgcaattgttaaaagcgaaaaatttccaagctgcgatgtttatcttacgtcagcttgaatttggtatttttgatttccgtttacatcacacctttgatgcggaaaaaaccaatcaaattttggatacacttaaatcagtgaaatcacaagttgccgtcataaaaggcgtagattgggcaagagcgccacacagcttcagccatatttttgcagggggctacgccgcaggttattacagctatttatgggctgaagtattatcggctgatgcttattcacgctttgaagaagaaggtattttcaacccaatcaccggcaaatcattcttagatgaaattctcacccgtggcggctcagaagaaccaatggaactcttcaaacgcttccgtggccgtgaaccgcaattagatgcgttgttaagacataaaggaattatgaactaa

SEQ ID NO: 98269 - protein, 681 aa, Haemophilus influenzae
MSMSNPLLNIQGLPPFSQIKPEHIRPAVEKLIQDCRNTIEQVLKQPHFTWENFILPLTETNDRLNRAWSPVSHLNSVKNSTELREAYQTCLPLLSEYSTWVGQHKGLYNAYLALKNSAEFADYSIAQKKAIENSLRDFELSGIGLSEEKQQRYGEIVARLSELNSQFSNNVLDATMGWEKLIENEAELAGLPESALQAAQQSAESKGLKGYRFTLEIPSYLPVMTYCENRALREEMYRAYATRASEQGPNAGKWDNSKVMEEILTLRVELAKLLGFNTYTELSLATKMAENPQQVLDFLDHLAERAKPQGEKELQELKGYCEKEFGVTELAPWDIGFYSEKQKQHLYAINDEELRPYFPENRVISGLFELIKRIFNIRAVERKGVDTWHKDVRFFDLIDENDQLRGSFYLDLYAREHKRGGAWMDDCIGRKRKLDGSIETPVAYLTCNFNAPIGNKPALFTHNEVTTLFHEFGHGIHHMLTQIDVSDVAGINGVPWDAVELPSQFMENWCWEEEALAFISGHYETGEPLPKEKLTQLLKAKNFQAAMFILRQLEFGIFDFRLHHTFDAEKTNQILDTLKSVKSQVAVIKGVDWARAPHSFSHIFAGGYAAGYYSYLWAEVLSADAYSRFEEEGIFNPITGKSFLDEILTRGGSEEPMELFKRFRGREPQLDALLRHKGIMN

SEQ ID NO: 98270 - DNA, 2043 bp, Salmonella typhimurium
  CDS (1)..(2043): transl_table=11
atgaccaatccattactaacgtctttttcactgccgcctttttctgcaattaaaccggagcatgtggtgcctgcggtcaccaaagcgttggccgattgccgggcggcggtagaaggcgttgtggcgcatggcgcgccgtatagctgggaaaacctctgccagccgttggcggaagccgacgatgttctggggcgtattttctcgccaattagccacttaaactcggtgaaaaatagtccggagctgcgtgaagcctacgaacagacgctgccgctgctgtcggaatacagcacctgggttggccagcatgaagggttgtacaacgcgtaccgcgacctgcgcgacggcgatcattacgccactctgaataccgcgcagaagaaagcggttgataacgcgctgcgtgattttgaactgtccggcatcggcctgccgaaagagaaacagcagcgttacggcgaaatcgccactcgcctgtctgagctgggcaaccagtacagcaataatgtgctcgatgccactatgggctggacgaagctcatcaccgatgaagccgagctggcgggaatgccggaaagcgctctggcggcagctaaagcccaggcggaagccaaagagcaggaaggttacctgctgaccctggatatcccgagctatctgccggtcatgacctactgcgacaaccaggcgttgcgcgaagagatgtatcgcgcctattccactcgcgcctccgatcaggggccgaacgccggtaagtgggataacagcccggtgatggaagaaattcttgcgctgcgccatgaactggcgcaactgctgggcttcgaaaattatgcccatgaatcgctggccaccaaaatggcggaaaatccgcagcaggtgctcgatttcttaaccgatttggcgaaacgcgcccgtccgcagggggaaaaagagctggcccagctgcgcgccttcgccaaagccgaatttggcgttgaggagctgcaaccgtgggatatcgcgtactacagtgaaaagcaaaaacagcacctgtacagcatcagcgatgagcagctacgtccgtacttcccggaaaacaaagccgtgaatggcctgtttgaagtggtgaaacgtatttacggcatcactgccaaagagcgtactgacgttgatgtctggcacccggaagtgcgtttctttgaactgtatgacgaaaataacgagctgcgcggcagcttctaccttgacctgtacgcgcgcgaacacaaacgcggcggggcgtggatggacgactgtgtcggccagatgcgtaaagcggacggcacattgcaaaagccggtcgcttatctgacctgtaatttcaaccgtccggtgaacggtaaacccgctctgtttacccatgacgaagtgatcaccctgttccacgagtttggtcatggcctgcatcatatgctgacccgcattgagaccgccggggtctccggtatcagcggcgtgccgtgggacgcggtcgaactgccaagtcagtttatggaaaactggtgctgggagccggaagcgctggcgtttatctccggccactatgagaccggcgaaccgctgccgaaggaactgctggataaaatgctggcggcgaaaaactatcaggcggcgctgtttattctgcgtcagctggagttcggtctgtttgatttccgtctgcatgcggaatttaatccacagcaaggagcgaaaattcttgagacgctctttgaaattaaaaaacaggtcgccgtggtgccgtcaccgacatggggtcgctttccacatgcgttcagccatatctttgctggcggctatgcggcaggctactacagctatctgtgggccgacgtactggcggcggacgcttattcccgctttgaggaggaaggcattttcaaccgtgagaccggtcagtcgttccttgataacatcctgactcgcggtggttctgaagagccgatggaactctttaaacgcttccgtggccgtgaaccacaactggacgcgatgctggagcattacgggattaaaggctga

SEQ ID NO: 98271 - protein, 680 aa, Salmonella typhimurium
MTNPLLTSFSLPPFSAIKPEHVVPAVTKALADCRAAVEGVVAHGAPYSWENLCQPLAEADDVLGRIFSPISHLNSVKNSPELREAYEQTLPLLSEYSTWVGQHEGLYNAYRDLRDGDHYATLNTAQKKAVDNALRDFELSGIGLPKEKQQRYGEIATRLSELGNQYSNNVLDATMGWTKLITDEAELAGMPESALAAAKAQAEAKEQEGYLLTLDIPSYLPVMTYCDNQALREEMYRAYSTRASDQGPNAGKWDNSPVMEEILALRHELAQLLGFENYAHESLATKMAENPQQVLDFLTDLAKRARPQGEKELAQLRAFAKAEFGVEELQPWDIAYYSEKQKQHLYSISDEQLRPYFPENKAVNGLFEVVKRIYGITAKERTDVDVWHPEVRFFELYDENNELRGSFYLDLYAREHKRGGAWMDDCVGQMRKADGTLQKPVAYLTCNFNRPVNGKPALFTHDEVITLFHEFGHGLHHMLTRIETAGVSGISGVPWDAVELPSQFMENWCWEPEALAFISGHYETGEPLPKELLDKMLAAKNYQAALFILRQLEFGLFDFRLHAEFNPQQGAKILETLFEIKKQVAVVPSPTWGRFPHAFSHIFAGGYAAGYYSYLWADVLAADAYSRFEEEGIFNRETGQSFLDNILTRGGSEEPMELFKRFRGREPQLDAMLEHYGIKG

SEQ ID NO: 98272 - DNA, 2133 bp, Rattus norvegicus
  CDS (1)..(2133)
atgctgctggcagccgggacgcggtatgcctaccggctgtgcggccggcgagccgcggcggctctgcagggacgcgcaggccggagctgcgcccggagcgtcagcactagctggtccccggtgggcgctgcctttaacgtcaagccccagggccacctgtgggacctgttgggagagcgacggggtctttttggagttcctgagctcagcacccctgaaggattccaagttgcccaggaggaagccttgaggaagacggagtggctggtagagcgagcatgttccacacctccagggccacagacagtcctcattttcgatgagctctcggattgcctctgcagagtggctgacttggcggactttgtgaaaattggacacccagagcaggcgttcagagaggctgcgcaggaggcctgcagaagtattggcaccatggtggaaaagttgaatacgaatgtggaattgtatcagagtctgcagaaattactagatgacaagaagcttatggattcccttgatgcagaaaccaggcgagtagccgaactatttatgtttgattttgaaatcagtggaatccatctagatgaagaaaagcgcagaagagccgtggacctcaatgttaagatcttggacttgagtagtgctttcctcatgggaaccaactttcccatcaagatccagaagcatctcttaccagagcacattcagcaccactttgctcgtgatggaaggcatttagtcatcgatggtctacatgcggaagcctccgatgacctggttcgggaggctgcttataaaatttttctttatcccaatgctgatcagttgaagtgtttggaggagttgctaagcagccgagatcttctggcaaacctagtaggctatctaccttttcccacaggccctccaggaaccatagcccagactccagagactgtcatgcagttccttgagaagctatctgaaaagctctgcgaaagaactagaaaagattttgagatgatgcaaggaatgaaaacaaaactaaatcctcaaaattctgaactaatgccttgggaccctccctactacagtggtgtgattcgtgcagagaggtataatattgagcccagtttatattgtccattcttatcccttggagcttgcatggaaggcctgaatgtcctatttaacagactgttgggcgtcaccttatatgcagaacagcccttcaaaggagaggtgtggtgtattgatgtccggaagctggctgttgttcatgaatctgaagggttgctgggctacatttactgtgattttttccagcgagcaaacaagccacagcaggattgccacttcaccatccgagggggcagattaaaggaagatggcagctatcagctcccagttgtggttctcatgctgaatctccctcatgcttccagggatttccctaccttattaactcctgggatgatggaaaatctcttccatgaaatggggcatgccatgcactcaatgctcggacgaactcggtaccagcatgtcactgggaccaggtgccctactgactttgctgaagttccgtctattctgatggagtatttttcaaatgattaccgagtagtcagccagtttgccaagcattatcagactggtcagccactgccaaaagctatggtgtctcgtctctgtgaatctaagaaggtctgtgccgccgcagaaatgcagctgcaggtcttttatgccgccctggatcaaatctaccatggccagcatcccctgaagaagtcaaccacagacatcctcatggaaacacaagagcagttttatggcttaccctatgttcctgacactgcctggcagctgaggttcagccacctggtgggatatggcgccaagtattactcatacctgatgtccagggctgtggcatccatggtctggaaggagtgcttcctacaggatccctttaacagggccgccggggagcgctaccgcagagagatgttagcccacggtgggggcaaggaacctatgctcatgattcaaggcatgctgcagaaatgtccttccatcgatgattttgtggatgcccttgtgtctgacttgaatctggactttgaaactttcttcatggattctaaatag

SEQ ID NO: 98273 - protein, 710 aa, Rattus norvegicus
MLLAAGTRYAYRLCGRRAAAALQGRAGRSCARSVSTSWSPVGAAFNVKPQGHLWDLLGERRGLFGVPELSTPEGFQVAQEEALRKTEWLVERACSTPPGPQTVLIFDELSDCLCRVADLADFVKIGHPEQAFREAAQEACRSIGTMVEKLNTNVELYQSLQKLLDDKKLMDSLDAETRRVAELFMFDFEISGIHLDEEKRRRAVDLNVKILDLSSAFLMGTNFPIKIQKHLLPEHIQHHFARDGRHLVIDGLHAEASDDLVREAAYKIFLYPNADQLKCLEELLSSRDLLANLVGYLPFPTGPPGTIAQTPETVMQFLEKLSEKLCERTRKDFEMMQGMKTKLNPQNSELMPWDPPYYSGVIRAERYNIEPSLYCPFLSLGACMEGLNVLFNRLLGVTLYAEQPFKGEVWCIDVRKLAVVHESEGLLGYIYCDFFQRANKPQQDCHFTIRGGRLKEDGSYQLPVVVLMLNLPHASRDFPTLLTPGMMENLFHEMGHAMHSMLGRTRYQHVTGTRCPTDFAEVPSILMEYFSNDYRVVSQFAKHYQTGQPLPKAMVSRLCESKKVCAAAEMQLQVFYAALDQIYHGQHPLKKSTTDILMETQEQFYGLPYVPDTAWQLRFSHLVGYGAKYYSYLMSRAVASMVWKECFLQDPFNRAAGERYRREMLAHGGGKEPMLMIQGMLQKCPSIDDFVDALVSDLNLDFETFFMDSK

SEQ ID NO: 98274 - DNA, 2328 bp, Schizophyllum commune
  CDS (1)..(2328)
atgattgctcgccccgccagagatgtgctctcctccgcgacgaagaagcagttccgcttcagaggttgcctcgctgcccgccatgaaccgtatcacacctcgacatcccgggccggccaggtagccatacttcccgccacaacggatgacaagacgctcgtctcggtcttcgactcgcctcggagcaatgcgaaactatccgcgttcgcgacgaccggcctcttcaatcattccactgttacgcacccccgcgcgctgaactcgatcgctcaggggacactcatacgcgcgcatgtcctgacgaaccgcattcttcgtgcgaaggagtcccgggaggagctcttcaaggttgtgaagaacctggacaggctcagtgacatgctctgcagtgtcattgacctctgcgaactcgttcgcaactcgcaccccgatcgcgcttgggtcgaggcagccaacgacgcgtacgagggactctgccagaccatgaacgagctgaacacccatgtggggctctacgatgttctgaagattgtgctgtccgaccctgagatcgtcaagtccttaagcccagaggcttaccgcacggcgatgattttttggaatgacttcgagaagtcggcaatcaacctccctgcgaaggaacgcgaagagttcgtcgcgctttcctctgaaatcatatcccttgggcgcatgttcctggaggagaccaccgccgcacgtccccccgccaaaatccccccttcagacctggctgggttgaaggacaagggtatgggcgtgcgtctgcagctgcaggcgcagttcacgcagcgcgacttgcatgtctaccccgggtcattgcaagcacaaatgatcatgcggtcggccccggcggaagaggcgcgaaggcgtgtctatatcgcgtcacattccagcacgccagagcagatagagcttttggagcgcatgctctccacacgcgcaaggctcgcccgactggtcggccgagagagcttcgcggctatggccctcgatgacaagatggctaagaatcccaccaacgtcgctcgcttcctcgactcccttatggatcgctcacgaccttacgcccgtcgcgctctgagaaacctcagcatgcgcaagcaagaacatctccataccccgccattccccacaatccaggcctgggaccgagattactactgtccccccgaacctccagcacctcccattccccttcctagactcaccttcggcaccgtcctgatgggactatcccgcctattccgtcacttatatggcattcacctgcgccccgtgaagcccatcgctggcgaggtctggcactccgacgtacacaagctggaagtggtggacgaagaaaggggtgtcatcggcctcatctacgcggacgtctttgcgcgccgagggaaggcgagcggcgctgcacactacacagtgcggtgctcgcggcggacagacgacgacgacgtacaaggcgacaatgacgaattgacgcggatgtatcccgacctgatcaagcaatcggaggagtttgaagcggtcggtcggggtccaatacctggactaccagggacgtaccagcagcccttggtcgtcttgctttgcgagtttgcgcgcccttcgcttggcgcggcggtcctcgaatggcacgaagtcatgaccctcttccacgagatgggccatgccatgcattctatgattggccgcaccgaataccagaacgtctccggcactcgctgccccactgacttcgtcgagctcccctccatcctcatggagcacttcctcaattcccgccaagttctatccctcttccacgccgactccacctcttcttcctcccagcccatcggcaaccacgacgaggacccgtgccactccatcgacacctacgcgcagatcatgctcgctgccctcgaccagatctaccactcgcccgccgcgctccagcccgggtttgactcgacgcgcaagctggcgaggttgcacgatgagaaggggctgataccgtacgtgcccgggacgagctttcagacgcaattcgggcacttgttcgggtatggggcgacgtactattcgtacttgttcgaccgcgcgattgcgtcgagggtatggaaggacgtcttcagctcgtcgccgttgagtcgggagacgggcgagcggtacaagcaggaggtgctgcggtacggtggtggcaaagacccatgggagatggtcagtgctctgctgaaggcgccagagctagccagcggggatgcggaggcaatggcgactgtcgggcggtggaagatcgaggatgaggttgggttgccgggcaggcactag

SEQ ID NO: 98275 - protein, 775 aa, Schizophyllum commune
MIARPARDVLSSATKKQFRFRGCLAARHEPYHTSTSRAGQVAILPATTDDKTLVSVFDSPRSNAKLSAFATTGLFNHSTVTHPRALNSIAQGTLIRAHVLTNRILRAKESREELFKVVKNLDRLSDMLCSVIDLCELVRNSHPDRAWVEAANDAYEGLCQTMNELNTHVGLYDVLKIVLSDPEIVKSLSPEAYRTAMIFWNDFEKSAINLPAKEREEFVALSSEIISLGRMFLEETTAARPPAKIPPSDLAGLKDKGMGVRLQLQAQFTQRDLHVYPGSLQAQMIMRSAPAEEARRRVYIASHSSTPEQIELLERMLSTRARLARLVGRESFAAMALDDKMAKNPTNVARFLDSLMDRSRPYARRALRNLSMRKQEHLHTPPFPTIQAWDRDYYCPPEPPAPPIPLPRLTFGTVLMGLSRLFRHLYGIHLRPVKPIAGEVWHSDVHKLEVVDEERGVIGLIYADVFARRGKASGAAHYTVRCSRRTDDDDVQGDNDELTRMYPDLIKQSEEFEAVGRGPIPGLPGTYQQPLVVLLCEFARPSLGAAVLEWHEVMTLFHEMGHAMHSMIGRTEYQNVSGTRCPTDFVELPSILMEHFLNSRQVLSLFHADSTSSSSQPIGNHDEDPCHSIDTYAQIMLAALDQIYHSPAALQPGFDSTRKLARLHDEKGLIPYVPGTSFQTQFGHLFGYGATYYSYLFDRAIASRVWKDVFSSSPLSRETGERYKQEVLRYGGGKDPWEMVSALLKAPELASGDAEAMATVGRWKIEDEVGLPGRH

SEQ ID NO: 98276 - DNA, 2289 bp, Schizosaccharomyces pombe
  CDS (1)..(2289)
atgcaagtaagaactttgcttacattgggaaaaaaaaaagtaattggaaataggcagtgcattcttagtctttatcgaaaatattctaatgttcaaagtcgcaaagcggaagaccaattgttgcgtcaaatttttgatgatcagaatatagctgtgaaccagataacgaaaagaaatggaattcagggagtaggattgtttcgtaatcacttcctttccgacaaagataccggcttcctaaggctcgcggaaactgcatctgaaaaatgtaaggccgtgattgaggatcttttgctcgaggatactgaagacgggtcaattgtagtcagcaaatttgacaggatttctaacttactatgcagtgtcattgacctttttgagtttgtgcgctgcgcccatcctgacaagatggtggtaatgaaagcagaagaagcttacagttatctatttgagctgatgaacactttaaacactcatcaaggtctttacgaaaaattaaagtgttctttacaacagactcctacgttgaaagatacagatcctgaagcatatactgttggaagagtattcctccaagattttgaaaaatcgggcgtaaatttagagagctcgaaaagaaactcctttgttaaaaagtcctctgaatctgcaactcttggaagagcattttttaataatagcatgaatcgtcctcagcgttatttaactatttctaagcaacgtctggctggttcggacccatattttgtacgctcactctctaagaatgacaaaaactttattatgattccaactgttggatacgaaggtacacaggccttgattagtgtagcaaatcccgacgtcaggaaagaaatttacatggaaggtcataaaggaacagttgaagaagtcgaattgctaaattcctatttgaggtctaaagcggaagttgcgaaactagtgggaaaaagtagttttgcagatttacaacttatagataaaatggctaatgctcctaaacatgttgttgaatttttagagaacttatcattaaaaaattcttccgtgttaaaaaagattttaaacaatctcgcgttaatgaagaaaaaagagttaaacttgaattttcttccatcatttgatgtttgggacagggaatattatactgctcgctataaacaatctcttataaatcaaaagccttctttaaacccttctataacgaattatcggcgttttttttctgttggtacagttattcaaggtctatctagactatttagttctttatatgggcttcgttttgttccagcggacatttcccctggtgaggtatggcatcctgatgtaaataaggtcaatgtttacaatgaaaatgatcatgtaatgggtgtaatttatttcgatctatttgctcgaacaggaaaaacagatggagctgctcattttacaattcgttcttctcgggaattagacttgacaagctttgacgattctataagtcttggatttgatgatgctactaatataagggtcaaggataacaaacggtatcaaatacctgtcatttcgttattgtgtaatttcgtacgttctagtggaatggatcctacctttttagatttgtgggatgtgaaaacactttttcacgagatggggcatgccatgcattccattctaggtcatactaaatatcagaacttagccggaactcgttgtgcaaccgactttgttgaacttccttcaattattatggagttttttatgtcaaatccagccgtattaccgctttatgctcgctacgaaggaactgagattccattacctgtacaagttttgaaccatcataacatggttgaaaatagttcagcacccttagatttacaatctcaaatttgtatggctatggtggatcaattgtttcactcgaaggttgtcttagatccgtcatttaattctatcgatgaagttactaatgtaaccagaaagttcagtgggtttgagtctgctccacctgctgcttggtatcttcagtttagtcatctttatggatatagcgctacttattattcatacatttttgatacggtattggcttcgctaatctttagtaaactttttgctggaaatccattaagccgtgaggctggtgagaaatttcgtaaagccatcctacgatggggtggcagtagaagcccatgggaatgtgttgcagaagcccttgaacaacctatattagcaacgggcggcgaagaggccatgcgtcgaataggaagtgaaggtattaaagcgacgtccaccttttaa

SEQ ID NO: 98277 - protein, 762 aa, Schizosaccharomyces pombe
MQVRTLLTLGKKKVIGNRQCILSLYRKYSNVQSRKAEDQLLRQIFDDQNIAVNQITKRNGIQGVGLFRNHFLSDKDTGFLRLAETASEKCKAVIEDLLLEDTEDGSIVVSKFDRISNLLCSVIDLFEFVRCAHPDKMVVMKAEEAYSYLFELMNTLNTHQGLYEKLKCSLQQTPTLKDTDPEAYTVGRVFLQDFEKSGVNLESSKRNSFVKKSSESATLGRAFFNNSMNRPQRYLTISKQRLAGSDPYFVRSLSKNDKNFIMIPTVGYEGTQALISVANPDVRKEIYMEGHKGTVEEVELLNSYLRSKAEVAKLVGKSSFADLQLIDKMANAPKHVVEFLENLSLKNSSVLKKILNNLALMKKKELNLNFLPSFDVWDREYYTARYKQSLINQKPSLNPSITNYRRFFSVGTVIQGLSRLFSSLYGLRFVPADISPGEVWHPDVNKVNVYNENDHVMGVIYFDLFARTGKTDGAAHFTIRSSRELDLTSFDDSISLGFDDATNIRVKDNKRYQIPVISLLCNFVRSSGMDPTFLDLWDVKTLFHEMGHAMHSILGHTKYQNLAGTRCATDFVELPSIIMEFFMSNPAVLPLYARYEGTEIPLPVQVLNHHNMVENSSAPLDLQSQICMAMVDQLFHSKVVLDPSFNSIDEVTNVTRKFSGFESAPPAAWYLQFSHLYGYSATYYSYIFDTVLASLIFSKLFAGNPLSREAGEKFRKAILRWGGSRSPWECVAEALEQPILATGGEEAMRRIGSEGIKATSTF

SEQ ID NO: 98278 - DNA, 2319 bp, Saccharomyces cerevisiae
  CDS (1)..(2319)
atgcttcgcacgataatattgaaagccgggtccaatgcctccataccgtcaccttcccgccaaaataagttactcaggttcttcgccacagccggcgcagtctctaggaccagtccaggaagcattaagaagattttcgacgacaattcatattggagaaatattaatggtcaggatgctaataatagcaagatctcacaatatctttttaaaaaaaataaaaccggacttttcaagaacccttatttgacttctccagatggtttgcgtaagtttagccaggtttctttgcagcaagcacaagaacttctcgacaaaatgaggaatgattttagcgagagtggtaaattaacctatattatgaacctggacagattaagcgatacgctatgtcgagttattgatttgtgcgagtttattaggtcaacacatccagatgatgcatttgttagggcagcacaagattgccatgaacaaatgtttgaattcatgaatgtcttgaacactgatgtttccttatgtaacatactaaagtcggttttaaacaatccagaagtgtcttcgaagttaagcgcagaagaacttaaagttggtaaaatattattggatgattttgaaaagtcaggaatctatatgaatccagatgttagagaaaagtttatccagttatctcaggaaatcagtttagtaggtcaagaattcatcaaccatacagactatcctggttcaaattctgtgaagataccatgtaaagatctggataatagtaaagtgagtacatttctattgaagcaattaaataaagatgtaaaagggcaaaattataaagtacctacatttgggtatgcagcttatgcattattaaaaagttgtgaaaatgagatggtaagaaaaaagttgtggaccgctcttcacagttgttctgacaaacaggttaaaagattgagtcacttaatcaaactaagggcaatcttggctaatttaatgcacaaaacaagttacgcagagtatcaattggaaggtaaaatggcaaagaatccgaaagatgttcaagattttattttgacgttaatgaacaatactatagagaagacagcaaatgaattgaaatttatagctgaactcaaggccaaagatcttaagaagccgttgactacaaacacggacgaaatattgaagctcgtgagaccatgggatagggattactatactggcaaatatttccagctcaacccgtcaaactctcccaatgccaaagaaataagctattattttacattaggaaatgtcattcagggcttgtcagatttgtttcagcaaatatatggtattagattagagccagcaattactgatgagggagaaacatggtccccagacgtgagaagattgaatgtgatatctgaagaggaaggaatcatcggcataatttattgtgatttattcgaacgaaatggcaagacttcaaatccggctcatttcacagtttgttgctctaggcagatatatcccagtgaaactgatttctcaaccatccaagtcggtgagaatccagacggtacctactttcaattacctgttatttctttggtgtgtaatttttctccaatactaatcgcttctaaaaaaagtctttgttttttgcagcttagtgaagttgaaacgctcttccatgaaatgggacatgcaatgcactcaatgttagggagaactcatatgcaaaacataagtggtacaagatgtgctactgattttgtagagttaccaagtatcctgatggagcacttcgctaaggatatacgaattctgacaaagattggcaaacattacgggactggagaaacaattcaggctgatatgttacagcgcttcatgaaaagcactaacttccttcaaaattgtgaaacatactctcaagcaaagatggctatgctggatcaatcatttcatgatgaaaaaatcatttctgatattgataactttgacgttgtggaaaactatcaagcactagaacgacgtttaaaggtcctagtggacgatcagagtaattggtgtggaagattcggccatttatttggatacggggcaacttattacagctacttatttgataggacgatagcttctaaaatctggtacgcccttttcgaggatgatccgtacagtcgaaaaaatggtgataaatttaaaaagcatttactaaaatggggagggctaaaagacccttggaaatgtatcgctgatgttttagaatgccccatgctagagaaaggcggtagcgatgcgatggaatttatagcacagtctcacaagtcttag

SEQ ID NO: 98279 - protein, 772 aa, Saccharomyces cerevisiae
MLRTIILKAGSNASIPSPSRQNKLLRFFATAGAVSRTSPGSIKKIFDDNSYWRNINGQDANNSKISQYLFKKNKTGLFKNPYLTSPDGLRKFSQVSLQQAQELLDKMRNDFSESGKLTYIMNLDRLSDTLCRVIDLCEFIRSTHPDDAFVRAAQDCHEQMFEFMNVLNTDVSLCNILKSVLNNPEVSSKLSAEELKVGKILLDDFEKSGIYMNPDVREKFIQLSQEISLVGQEFINHTDYPGSNSVKIPCKDLDNSKVSTFLLKQLNKDVKGQNYKVPTFGYAAYALLKSCENEMVRKKLWTALHSCSDKQVKRLSHLIKLRAILANLMHKTSYAEYQLEGKMAKNPKDVQDFILTLMNNTIEKTANELKFIAELKAKDLKKPLTTNTDEILKLVRPWDRDYYTGKYFQLNPSNSPNAKEISYYFTLGNVIQGLSDLFQQIYGIRLEPAITDEGETWSPDVRRLNVISEEEGIIGIIYCDLFERNGKTSNPAHFTVCCSRQIYPSETDFSTIQVGENPDGTYFQLPVISLVCNFSPILIASKKSLCFLQLSEVETLFHEMGHAMHSMLGRTHMQNISGTRCATDFVELPSILMEHFAKDIRILTKIGKHYGTGETIQADMLQRFMKSTNFLQNCETYSQAKMAMLDQSFHDEKIISDIDNFDVVENYQALERRLKVLVDDQSNWCGRFGHLFGYGATYYSYLFDRTIASKIWYALFEDDPYSRKNGDKFKKHLLKWGGLKDPWKCIADVLECPMLEKGGSDAMEFIAQSHKS

SEQ ID NO: 98280 - DNA, 2139 bp, Saccharomyces cerevisiae
  CDS (1)..(2139)
atgcgattgttgctgtgcaagaattggtttgcgtcacctgtaatctcaccactactgtatacccgctccttatattcaatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcactttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaagatgttaagaaacttaaccagggtgcagatccaaactactacatttgggaccaccgttactacgataacaaatatttgttagaaaacttcaatgtggacctagaaaagatttctgaatattttccactagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaa

SEQ ID NO: 98281 - protein, 712 aa, Saccharomyces cerevisiae
MRLLLCKNWFASPVISPLLYTRSLYSMANTTSFPIAPQAPPNWSFTPSDISGKTNEIINNSNNFYDSMSKVESPSVSNFVEPFMKFENELGPIINQLTFLQHVSSDKEIRDASVNSSMKLDELNIDLSLRHDIFLQFARVWQDVQSKADSVERETFKYVEKSYKDYIHSGLELDEGNRLKIKEIKKKISVNSINFSKNLGEQKEYITFTKEQLEGVPDSILTQFETIKSDKDSNETLYKVTFKYPDIFPVMKLASSAQTRKQAFLADQNKVPENEAILLDTLKLRDELASLLGYDTYANYNLYDKMAEDSTTVMNFLNDLKDKLIPLGRKELQVLQDMKAEDVKKLNQGADPNYYIWDHRYYDNKYLLENFNVDLEKISEYFPLEATITGMLEIYETLFNLKFIETKDSQNKSVWHDDVKQIAVWNMDDPKSPNFVGWIYFDLHPRDGKYGHAANFGLSSSFMIDDTTRSYPVTALVCNFSKSTKDKPSLLKHNEIVTFFHELGHGIHDLVGQNKESRFNGPGSVPWDFVEAPSQMLEFWTWNKNELINLSSHYKTGEKIPESLINSLIKTKHVNGALFTLRQLHFGLFDMKVHTCKDLQNLSICDTWNQLRQDISLISNGGTLSKGYDSFGHIMSDSYSAGYYGYLWAEVFATDMYHTKFAKDPLNAKNGIQYRDIVLARGGLYDINDNLKEFLGREPSKDAFLKELGLQN

SEQ ID NO: 98282 - DNA, 23 bp, Primer
atgacgaatccgttactgactcc

SEQ ID NO: 98283 - DNA, 25 bp, Primer
ttagcccttaatgccgtaatgctcc

SEQ ID NO: 98284 - protein, 827 aa, consensus
  MISC_FEATURE (1)..(827): consensus for the disclosure of xaa see table XV
GXXLXXXXXXXXXXXXXXXXXXLXXXFXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXRXXXXXAXXXXXXXXXXXXXXXXXXXXXXXXXXXXXXXXXXXXXXXXXXXXXXXRXXXAXLLGXXXXAXXXXXXXXMAXXXXXVXXXLXXXXXXXXXXXXXXXXXXXXXXXXXXXXXXXXXXXXXXXXXXXXXXXXXXWDXXXXXXXXXXXXXXXXXXXXXXXXXXXXYFXXXXXXXXGXXXXXXXXXGXXXXXXXXXXXXXXXXXXXXXXXXXXXXXXXVXXXXXXXXXXXXXXXXXXXXXXXXXXYXDXXXRXXXXXXXXXXXXXXXXXXXXXXXXXXXXXXXXXXXXXXKXXXAXXXXXXXXXXXXXXXXXXXXXXXXXXXXXXXXXXXXXXXXXXXXXXXXXXXXXXXXXXXXXPXXXXXXNXXXXXXXXXXXXXXXXXXXPXLXXXXXXXTXFHEXGHXXHXXXXXXXXXXXXGXXXXXXXXXXDXVEXPSXXXEXXXXXXXXXXXXXXHXXXXXXXXXXXXXXXXTXXXXXXXXXXPXXXXXXXXXXXXXXXXXXXXXXXXXXXXDXXXHXXXXXXXXXXXXXXXXXXXXXXXXXXXXXXXXXXXXXXXXXXXXXXXXXXXXXFXHXXXXXXXXXXXXXXXXXYXAXYYXYXWXXXXXXDXXXXXXXXXXXXXXXXXXXXXXXXXXXXXXXGXXXXXXXLXXGGXXXXXXXXXXXXGXXXXXXXXXXXXXXXXXXXXXXXXXXXXXXXXXXXXXXXXXXXXXXG

SEQ ID NO: 98285 - protein, 96 aa, consensus
  MISC_FEATURE (1)..(96): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 98286 - protein, 63 aa, consensus
  MISC_FEATURE (1)..(63): consensus for the disclosure of xaa see table XV
XXXXXXXXXXXXXXXXXXXXXXXXXXXXXXXXXXXXXXXXXXPXXXXXXXXXXXXXXXXXXXX

SEQ ID NO: 98287 - protein, 80 aa, consensus
  MISC_FEATURE (1)..(80): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 98288 - DNA, 864 bp, Escherichia coli; identical to SEQ ID NO: 46787
  CDS (1)..(864)

SEQ ID NO: 98289 - protein, 287 aa, Escherichia coli; identical to SEQ ID NO: 46788

SEQ ID NO: 98290 - DNA, 891 bp, Mesorhizobium loti MAFF303099; identical to SEQ ID NO: 46789
  CDS (1)..(891): transl_table=11

SEQ ID NO: 98291 - protein, 296 aa, Mesorhizobium loti MAFF303099; identical to SEQ ID NO: 46790

SEQ ID NO: 98292 - DNA, 867 bp, Borrelia burgdorferi B31; identical to SEQ ID NO: 46791
  CDS (1)..(867): transl_table=11

SEQ ID NO: 98293 - protein, 288 aa, Borrelia burgdorferi B31; identical to SEQ ID NO: 46792

SEQ ID NO: 98294 - DNA, 879 bp, Thermotoga maritima MSB8; identical to SEQ ID NO: 46793
  CDS (1)..(879): transl_table=11

SEQ ID NO: 98295 - protein, 292 aa, Thermotoga maritima MSB8; identical to SEQ ID NO: 46794

SEQ ID NO: 98296 - DNA, 885 bp, Bacillus halodurans C-125; identical to SEQ ID NO: 46795
  CDS (1)..(885): transl_table=11

SEQ ID NO: 98297 - protein, 294 aa, Bacillus halodurans C-125; identical to SEQ ID NO: 46796

SEQ ID NO: 98298 - DNA, 864 bp, Pasteurella multocida subsp. multocida str. Pm70; identical to SEQ ID NO: 46797
  CDS (1)..(864): transl_table=11

SEQ ID NO: 98299 - protein, 287 aa, Pasteurella multocida subsp. multocida str. Pm70; identical to SEQ ID NO: 46798

SEQ ID NO: 98300 - DNA, 864 bp, Pseudomonas aeruginosa PAO1; identical to SEQ ID NO: 46799
  CDS (1)..(864): transl_table=11

SEQ ID NO: 98301 - protein, 287 aa, Pseudomonas aeruginosa PAO1; identical to SEQ ID NO: 46800

SEQ ID NO: 98302 - DNA, 885 bp, Neisseria meningitidis Z2491; identical to SEQ ID NO: 46801
  CDS (1)..(885): transl_table=11

SEQ ID NO: 98303 - protein, 294 aa, Neisseria meningitidis Z2491; identical to SEQ ID NO: 46802

SEQ ID NO: 98304 - DNA, 879 bp, Clostridium acetobutylicum ATCC 824; identical to SEQ ID NO: 46803
  CDS (1)..(879): transl_table=11

SEQ ID NO: 98305 - protein, 292 aa, Clostridium acetobutylicum ATCC 824; identical to SEQ ID NO: 46804

SEQ ID NO: 98306 - DNA, 888 bp, Sinorhizobium meliloti 1021; identical to SEQ ID NO: 46805
  CDS (1)..(888): transl_table=11

SEQ ID NO: 98307 - protein, 295 aa, Sinorhizobium meliloti 1021; identical to SEQ ID NO: 46806

SEQ ID NO: 98308 - DNA, 876 bp, Bacillus subtilis subsp. subtilis str. 168; identical to SEQ ID NO: 46807
  CDS (1)..(876): transl_table=11

SEQ ID NO: 98309 - protein, 291 aa, Bacillus subtilis subsp. subtilis str. 168; identical to SEQ ID NO: 46808

SEQ ID NO: 98310 - DNA, 882 bp, Caulobacter crescentus CB15; identical to SEQ ID NO: 46809
  CDS (1)..(882): transl_table=11

SEQ ID NO: 98311 - protein, 293 aa, Caulobacter crescentus CB15; identical to SEQ ID NO: 46810

SEQ ID NO: 98312 - DNA, 864 bp, Salmonella typhimurium LT2; identical to SEQ ID NO: 46811
  CDS (1)..(864): transl_table=11

SEQ ID NO: 98313 - protein, 287 aa, Salmonella typhimurium LT2; identical to SEQ ID NO: 46812

SEQ ID NO: 98314 - DNA, 876 bp, Listeria innocua Clip11262; identical to SEQ ID NO: 46813
  CDS (1)..(876): transl_table=11

SEQ ID NO: 98315 - protein, 291 aa, Listeria innocua Clip11262; identical to SEQ ID NO: 46814

SEQ ID NO: 98316 - DNA, 888 bp, Agrobacterium tumefaciens str. C58; identical to SEQ ID NO: 46815
  CDS (1)..(888): transl_table=11

SEQ ID NO: 98317 - protein, 295 aa, Agrobacterium tumefaciens str. C58; identical to SEQ ID NO: 46816

SEQ ID NO: 98318 - DNA, 945 bp, Brucella melitensis 16M; identical to SEQ ID NO: 46817
  CDS (1)..(945): transl_table=11

SEQ ID NO: 98319 - protein, 314 aa, Brucella melitensis 16M; identical to SEQ ID NO: 46818

SEQ ID NO: 98320 - DNA, 885 bp, Clostridium perfringens str. 13; identical to SEQ ID NO: 46819
  CDS (1)..(885): transl_table=11

SEQ ID NO: 98321 - protein, 294 aa, Clostridium perfringens str. 13; identical to SEQ ID NO: 46820

SEQ ID NO: 98322 - DNA, 879 bp, Fusobacterium nucleatum subsp. nucleatum ATCC 25586; identical to SEQ ID NO: 46821
  CDS (1)..(879): transl_table=11

SEQ ID NO: 98323 - protein, 292 aa, Fusobacterium nucleatum subsp. nucleatum ATCC 25586; identical to SEQ ID NO: 46822

SEQ ID NO: 98324 - DNA, 873 bp, Thermoanaerobacter tengcongensis MB4; identical to SEQ ID NO: 46823
  CDS (1)..(873): transl_table=11

SEQ ID NO: 98325 - protein, 290 aa, Thermoanaerobacter tengcongensis MB4; identical to SEQ ID NO: 46824

SEQ ID NO: 98326 - DNA, 888 bp, Chlorobium tepidum TLS; identical to SEQ ID NO: 46825
  CDS (1)..(888): transl_table=11

SEQ ID NO: 98327 - protein, 295 aa, Chlorobium tepidum TLS; identical to SEQ ID NO: 46826

SEQ ID NO: 98328 - DNA, 864 bp, Yersinia pestis KIM; identical to SEQ ID NO: 46827
  CDS (1)..(864): transl_table=11

SEQ ID NO: 98329 - protein, 287 aa, Yersinia pestis KIM; identical to SEQ ID NO: 46828

SEQ ID NO: 98330 - DNA, 900 bp, Brucella suis 1330; identical to SEQ ID NO: 46829
  CDS (1)..(900): transl_table=11

SEQ ID NO: 98331 - protein, 299 aa, Brucella suis 1330; identical to SEQ ID NO: 46830

SEQ ID NO: 98332 - DNA, 864 bp, Shewanella oneidensis MR-1; identical to SEQ ID NO: 46831
  CDS (1)..(864): transl_table=11

SEQ ID NO: 98333 - protein, 287 aa, Shewanella oneidensis MR-1; identical to SEQ ID NO: 46832

SEQ ID NO: 98334 - DNA, 951 bp, Pseudomonas putida KT2440; identical to SEQ ID NO: 46833
  CDS (1)..(951): transl_table=11

SEQ ID NO: 98335 - protein, 316 aa, Pseudomonas putida KT2440; identical to SEQ ID NO: 46834

SEQ ID NO: 98336 - DNA, 888 bp, Bradyrhizobium japonicum USDA 110; identical to SEQ ID NO: 46835
  CDS (1)..(888)

SEQ ID NO: 98337 - protein, 295 aa, Bradyrhizobium japonicum USDA 110; identical to SEQ ID NO: 46836

SEQ ID NO: 98338 - DNA, 864 bp, Xylella fastidiosa Temecula1; identical to SEQ ID NO: 46837
  CDS (1)..(864): transl_table=11

SEQ ID NO: 98339 - protein, 287 aa, Xylella fastidiosa Temecula1; identical to SEQ ID NO: 46838

SEQ ID NO: 98340 - DNA, 888 bp, Clostridium tetani E88; identical to SEQ ID NO: 46839
  CDS (1)..(888): transl_table=11

SEQ ID NO: 98341 - protein, 295 aa, Clostridium tetani E88; identical to SEQ ID NO: 46840

SEQ ID NO: 98342 - DNA, 867 bp, Vibrio parahaemolyticus RIMD 2210633; identical to SEQ ID NO: 46841
  CDS (1)..(867): transl_table=11

SEQ ID NO: 98343 - protein, 288 aa, Vibrio parahaemolyticus RIMD 2210633; identical to SEQ ID NO: 46842

SEQ ID NO: 98344 - DNA, 867 bp, Bacteroides thetaiotaomicron VPI-5482; identical to SEQ ID NO: 46843
  CDS (1)..(867): transl_table=11

SEQ ID NO: 98345 - protein, 288 aa, Bacteroides thetaiotaomicron VPI-5482; identical to SEQ ID NO: 46844

SEQ ID NO: 98346 - DNA, 885 bp, Enterococcus faecalis V583; identical to SEQ ID NO: 46845
  CDS (1)..(885): transl_table=11

SEQ ID NO: 98347 - protein, 294 aa, Enterococcus faecalis V583; identical to SEQ ID NO: 46846

SEQ ID NO: 98348 - DNA, 864 bp, Coxiella burnetii RSA 493; identical to SEQ ID NO: 46847
  CDS (1)..(864): transl_table=11

SEQ ID NO: 98349 - protein, 287 aa, Coxiella burnetii RSA 493; identical to SEQ ID NO: 46848

SEQ ID NO: 98350 - DNA, 876 bp, Bacillus cereus ATCC 14579; identical to SEQ ID NO: 46849
  CDS (1)..(876): transl_table=11

SEQ ID NO: 98351 - protein, 291 aa, Bacillus cereus ATCC 14579; identical to SEQ ID NO: 46850

SEQ ID NO: 98352 - DNA, 867 bp, Nitrosomonas europaea ATCC 19718; identical to SEQ ID NO: 46851
  CDS (1)..(867): transl_table=11

SEQ ID NO: 98353 - protein, 288 aa, Nitrosomonas europaea ATCC 19718; identical to SEQ ID NO: 46852

SEQ ID NO: 98354 - DNA, 1029 bp, Rhodopirellula baltica SH 1; identical to SEQ ID NO: 46853
  CDS (1)..(1029): transl_table=11

SEQ ID NO: 98355 - protein, 342 aa, Rhodopirellula baltica SH 1; identical to SEQ ID NO: 46854

SEQ ID NO: 98356 - DNA, 864 bp, Wigglesworthia glossinidia endosymbiont of Glossina brevipalpis; identical to SEQ ID NO: 46855
  CDS (1)..(864): transl_table=11

SEQ ID NO: 98357 - protein, 287 aa, Wigglesworthia glossinidia endosymbiont of Glossina brevipalpis; identical to SEQ ID NO: 46856

SEQ ID NO: 98358 - DNA, 873 bp, Candidatus Blochmannia floridanus; identical to SEQ ID NO: 46857
  CDS (1)..(873): transl_table=11

SEQ ID NO: 98359 - protein, 290 aa, Candidatus Blochmannia floridanus; identical to SEQ ID NO: 46858

SEQ ID NO: 98360 - DNA, 927 bp, Bordetella bronchiseptica RB50; identical to SEQ ID NO: 46859
  CDS (1)..(927): transl_table=11

SEQ ID NO: 98361 - protein, 308 aa, Bordetella bronchiseptica RB50; identical to SEQ ID NO: 46860

SEQ ID NO: 98362 - DNA, 867 bp, Chromobacterium violaceum ATCC 12472; identical to SEQ ID NO: 46861
  CDS (1)..(867): transl_table=11

SEQ ID NO: 98363 - protein, 288 aa, Chromobacterium violaceum ATCC 12472; identical to SEQ ID NO: 46862

SEQ ID NO: 98364 - DNA, 891 bp, Porphyromonas gingivalis W83; identical to SEQ ID NO: 46863
  CDS (1)..(891): transl_table=11

SEQ ID NO: 98365 - protein, 296 aa, Porphyromonas gingivalis W83; identical to SEQ ID NO: 46864

SEQ ID NO: 98366 - DNA, 864 bp, Photorhabdus luminescens subsp. laumondii TTO1; identical to SEQ ID NO: 46865
  CDS (1)..(864): transl_table=11

SEQ ID NO: 98367 - protein, 287 aa, Photorhabdus luminescens subsp. laumondii TTO1; identical to SEQ ID NO: 46866

SEQ ID NO: 98368 - DNA, 888 bp, Rhodopseudomonas palustris CGA009; identical to SEQ ID NO: 46867
  CDS (1)..(888): transl_table=11

SEQ ID NO: 98369 - protein, 295 aa, Rhodopseudomonas palustris CGA009; identical to SEQ ID NO: 46868

SEQ ID NO: 98370 - DNA, 879 bp, Bdellovibrio bacteriovorus HD100; identical to SEQ ID NO: 46869
  CDS (1)..(879): transl_table=11

SEQ ID NO: 98371 - protein, 292 aa, Bdellovibrio bacteriovorus HD100; identical to SEQ ID NO: 46870

SEQ ID NO: 98372 - DNA, 867 bp, Treponema denticola ATCC 35405; identical to SEQ ID NO: 46871
  CDS (1)..(867): transl_table=11

SEQ ID NO: 98373 - protein, 288 aa, Treponema denticola ATCC 35405; identical to SEQ ID NO: 46872

SEQ ID NO: 98374 - DNA, 885 bp, Parachlamydia sp. UWE25; identical to SEQ ID NO: 46873
  CDS (1)..(885): transl_table=11

SEQ ID NO: 98375 - protein, 294 aa, Parachlamydia sp. UWE25; identical to SEQ ID NO: 46874

SEQ ID NO: 98376 - DNA, 882 bp, Desulfovibrio vulgaris subsp. vulgaris str. Hildenborough; identical to SEQ ID NO: 46875
  CDS (1)..(882): transl_table=11

SEQ ID NO: 98377 - protein, 293 aa, Desulfovibrio vulgaris subsp. vulgaris str. Hildenborough; identical to SEQ ID NO: 46876

SEQ ID NO: 98378 - DNA, 864 bp, Erwinia carotovora subsp. atroseptica SCRI1043; identical to SEQ ID NO: 46877
  CDS (1)..(864)

SEQ ID NO: 98379 - protein, 287 aa, Erwinia carotovora subsp. atroseptica SCRI1043; identical to SEQ ID NO: 46878

SEQ ID NO: 98380 - DNA, 894 bp, Desulfotalea psychrophila LSv54; identical to SEQ ID NO: 46879
  CDS (1)..(894): transl_table=11

SEQ ID NO: 98381 - protein, 297 aa, Desulfotalea psychrophila LSv54; identical to SEQ ID NO: 46880

SEQ ID NO: 98382 - DNA, 870 bp, Borrelia garinii PBi; identical to SEQ ID NO: 46881
  CDS (1)..(870): transl_table=11

SEQ ID NO: 98383 - protein, 289 aa, Borrelia garinii PBi; identical to SEQ ID NO: 46882

SEQ ID NO: 98384 - DNA, 879 bp, Symbiobacterium thermophilum IAM 14863; identical to SEQ ID NO: 46883
  CDS (1)..(879): transl_table=11

SEQ ID NO: 98385 - protein, 292 aa, Symbiobacterium thermophilum IAM 14863; identical to SEQ ID NO: 46884

SEQ ID NO: 98386 - DNA, 864 bp, Mannheimia succiniciproducens MBEL55E; identical to SEQ ID NO: 46885
  CDS (1)..(864): transl_table=11

SEQ ID NO: 98387 - protein, 287 aa, Mannheimia succiniciproducens MBEL55E; identical to SEQ ID NO: 46886

SEQ ID NO: 98388 - DNA, 876 bp, Bacillus licheniformis ATCC 14580; identical to SEQ ID NO: 46887
  CDS (1)..(876): transl_table=11

SEQ ID NO: 98389 - protein, 291 aa, Bacillus licheniformis ATCC 14580; identical to SEQ ID NO: 46888

SEQ ID NO: 98390 - DNA, 870 bp, Methylococcus capsulatus str. Bath; identical to SEQ ID NO: 46889
  CDS (1)..(870): transl_table=11

SEQ ID NO: 98391 - protein, 289 aa, Methylococcus capsulatus str. Bath; identical to SEQ ID NO: 46890

SEQ ID NO: 98392 - DNA, 867 bp, Legionella pneumophila str. Paris; identical to SEQ ID NO: 46891
  CDS (1)..(867): transl_table=11

SEQ ID NO: 98393 - protein, 288 aa, Legionella pneumophila str. Paris; identical to SEQ ID NO: 46892

SEQ ID NO: 98394 - DNA, 864 bp, Photobacterium profundum SS9; identical to SEQ ID NO: 46893
  CDS (1)..(864): transl_table=11

SEQ ID NO: 98395 - protein, 287 aa, Photobacterium profundum SS9; identical to SEQ ID NO: 46894

SEQ ID NO: 98396 - DNA, 876 bp, Geobacillus kaustophilus HTA426; identical to SEQ ID NO: 46895
  CDS (1)..(876): transl_table=11

SEQ ID NO: 98397 - protein, 291 aa, Geobacillus kaustophilus HTA426; identical to SEQ ID NO: 46896

SEQ ID NO: 98398 - DNA, 864 bp, Idiomarina loihiensis L2TR; identical to SEQ ID NO: 46897
  CDS (1)..(864): transl_table=11

SEQ ID NO: 98399 - protein, 287 aa, Idiomarina loihiensis L2TR; identical to SEQ ID NO: 46898

SEQ ID NO: 98400 - DNA, 867 bp, Azoarcus sp. EbN1; identical to SEQ ID NO: 46899
  CDS (1)..(867): transl_table=11

SEQ ID NO: 98401 - protein, 288 aa, Azoarcus sp. EbN1; identical to SEQ ID NO: 46900

SEQ ID NO: 98402 - DNA, 891 bp, Silicibacter pomeroyi DSS-3; identical to SEQ ID NO: 46901
  CDS (1)..(891): transl_table=11

SEQ ID NO: 98403 - protein, 296 aa, Silicibacter pomeroyi DSS-3; identical to SEQ ID NO: 46902

SEQ ID NO: 98404 - DNA, 891 bp, Rhodobacter sphaeroides 2.4.1; identical to SEQ ID NO: 46903
  CDS (1)..(891)

SEQ ID NO: 98405 - protein, 296 aa, Rhodobacter sphaeroides 2.4.1; identical to SEQ ID NO: 46904

SEQ ID NO: 98406 - DNA, 870 bp, Desulfitobacterium hafniense DCB-2; identical to SEQ ID NO: 46905
  CDS (1)..(870)

SEQ ID NO: 98407 - protein, 289 aa, Desulfitobacterium hafniense DCB-2; identical to SEQ ID NO: 46906

SEQ ID NO: 98408 - DNA, 864 bp, Actinobacillus pleuropneumoniae serovar 1 str. 4074; identical to SEQ ID NO: 46907
  CDS (1)..(864)

SEQ ID NO: 98409 - protein, 287 aa, Actinobacillus pleuropneumoniae serovar 1 str. 4074; identical to SEQ ID NO: 46908

SEQ ID NO: 98410 - DNA, 855 bp, Dechloromonas aromatica RCB; identical to SEQ ID NO: 46909
  CDS (1)..(855)

SEQ ID NO: 98411 - protein, 284 aa, Dechloromonas aromatica RCB; identical to SEQ ID NO: 46910

SEQ ID NO: 98412 - DNA, 867 bp, Methylobacillus flagellatus KT; identical to SEQ ID NO: 46911
  CDS (1)..(867)

SEQ ID NO: 98413 - protein, 288 aa, Methylobacillus flagellatus KT; identical to SEQ ID NO: 46912

SEQ ID NO: 98414 - DNA, 900 bp, Magnetospirillum magnetotacticum MS-1; identical to SEQ ID NO: 46913
  CDS (1)..(900)

SEQ ID NO: 98415 - protein, 299 aa, Magnetospirillum magnetotacticum MS-1; identical to SEQ ID NO: 46914

SEQ ID NO: 98416 - DNA, 822 bp, Rubrivivax gelatinosus PM1; identical to SEQ ID NO: 46915
  CDS (1)..(822)

SEQ ID NO: 98417 - protein, 273 aa, Rubrivivax gelatinosus PM1; identical to SEQ ID NO: 46916

SEQ ID NO: 98418 - DNA, 888 bp, Rhodospirillum rubrum; identical to SEQ ID NO: 46917
  CDS (1)..(888)

SEQ ID NO: 98419 - protein, 295 aa, Rhodospirillum rubrum; identical to SEQ ID NO: 46918

SEQ ID NO: 98420 - DNA, 936 bp, Ralstonia metallidurans CH34; identical to SEQ ID NO: 46919
  CDS (1)..(936)

SEQ ID NO: 98421 - protein, 311 aa, Ralstonia metallidurans CH34; identical to SEQ ID NO: 46920

SEQ ID NO: 98422 - DNA, 924 bp, Burkholderia fungorum LB400; identical to SEQ ID NO: 46921
  CDS (1)..(924)

SEQ ID NO: 98423 - protein, 307 aa, Burkholderia fungorum LB400; identical to SEQ ID NO: 46922

SEQ ID NO: 98424 - DNA, 882 bp, Enterococcus faecium; identical to SEQ ID NO: 46923
  CDS (1)..(882)

SEQ ID NO: 98425 - protein, 293 aa, Enterococcus faecium; identical to SEQ ID NO: 46924

SEQ ID NO: 98426 - DNA, 888 bp, Magnetococcus sp. MC-1; identical to SEQ ID NO: 46925
  CDS (1)..(888)

SEQ ID NO: 98427 - protein, 295 aa, Magnetococcus sp. MC-1; identical to SEQ ID NO: 46926

SEQ ID NO: 98428 - DNA, 879 bp, Geobacter metallireducens GS-15; identical to SEQ ID NO: 46927
  CDS (1)..(879)

SEQ ID NO: 98429 - protein, 292 aa, Geobacter metallireducens GS-15; identical to SEQ ID NO: 46928

SEQ ID NO: 98430 - DNA, 870 bp, Cytophaga hutchinsonii; identical to SEQ ID NO: 46929
  CDS (1)..(870)

SEQ ID NO: 98431 - protein, 289 aa, Cytophaga hutchinsonii; identical to SEQ ID NO: 46930

SEQ ID NO: 98432 - DNA, 885 bp, Clostridium thermocellum ATCC 27405; identical to SEQ ID NO: 46931
  CDS (1)..(885)

SEQ ID NO: 98433 - protein, 294 aa, Clostridium thermocellum ATCC 27405; identical to SEQ ID NO: 46932

SEQ ID NO: 98434 - DNA, 855 bp, Microbulbifer degradans 2-40; identical to SEQ ID NO: 46933
  CDS (1)..(855)

SEQ ID NO: 98435 - protein, 284 aa, Microbulbifer degradans 2-40; identical to SEQ ID NO: 46934

SEQ ID NO: 98436 - DNA, 879 bp, Moorella thermoacetica ATCC 39073; identical to SEQ ID NO: 46935
  CDS (1)..(879)

SEQ ID NO: 98437 - protein, 292 aa, Moorella thermoacetica ATCC 39073; identical to SEQ ID NO: 46936

SEQ ID NO: 98438 - DNA, 867 bp, Thiobacillus denitrificans ATCC 25259; identical to SEQ ID NO: 46937
  CDS (1)..(867)

SEQ ID NO: 98439 - protein, 288 aa, Thiobacillus denitrificans ATCC 25259; identical to SEQ ID NO: 46938

SEQ ID NO: 98440 - DNA, 882 bp, Silicibacter sp. TM1040; identical to SEQ ID NO: 46939
  CDS (1)..(882)

SEQ ID NO: 98441 - protein, 293 aa, Silicibacter sp. TM1040; identical to SEQ ID NO: 46940

SEQ ID NO: 98442 - DNA, 873 bp, Azotobacter vinelandii; identical to SEQ ID NO: 46941
  CDS (1)..(873)

SEQ ID NO: 98443 - protein, 290 aa, Azotobacter vinelandii; identical to SEQ ID NO: 46942

SEQ ID NO: 98444 - DNA, 903 bp, Polaromonas sp. JS666; identical to SEQ ID NO: 46943
  CDS (1)..(903)

SEQ ID NO: 98445 - protein, 300 aa, Polaromonas sp. JS666; identical to SEQ ID NO: 46944

SEQ ID NO: 98446 - DNA, 864 bp, Haemophilus influenzae; identical to SEQ ID NO: 46945
  CDS (1)..(864): transl_table=11

SEQ ID NO: 98447 - protein, 287 aa, Haemophilus influenzae; identical to SEQ ID NO: 46946

SEQ ID NO: 98448 - DNA, 22 bp, Primer
atgatccgcagtatgaccgcct

SEQ ID NO: 98449 - DNA, 24 bp, Primer
ttattcgatgttctgaatctgctc

SEQ ID NO: 98450 - protein, 338 aa, consensus; identical to SEQ ID NO: 46949
  MISC_FEATURE (1)..(338): consensus for the disclosure of xaa see table XV

SEQ ID NO: 98451 - protein, 73 aa, consensus; identical to SEQ ID NO: 46950
  MISC_FEATURE (1)..(73): consensus for the disclosure of xaa see table XV

SEQ ID NO: 98452 - protein, 101 aa, consensus; identical to SEQ ID NO: 46951
  MISC_FEATURE (1)..(101): consensus for the disclosure of xaa see table XV

SEQ ID NO: 98453 - DNA, 957 bp, Escherichia coli
  CDS (1)..(957)
atgacgcagacttccgcatttcattttgaatcgctggtgtgggactggccgattgccatctacctgtttttgattggtatttctgctggtctggtgacgctggccgtgctgttacgtcgcttctacccgcaggcgggcggtgcagacagtacgttgctgcgcaccacgctgattgtcgggccgggcgcggtgatcctcggtctgttgatcctcgtcttccacctgacaagaccgtggaccttctggaagctgatgttccactacagttttacctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcagtttgtacaccgtatggaaatccctgtggtatggggtgaaatcttcctgctggtggcgttttttgtcggtctggcgctgggcgatgacggtaaagttcgtgcgctggtggcggcattaggtggcggtttctggacgtggtggttctggcttggtgtcgccgggctggggctgattgtgccaatgctgctcaaaccgtgggtcaatcgcagttccggcattcctgccgtgctggcggcgtgtggggccagtctggtcggcgtgttgatgctgcgctttttcattctctacgccggacagttgacggtggcgtaa

SEQ ID NO: 98454 - protein, 318 aa, Escherichia coli
MTQTSAFHFESLVWDWPIAIYLFLIGISAGLVTLAVLLRRFYPQAGGADSTLLRTTLIVGPGAVILGLLILVFHLTRPWTFWKLMFHYSFTSVMSMGVMLFQLYMVVLVLWLAKIFEHDLLALQQRWLPKLGIVQKVLSLLTPVHRGLETLMLVLAVLLGAYTGFLLSALKSYPFLNNPILPVLFLFSGISSGAAVALIAMAIRQRSNPHSTEAQFVHRMEIPVVWGEIFLLVAFFVGLALGDDGKVRALVAALGGGFWTWWFWLGVAGLGLIVPMLLKPWVNRSSGIPAVLAACGASLVGVLMLRFFILYAGQLTVA

SEQ ID NO: 98455 - DNA, 918 bp, Archaeoglobus fulgidus DSM 4304
  CDS (1)..(918): transl_table=11
atgctcatcctgaatccccagcattattacctcctccagcagccctggtggggaatactgattgcattctacctcttcctcggcggtttgggagcgatggccttctgcatcagcttctacttctggaggcagaagggaagccagtcgctggttgtgggaggttcgctgctcggactgatagctgtcttaatcggtacgcttttcctgatccttgacctcggacatccggagaggttctacttagtccttctgagcccgaggctcaacccctcatcctggattgtgataggctcaacgcttctctctgcgttcatgctgttcgcagcgctctttgtcgctccaatgctccgctggttcaaatgggtgccatgggcaaaaagcgaggctgcaatcagagcgttcggatggcttgccttcatcacaggaatcggcgttgctgcatacacgggcatactcataggaattgtcttcaacatccccttctggaacgctcctgctctaccggtgatattcatgatttcagccctctcaacaggcttagcatcgctgatactgctgatgctcgtggttgacagagaggctcatgaaattcacgtgatggcaaaaacagacggcttcgtaatgatcttcgagctgatagttctgtcgatattcctgctgattaggagctacgggccggttgctgccatagagtctgtgaacacagtccttttcggatggctcgccccctacttcgttggaggagtgctattgatgggcctcgccattccgataatgctcatattcggctacgaggtaaaaagaccgggagtaacggcggtgacagtgatatcggcaatattcgtcctggttggcggagctttgctgaggtacgtcgttcttgaggcgggaatactgcagattccctgctgcatctaa

SEQ ID NO: 98456 - protein, 305 aa, Archaeoglobus fulgidus DSM 4304
MLILNPQHYYLLQQPWWGILIAFYLFLGGLGAMAFCISFYFWRQKGSQSLVVGGSLLGLIAVLIGTLFLILDLGHPERFYLVLLSPRLNPSSWIVIGSTLLSAFMLFAALFVAPMLRWFKWVPWAKSEAAIRAFGWLAFITGIGVAAYTGILIGIVFNIPFWNAPALPVIFMISALSTGLASLILLMLVVDREAHEIHVMAKTDGFVMIFELIVLSIFLLIRSYGPVAAIESVNTVLFGWLAPYFVGGVLLMGLAIPIMLIFGYEVKRPGVTAVTVISAIFVLVGGALLRYVVLEAGILQIPCCI

SEQ ID NO: 98457 - DNA, 960 bp, Pasteurella multocida subsp. multocida str. Pm70
  CDS (1)..(960): transl_table=11
atgaacagtccatttcatttcccgtctttagtatgggatcataccatcgccgtttatttgttcttattggggatctctgccggtgcaaccatgttagccgttttgttaaaacgcgcagggctagctggcgcagaaccgtcaaacaatcatgtgatacgttgtacggcatttttggcgccattaagtctgattattggcttggtgattttgattttccatttaactaagccatggaccttttggtacttgatgtttaattacagtaccacctctattatgtcgatgggggttatgctattccaggcctacatgttgtttttactggtctggttagcgattattttccatcagcttgtggcaactttaattgagcaatatgccaaaccgttacgatttgtgaataaattgattgcttttgctgccaaattcactggattaattgaaattattttgataattctctctgtgttattgggcgcctatacgggcttcttattatcggctttgattagctacccaatgttgaataacccagtgttaccaattttattcttggcctcagggacatcctcaggtattgcggcattaattttctgtaccttgctctttactaaagaagacacccattcacctgcgttaggcttcttacataagtttgaattgccggtagtgttgatggaaatctttttacttgccgccttctttattggcttgtatttagggggcggtcaaaaaacggtggcatttgagaccgcacttttaggtggattctgggcacatgtcttctggattggggtagttggtattggtttagtcttgccattactcctcaatggcatagccactccgcagttaaaacatcgcaaaggctttatgctactggtggcttgcttaggcttaattggcgtgttatgtttgcgtttctttatcctctatgcaggacaaatgacgctagcataa

SEQ ID NO: 98458 - protein, 319 aa, Pasteurella multocida subsp. multocida str. Pm70
MNSPFHFPSLVWDHTIAVYLFLLGISAGATMLAVLLKRAGLAGAEPSNNHVIRCTAFLAPLSLIIGLVILIFHLTKPWTFWYLMFNYSTTSIMSMGVMLFQAYMLFLLVWLAIIFHQLVATLIEQYAKPLRFVNKLIAFAAKFTGLIEIILIILSVLLGAYTGFLLSALISYPMLNNPVLPILFLASGTSSGIAALIFCTLLFTKEDTHSPALGFLHKFELPVVLMEIFLLAAFFIGLYLGGGQKTVAFETALLGGFWAHVFWIGVVGIGLVLPLLLNGIATPQLKHRKGFMLLVACLGLIGVLCLRFFILYAGQMTLA

SEQ ID NO: 98459 - DNA, 873 bp, Pyrobaculum aerophilum str. IM2
  CDS (1)..(873): transl_table=11
atgacggcgtttcaagaaatctgggccccctggctaattggcccgttcctctggcttgccggcattgctggaatgggctttgtcgcatacgtcttactcaagtggataggcgttgaggagagaaagagggagtttagctggattttgttcttatcaattgtacttgctctggtatttgtaatagctgatctctccaggccgtggaatatgccctctgctattatgagcgcggtgttcagcggcacattcggctggacgaagagctggatggccgtgggaatagtaattctattactcggcttaatactggcgctgttagtggccgttagaaatagcggcgtgaaggcgatagcgccactgacagactcaaagtggttcgacatattgttagcgcttgttggcatcgccattactatatacagcggttttctaattgctgcgacaccgggcgtgccgttttggaatactgctttgctgccagtgctctggattattagcgcttcggtctgcgccgttgcattagtaaagctaatgatccacaacgaagttgcgtctaagacggctacacgcttcggcgtagcgcttgacgttgcaaagctgttagcaatattcgcgttaataagcctgtcactatacggtggaagcatcgcggcgagacaaagcgcctatgcccttgcctatggcgaattggcggcgccgttttggataggcgtagtgggagtaggagttgtgatacccctactgctaggactcgcgctacttaaaaaagaaaataaactcttgggcataatcgctgcaattctggcgctaataggagcattactgctaagagtactcatactacaagcgggaatattcgaaccgcttgtttaa

SEQ ID NO: 98460 - protein, 290 aa, Pyrobaculum aerophilum str. IM2
MTAFQEIWAPWLIGPFLWLAGIAGMGFVAYVLLKWIGVEERKREFSWILFLSIVLALVFVIADLSRPWNMPSAIMSAVFSGTFGWTKSWMAVGIVILLLGLILALLVAVRNSGVKAIAPLTDSKWFDILLALVGIAITIYSGFLIAATPGVPFWNTALLPVLWIISASVCAVALVKLMIHNEVASKTATRFGVALDVAKLLAIFALISLSLYGGSIAARQSAYALAYGELAAPFWIGVVGVGVVIPLLLGLALLKKENKLLGIIAAILALIGALLLRVLILQAGIFEPLV

SEQ ID NO: 98461 - DNA, 921 bp, Chlorobium tepidum TLS
  CDS (1)..(921): transl_table=11
atgacctttgtacatcaggaagtatggcactggcagatcgcaacctacctgtttctgggcggtctgggcggcgcgacgttcgccatcagcgcggtgcttcacctcttcgaggggtgcgaccgcaaaatgctttccgtggccgtcatgtcgtcgatagcgtttctggtcatcggcactgtgttcctgctcgccgacatgcttcagccgctgaaagcaatctatgccctgaccaatccgcgctcgtggattttctggggtgtggtcttcatcaacgcctacttcgtcgcagccatcgcctatgtgattccgctgctcgaagagtggccgatgctacagccaatcatacagaaaatccccgcgccgatcctcggcctgctcgaacgcttcaacaagctggtcgccctcggcggctcggcagccggattcctcgtggcgatctacaccggcctgttgatctcggccgctccagcgatcaacttctggaacaccccggcattgccgctgctcttcgtgatctccggcttctcgaccggcgcggcctggctgctcctgctctcgatgctctccagcaaccccggcgcacaggctatcagcgccaagctcgaacagctcgacgccatactgatcgtcacagaacttattattctcggtgcatacttcaacttcgccatgttcctgcccaccagcgcgcgcgcctcggcggagttcctgttccacagcccggtcttcatcgtcggcttcttcgtggctggtcttttggtgccgctcgccattgaaagctggggcatcttcttcggcggccattcggagaaggacaaaccgaagctgacgatgctgctcgccagcgctctggtgcttgtcggcggctacctcctgcgtatctacgtactcaaagccggcatgttccagtacccctggtaa

SEQ ID NO: 98462 - protein, 306 aa, Chlorobium tepidum TLS
MTFVHQEVWHWQIATYLFLGGLGGATFAISAVLHLFEGCDRKMLSVAVMSSIAFLVIGTVFLLADMLQPLKAIYALTNPRSWIFWGVVFINAYFVAAIAYVIPLLEEWPMLQPIIQKIPAPILGLLERFNKLVALGGSAAGFLVAIYTGLLISAAPAINFWNTPALPLLFVISGFSTGAAWLLLLSMLSSNPGAQAISAKLEQLDAILIVTELIILGAYFNFAMFLPTSARASAEFLFHSPVFIVGFFVAGLLVPLAIESWGIFFGGHSEKDKPKLTMLLASALVLVGGYLLRIYVLKAGMFQYPW

SEQ ID NO: 98463 - DNA, 936 bp, Shewanella oneidensis MR-1
  CDS (1)..(936): transl_table=11
atggattttaccctaggactctcccaaggcgttgcttggccttggccgattgcagtgtatttgtttttcgcggggatttcgggcggggcgttaaccattgcgctggcactgcgtttttacttaggtcaggtggaaaataccgccttcttaaaagcggcgaccctgctgtcctttgtcaccattagcttagggatgttatgtctagttcttgacttaactaaccccttattcttctggcgaattttggtgttctataacttaaattctgtgatgtcaattggtgttattgcgctgtcggtgtatatcccgttagtcgcagtagtcgctcttttagccctcgaaaaagagctgatggccatcccacaattgaagttcttagcgccgattattgccaagttaaaaggctttagacggccaatggaagcgctcgcgttagtgctggcgttatctgtgtgtgcttacactggtttcttgatttcagcgctgatccgcttcccgctgatcaacacctcggtactcccagcgctatttattgcctcgggtctatctgcgggtggagcttcagccaaaatgctggcggtatggttatttaaagaacccctgcacagcggtgaaatgaagattctgcacggtgctgagtggccaattatgttcgccgaagccatgtttattttcatgatcgcgacagcgttgttaactggtaatgcgggtggtcaatttgcctttgccgccttccatgaaggtgtgtgggcaagcgtattctggattggtgtcgtgggtatcggctttgccgcgccactgctactcaattttgcgacgggtaaacattttagtcattcggccaaagcgttttatatgtcgggaatgtgtgcggtagtggggatgatgtgtctacgactctttatcctgttagctggccaaaattacgcgatttag

SEQ ID NO: 98464 - protein, 311 aa, Shewanella oneidensis MR-1
MDFTLGLSQGVAWPWPIAVYLFFAGISGGALTIALALRFYLGQVENTAFLKAATLLSFVTISLGMLCLVLDLTNPLFFWRILVFYNLNSVMSIGVIALSVYIPLVAVVALLALEKELMAIPQLKFLAPIIAKLKGFRRPMEALALVLALSVCAYTGFLISALIRFPLINTSVLPALFIASGLSAGGASAKMLAVWLFKEPLHSGEMKILHGAEWPIMFAEAMFIFMIATALLTGNAGGQFAFAAFHEGVWASVFWIGVVGIGFAAPLLLNFATGKHFSHSAKAFYMSGMCAVVGMMCLRLFILLAGQNYAI

SEQ ID NO: 98465 - DNA, 945 bp, Shewanella oneidensis MR-1
  CDS (1)..(945): transl_table=11
atgaacaatacttggggcgatatggcgcaatatgatcccgtcacttggcactgggtcatcgccgtgtatctgtttatggcgggtttatccgccggaagtttgctgattggtatcggtttgcgttggttcaatcaagaacaaacgcaagttgagagcaatatcctcaaggccgcggcaattattggccctgtggccatcagcttaggcttggcttgtttagtgtttgatttaactaagcctttccacttctggttgattttaattaactacaacttccagtcagtgatggcgattggggtattagcgctgctggcttactcacccttggcatttgcctacgcgattttagtactgcgtgacgatttgccaaagtggggcttaggtttcttagtgcctatcgctaagctgcttatgccctttagaaagctgattgaagtgctgttgtttgtcctcgccattggtgtgggcgcttacactggcttcttaatctcggccatgaatgcctatccgatgctaaacactgcggtattgccagcactgttcttggtatctggtttatcagcgggtgcggcggccaatgcggtgctggcactggtgatgttcaaaaccgatagtcacgacaagacgttagccaaaatgcatggcttagagctaccagtgatggcaatcgaaatcatgttcctgtttatgttgttctgcgccttgtactttaagggcggtgcggcggctgcggcgctagcatcactcacctctggcgtgtgggcaagcgtattctggattggtgtcgtggggattggctttggtgtgccattgctgtttatgctgcttcccgccgcgactcgccatactaagggcgcaatgattatggtggcctgtgccagcttaaccggcgtgctcgcgctgagacactttattgtgtatgcgggccaaagctacttaaactaa

SEQ ID NO: 98466 - protein, 314 aa, Shewanella oneidensis MR-1
MNNTWGDMAQYDPVTWHWVIAVYLFMAGLSAGSLLIGIGLRWFNQEQTQVESNILKAAAIIGPVAISLGLACLVFDLTKPFHFWLILINYNFQSVMAIGVLALLAYSPLAFAYAILVLRDDLPKWGLGFLVPIAKLLMPFRKLIEVLLFVLAIGVGAYTGFLISAMNAYPMLNTAVLPALFLVSGLSAGAAANAVLALVMFKTDSHDKTLAKMHGLELPVMAIEIMFLFMLFCALYFKGGAAAAALASLTSGVWASVFWIGVVGIGFGVPLLFMLLPAATRHTKGAMIMVACASLTGVLALRHFIVYAGQSYLN

SEQ ID NO: 98467 - DNA, 942 bp, Shewanella oneidensis MR-1
  CDS (1)..(942): transl_table=11
atgagcgccctacattttgatacgctagtgtggcattggccgattgcgatatacctgtttttagctggggcatctgctggcgccatgttctttgcggtgttactcaaacattttgtgcttaaacataatgcttaccagtctggttttgtgcaggcggcttgtattgtggcgcctgtagcggttatggcgggtttaggcatcttagttttggacttaactaagcccttcgatttttggaagatcttagttttctacaatccaacatctgtgatgtcgatgggggtgcttattctgctgatttaccaagtctttatgtttatgtggattggcttattgttccgtaaacctatcgatgcttggtgcgaaaaccgcttcccgattgtgctgaagttgacagctttgctgagccgtttcgaggcgacaattaccggtttattggtgatcttctctcttgctctcggagcttatactggctttttactttcggccttacccggctacccaatgttgaaaaatccggtgttgccactgctgtttttggcctcggggctttcatctggtgcggcatgctcactgcttggcggggtgttacttaacgccaatccgaatgcgaaggaagtgcactttattcataaggttgaaattccgctgattttggtggagatagtgctgatatttaccttctttatgggcttagtgctgaccggcggccaaagtaagctcgcagccttcaatgcgataggttatggattctgggggtggatcttctggcttggtatcgttgggattggcttgtcgggtcccttggcgatgaacctgtttatgacagccacttcaaaacgtaaatgggcctatgtagcaggaactgcttgtttaagtctgataggggtattgctgctgcgtaactttattctctacaccgggcaaatgacggtcgtttaa

SEQ ID NO: 98468 - protein, 313 aa, Shewanella oneidensis MR-1
MSALHFDTLVWHWPIAIYLFLAGASAGAMFFAVLLKHFVLKHNAYQSGFVQAACIVAPVAVMAGLGILVLDLTKPFDFWKILVFYNPTSVMSMGVLILLIYQVFMFMWIGLLFRKPIDAWCENRFPIVLKLTALLSRFEATITGLLVIFSLALGAYTGFLLSALPGYPMLKNPVLPLLFLASGLSSGAACSLLGGVLLNANPNAKEVHFIHKVEIPLILVEIVLIFTFFMGLVLTGGQSKLAAFNAIGYGFWGWIFWLGIVGIGLSGPLAMNLFMTATSKRKWAYVAGTACLSLIGVLLLRNFILYTGQMTVV

SEQ ID NO: 98469 - DNA, 957 bp, Salmonella enterica subsp. enterica serovar Typhi Ty2
  CDS (1)..(957): transl_table=11
atgacatccgcttctgcatttcattttgcatcactggtgtgggactggcccatcgccatctatctgttcctgattggcatctccgccggactggttacgttggcgattctgctacgccgcttccatccggaggcgggcggttcggacagcacgctgctgcgcactacgctggtgttagggccgggggcgattattcttggtctgctgattctggtcttccacctgacgcgcccgtggaccttctggaagctgatgtttcactacagctttacctcggtgatgtcgatgggggtgatgctgttccagctttacatggtggtcctgatactgtggctggcgaaaatctttgaaaaagaggtgattgccctgcagcaacgttggctgccgcggttagagatcgtgcagaaagtgttgacgctgatcgcgccgttccaccgtgcgctggagacgttaatgctggtgctggcggttctgctcggcgcgtacaccggctttctgctgtcggcgctgaaatcctatccgttcctgaataacccgatcctgccggtactattcctgttctccgggatttcctccggcgcggcggtggcgctgatcgccatggcgttacgccatcgtagcaacccgcacagcacggaagcgcgctttgtgcatcgcatggaggttccggtggtatggctggaaattttcctgctggcggcgttcttcgtcggtctggcgctgggcgatgacggcaaaatgcgggcgctggcggcggcgctgggcggcggattctggagctggtggttctggcttggcgtcgtagggctgggattgattatcccgatgctgctaaaaccctgggccaaccgcagcgtcacgtttcacggcgtgctggccgtttgcggcgccagtttgaccggcgtgctgctgctgcgctttttcattctttatgcgggacagctaacggttgcataa

SEQ ID NO: 98470 - protein, 318 aa, Salmonella enterica subsp. enterica serovar Typhi Ty2
MTSASAFHFASLVWDWPIAIYLFLIGISAGLVTLAILLRRFHPEAGGSDSTLLRTTLVLGPGAIILGLLILVFHLTRPWTFWKLMFHYSFTSVMSMGVMLFQLYMVVLILWLAKIFEKEVIALQQRWLPRLEIVQKVLTLIAPFHRALETLMLVLAVLLGAYTGFLLSALKSYPFLNNPILPVLFLFSGISSGAAVALIAMALRHRSNPHSTEARFVHRMEVPVVWLEIFLLAAFFVGLALGDDGKMRALAAALGGGFWSWWFWLGVVGLGLIIPMLLKPWANRSVTFHGVLAVCGASLTGVLLLRFFILYAGQLTVA

SEQ ID NO: 98471 - DNA, 966 bp, Haemophilus ducreyi 35000HP
  CDS (1)..(966): transl_table=11
atgaatgaatacgtgccatttcaaacgccaaatcttgtctgggatagtaccattgcaatttatttgttcttgctaggtatctcttctggtgcagtacaattagcgattgcatttagaaatagtgtcaaaattgaaaaaccaagtgaaaactgggtgattcgtagtgccgctattttgggtactgtgccaaccttaattggtttaacattattagttttccatttaaccaagccgtggtcattttggaaattaatgtttaattatagcagtacttcagtaatgtcaatgggcgttatgttattccaactctatatagctatgctgaccatctggatcgctattatgtttaaaggcacggtagcggtgttaattaatcgctatttgccgatctttaaatttttattatgttggcttgatgttgctgaaaaacgcttactgaaaataatagaatttattttattcatttttgctgctgtattaggtgcttataccggttttttactgtctgctttagtcagttatcctatgctaaataatcctgtattaccgccattatttttagcatcaggcgtatcatcagggattgcggcaacgtttttaatgattttattagtgggtaaattatccggtgaaagccaagaagtgcattttatgcataaatttgaagtgccaattatggtaactgaattaggtttaatcattgctttctttgtcggtttacatttcggaggaggtgataagacattagccttacaaaatgcgttatcaggattttggggaatggtattttggataggtgtgatttctatcggtattttaataccgcttgtcgctaatttatttgcacactataaattaaaacataatgttaagtttattgttttggtttctgtattggatctaatcggtgtactgtgcttacgttattttatcctgtatgcaagccaattaactgttgtcagttga

SEQ ID NO: 98472 - protein, 321 aa, Haemophilus ducreyi 35000HP
MNEYVPFQTPNLVWDSTIAIYLFLLGISSGAVQLAIAFRNSVKIEKPSENWVIRSAAILGTVPTLIGLTLLVFHLTKPWSFWKLMFNYSSTSVMSMGVMLFQLYIAMLTIWIAIMFKGTVAVLINRYLPIFKFLLCWLDVAEKRLLKIIEFILFIFAAVLGAYTGFLLSALVSYPMLNNPVLPPLFLASGVSSGIAATFLMILLVGKLSGESQEVHFMHKFEVPIMVTELGLIIAFFVGLHFGGGDKTLALQNALSGFWGMVFWIGVISIGILIPLVANLFAHYKLKHNVKFIVLVSVLDLIGVLCLRYFILYASQLTVVS

SEQ ID NO: 98473 - DNA, 957 bp, Wolinella succinogenes DSM 1740
  CDS (1)..(957): transl_table=11
atgaatgaagcgattgaatttaccgttggattctcgcatggagtggagtggggatggcctattggggtctatttgttgttggcgggtatctcagggggtgcaatgattgtggcgctggcgcttcgatactataaagggcagaaagaggagacccctcttttgaaggcagcctctttggtctcttttgccactatcgccctagggatgatctttttggtgggtgatttagagaaacccctctatttttggaagattttgattcactataacttctcttcggtgatgtctattggggtgttggcgctctgcttttatatccctcttagtttcttgatggtggcgatcgtctttgaatcgatcatcactccgtggcttcagaggagtcctctagcgcctttggtaagaatctatccccttcttcggtctctacggaagcctttagaggcgatgacatttttgctagcgctgactgtttgcgcctacacgggatttttgatctcggtattggtgcgattccctctcctaaacacagcgattcttcctgcgctctttgtcgcttcgggtctttcagcaggaacagcgttttctagcgtggttgctgcctttttcttcaaggaggagacccactctagcgatctaaagacacttcatgccatcgagtggccagtcatggcggcggaaatactctttttattcatgctttttgtctctctagtgcttggcacgcagatgggcaaaagcagtgcccctgcattttttgagggagcttacgcggggcttctttggattggggttgtagggattggctttggggtgcctttggtgcttaattttgccctaggcaaaaaggtcgcttcctctcatgcgagcttttatctctcaggaatctctagcgtcgttggtgtgctctctttgagactctttatcttatacgcgggtcagacctttgccctatag

SEQ ID NO: 98474 - protein, 318 aa, Wolinella succinogenes DSM 1740
MNEAIEFTVGFSHGVEWGWPIGVYLLLAGISGGAMIVALALRYYKGQKEETPLLKAASLVSFATIALGMIFLVGDLEKPLYFWKILIHYNFSSVMSIGVLALCFYIPLSFLMVAIVFESIITPWLQRSPLAPLVRIYPLLRSLRKPLEAMTFLLALTVCAYTGFLISVLVRFPLLNTAILPALFVASGLSAGTAFSSVVAAFFFKEETHSSDLKTLHAIEWPVMAAEILFLFMLFVSLVLGTQMGKSSAPAFFEGAYAGLLWIGVVGIGFGVPLVLNFALGKKVASSHASFYLSGISSVVGVLSLRLFILYAGQTFAL

SEQ ID NO: 98475 - DNA, 882 bp, Wolinella succinogenes DSM 1740
  CDS (1)..(882): transl_table=11
atggacggtcatgttttgtgggattatcgggttgctatcgacctatttttaggaggtgttggagtagcagcatttattttgtcagcgctcctctttttcttggataaagaggctaacaagcctgtgtataagggagggtttgttcttgcacctctgtttgtctcgctgggattgatattcttgttgcttgagattggacgcccctttaatgcggtgcgaaccctcatcaatatcaatcctgcttcgattatgtctttgggggtctttttgcaagccatttttgtagcgattgccttttatgttgcctacctcatggtgaaatgcgatgagagctgttcctgtcagggagaatcgtgcgaagggcctaaattcttgattcttgcgggagggtttttggcgcttcttacaggactctatcatggaatgcttctttatggaacaggtagagaggcgtggaatggggcccttcctctgctctttttggcaagctccatcgcttcaggttttgcgctcacctatctcgtggcgactctaaggggtggcggagaggctcctctgtgggttttatctgcgatttccgtggcacttgtgggggttttatctgcggcgtttggatgggtctatggacttggagccctaggggttgaatcaaaggcctcactagactatctccacgctcattatggaatccacttctatctggttgctcttgtgatcggatctcttgtacctttggttctctttgtcaagtcgattctttccaaagaggggttggcgaaaaatattgcgttagcgagcactattatgattttggtgggctcttttgtgcttaagtatgtcgtggtttatgtcggtcagatcgaatatctggcaagtcactaa

SEQ ID NO: 98476 - protein, 293 aa, Wolinella succinogenes DSM 1740
MDGHVLWDYRVAIDLFLGGVGVAAFILSALLFFLDKEANKPVYKGGFVLAPLFVSLGLIFLLLEIGRPFNAVRTLININPASIMSLGVFLQAIFVAIAFYVAYLMVKCDESCSCQGESCEGPKFLILAGGFLALLTGLYHGMLLYGTGREAWNGALPLLFLASSIASGFALTYLVATLRGGGEAPLWVLSAISVALVGVLSAAFGWVYGLGALGVESKASLDYLHAHYGIHFYLVALVIGSLVPLVLFVKSILSKEGLAKNIALASTIMILVGSFVLKYVVVYVGQIEYLASH

SEQ ID NO: 98477 - DNA, 963 bp, Erwinia carotovora subsp. atroseptica SCRI1043
  CDS (1)..(963)
atgcataacgccttcacgttcgacacgctggtctgggattggcccatcgccgtttatcttcttctggttggtatctcgtcggggatggtgtcgctgtctctgctccttaggcactacgttcctaccgaataccacggcagtaatcgcgttatcaaagccacggccatcgtggcaccgcttgccgtgatcctcgggctggtgattctgatttttcacctgactaagccgctgaccttttggtatttgatggtcttttacaatcccacctccatcatgtcgcttggcgtgatgctctttcaggtgtatttcgttgtcatgctgctgtggctcatcacgctttatcatgacgtatggctgactcagcttgagaccgtctggcaccggcccgcactggctgcacgagcgcgtagattaaccgcaattatcgtcaaaaacgccgcggtgattgaaaacctgctgctggtcttggcaatcctactcggctgctatactggctttctgctgtccgcgctgaaatcgttcccgctgctgaataaccccgtcttgcccgtcctgtttttagtatccggtacgacatccggtattgccgtcatcctgctggccagcgcgtggggacgtcatacctcagggaattcactctccctgcatttcatccatcgtgtggaaaccccggtggtgtatgccgaattgttccttctgctggcgttttttgtcgggctgctgcttggcggcgggcaaaaggttctcgccgcccagaccgcgctgtcaggcttctggggaagcgtattctggattggcattatcggcatcggcattgtgatcccatccattaccaatcgggtacgcaaaccttctgcccattccggcaaagggcaagtgattaccttagccgtcatgagtctgttcggcgtgttcctgctacgactgttcgtgctttatgccggacaaatgacggtggcctaa

SEQ ID NO: 98478 - protein, 320 aa, Erwinia carotovora subsp. atroseptica SCRI1043
MHNAFTFDTLVWDWPIAVYLLLVGISSGMVSLSLLLRHYVPTEYHGSNRVIKATAIVAPLAVILGLVILIFHLTKPLTFWYLMVFYNPTSIMSLGVMLFQVYFVVMLLWLITLYHDVWLTQLETVWHRPALAARARRLTAIIVKNAAVIENLLLVLAILLGCYTGFLLSALKSFPLLNNPVLPVLFLVSGTTSGIAVILLASAWGRHTSGNSLSLHFIHRVETPVVYAELFLLLAFFVGLLLGGGQKVLAAQTALSGFWGSVFWIGIIGIGIVIPSITNRVRKPSAHSGKGQVITLAVMSLFGVFLLRLFVLYAGQMTVA

SEQ ID NO: 98479 - DNA, 963 bp, Erwinia carotovora subsp. atroseptica SCRI1043
  CDS (1)..(963)
atgacgcccgtgtcttcaagcgcattccattttgattcgttagtctgggactggccgattgcgatttacctgttcctggtggggatttctgcggggctggtgacgctgtctgccttactgcggcgctaccatcccgaacaggccacagcagacagtacgctaatgcgcaccacgcttattctcgcgccgtgcaccatcattttgggattgttgattctggtcttccacctcacgcgcccctggacgttctggaagctcatgttccattacagttttacctccgtgatgtccgttggggttatgctgtttcaggtttacatggcggcgctggcagtctggctgatcaatatttttagcgagcaggctattgtgctgcaacagcgctggctgccgaagctgactctcttccccaaggtgctctgctggctggcaccgatgcagaaatcgctggatatcgtgatgctgctgctggcggtgatgttaggggcttataccggattcttgctctccgcgctgaagacctatccgctactaaataatccgattctacctgcgttattcctgttttcgggcgtgtcctccggtgccgcagtggcgttgatcgctatgacctgccgctatcgccgcaatccgcatagcgaagaggcgcactttatccatcgcgtcgaaacgccggtcgtgtggctagagatcttcttgctgttcgcgttctttattggcctcgcgttaggggacgatgggaagcaacgggcgctagtggctgcgttgggtggtggattctgggccgtgtggttctggctgggcgttgtagggattggattagtcattcccttgctgctcaagtcgtgggctaaccgacagcattcaccctatggcgtgctggcggtctgcggcatgagtctggtgggcgttttactgctgcgcttctttatcctctatgcggggcagttaaccgttgtctag

SEQ ID NO: 98480 - protein, 320 aa, Erwinia carotovora subsp. atroseptica SCRI1043
MTPVSSSAFHFDSLVWDWPIAIYLFLVGISAGLVTLSALLRRYHPEQATADSTLMRTTLILAPCTIILGLLILVFHLTRPWTFWKLMFHYSFTSVMSVGVMLFQVYMAALAVWLINIFSEQAIVLQQRWLPKLTLFPKVLCWLAPMQKSLDIVMLLLAVMLGAYTGFLLSALKTYPLLNNPILPALFLFSGVSSGAAVALIAMTCRYRRNPHSEEAHFIHRVETPVVWLEIFLLFAFFIGLALGDDGKQRALVAALGGGFWAVWFWLGVVGIGLVIPLLLKSWANRQHSPYGVLAVCGMSLVGVLLLRFFILYAGQLTVV

SEQ ID NO: 98481 - DNA, 1275 bp, Symbiobacterium thermophilum IAM 14863
  CDS (1)..(1275): transl_table=11
atgtccgcactgacccgagaagaggcggccctgcggctcgccgaccagcgcccgtcgcccgggccgggcaggctgctccgagcgggctggtacctgctgctcatcgccctggtcgccgccggcggggtagccatcgcccaccggaccgcgcacgggcttgccgccaccaacctgacctcgatcaccccctggggcgcctggattgccttctacatctacttcgtcggcctctcggccggggcgttcctgctttccagcctcatctatgtgttcggcatggcccggttcgagcggctggggcggatggccctgctcaccgccctggtggcgatgatcgtcgccctgaccttcgtgctgctggacctgggccggatggagcgggcgctcagcgccctggtctacttcaactggctctcgccgctcgcctgggagatgcgcttctacgtgatctacatcctgctcctggccgccgagctctggttcgcgatgcgcgccgacctggtgcgccgggcggagcgttcccgactggcccggtggctcagcttcggcagccggtccctggacaccgggcgggatcaccggatgctccggatcctcggcaccatcggcgtgcccatcgccatcttcggcgtgcacggcggcacgggcacgatcttcgccatcgtgaaggcccggggcatgtggttctcggcgctcacgcccatcgtgttcatcgtgtcggcgctggtatcgggcacggcgctcctggccctgctctacatcctgcggcagaaggcactgaagcggcccgtgaacgccggcatggtggcggacctgggcaagctgctgggcggcttcctgctggtggatctggggctcctgttctacgagttcctggtgccgttgctctccatggcgccgcacgagaccagcgtcgtgcacctgatgatggaggggccctacgcctggaccttctggatcctgcagctgggcatcggcatggtagcgccggcgatcctcctgatgacccgcctgcgggagtccgtgccgctcaccgccctggcctgcctcatggtggtcgtgggcatcgtgggcgtgcggttcaacatcgtcgtgccgccgctcatcgagcccgtgctgcaggggctgcccgccggccagtacttcccgaacgcggtggagtggtggacgagcgctggcatcatcgccatggggctcctgctcttcagcgtggccgcggacctgctgcccgtggatgaggaagtgcacgagatcggagggacggcccatgactga

SEQ ID NO: 98482 - protein, 424 aa, Symbiobacterium thermophilum IAM 14863
MSALTREEAALRLADQRPSPGPGRLLRAGWYLLLIALVAAGGVAIAHRTAHGLAATNLTSITPWGAWIAFYIYFVGLSAGAFLLSSLIYVFGMARFERLGRMALLTALVAMIVALTFVLLDLGRMERALSALVYFNWLSPLAWEMRFYVIYILLLAAELWFAMRADLVRRAERSRLARWLSFGSRSLDTGRDHRMLRILGTIGVPIAIFGVHGGTGTIFAIVKARGMWFSALTPIVFIVSALVSGTALLALLYILRQKALKRPVNAGMVADLGKLLGGFLLVDLGLLFYEFLVPLLSMAPHETSVVHLMMEGPYAWTFWILQLGIGMVAPAILLMTRLRESVPLTALACLMVVVGIVGVRFNIVVPPLIEPVLQGLPAGQYFPNAVEWWTSAGIIAMGLLLFSVAADLLPVDEEVHEIGGTAHD

SEQ ID NO: 98483 - DNA, 972 bp, Mannheimia succiniciproducens MBEL55E
  CDS (1)..(972): transl_table=11
atgagtacattaacctatcctgtgccttttcatacgcctgatcttgtatgggattcctctattgcaatttacctgtttttgctgggtatttcttccggtgcggtacagttagcgatcgcttatcgccgctcccacaagttggaaaaaccaagtgaaaactggattgttcgtagtgccgcggtattgggaacgataccgaccctaatcggtttgactttattgattttccatttggcgcgaccttggacattctggaaattgatgtttaattatcaatttaattccgtgatgtcgatgggggttatgcttttccaagtctatatgctgtttatggtaatttggattgcggtactctttaaagccgaaatcgataacctaattaagaaatttgtgccgaagttacggttcgtaaccaatattatcggcgcttgtgaacgcatttttagtgccgccgaagtaattctgtttattttagccgcagtattaggcgcttataccggtttcttgttatcggcattaatcagttacccaatgttgaataacccggtattgccggcattattccttgcatcgggaacctcatccggcattgccgccacattcctgtgtattttaatcgcaggtaaacttaaaggcgacagccatgaagtgcattatatccataaattcgaagtgccgattatggtaaccgaattgggtttaatcgtctgcttcttcgtaggcttgtactttggcggcggtcaaaaggtcgttgccttgcagaatgccctttccggcttctggggcgcggtgttctggattggcgttatgttgattggtattatgattccgctaatcgcaaacttatttgccagcgataaatggaaatataatgcgaaatttatcattttagtgtcaatttttgacttaatcggtgtgctttgcctgcgttactttattttatacgccggccaactaaccatcgcaatgtaa

SEQ ID NO: 98484 - protein, 323 aa, Mannheimia succiniciproducens MBEL55E
MSTLTYPVPFHTPDLVWDSSIAIYLFLLGISSGAVQLAIAYRRSHKLEKPSENWIVRSAAVLGTIPTLIGLTLLIFHLARPWTFWKLMFNYQFNSVMSMGVMLFQVYMLFMVIWIAVLFKAEIDNLIKKFVPKLRFVTNIIGACERIFSAAEVILFILAAVLGAYTGFLLSALISYPMLNNPVLPALFLASGTSSGIAATFLCILIAGKLKGDSHEVHYIHKFEVPIMVTELGLIVCFFVGLYFGGGQKVVALQNALSGFWGAVFWIGVMLIGIMIPLIANLFASDKWKYNAKFIILVSIFDLIGVLCLRYFILYAGQLTIAM

SEQ ID NO: 98485 - DNA, 960 bp, Photobacterium profundum SS9
  CDS (1)..(960): transl_table=11
atgatgactacttttgccgatgccttttattttgattccttagtgtgggattggattatcgcaatttatttgtttctagcaggcatgtctgctggagctgtaatgatttcgatatacttgaaacgtaaagttattcaaggccatccaagcactaatggcatcattaaagcgacagctattcttgcaccgtttggtattattgctggtttagtgattctaattttccacctgactaaaccatggtcattttggaaaatcatggtcttttataatacatcgtcagtcatgtcgatgggagtaatgctgttccaaatttacatggtggtgctatttgcgtggatagccattattttcaaagatgatttactcaaactgttgaacggtcgtttaccgattgttgataaagcgatggggatcattagcaaatatgaaaatagtattgagctattcttaggcttcttagcggtaatgttagcggcttatactggcttcttattatcagtactaaaaacctacccattgttgaataaccctgtcttaccaatactctttttgttttcgagcttatcgtcgggagcggcagcttgtttgctattgggtattattggtttcaaagaatcagcgcatagcgccagcgttaaatggattcacaagtttgaacgtccagttgtggtgttcgaattgtttgttctttttgcattcttttctggcctctacttcggtggtggacaaagagaagcggcggttatggcagcgattggcgggggcttttgggcatcgtggttttggtatggggtaatagggctaggcatgttggtgccattgggtttgaatgccgttagttcagacggtgttaaatacaataaagcctttatcatgctagtgaccactctcagccttattggtgtgctgatgctacgtacctttattttatacgctggacaaatgacactgatttaa

SEQ ID NO: 98486 - protein, 319 aa, Photobacterium profundum SS9
MMTTFADAFYFDSLVWDWIIAIYLFLAGMSAGAVMISIYLKRKVIQGHPSTNGIIKATAILAPFGIIAGLVILIFHLTKPWSFWKIMVFYNTSSVMSMGVMLFQIYMVVLFAWIAIIFKDDLLKLLNGRLPIVDKAMGIISKYENSIELFLGFLAVMLAAYTGFLLSVLKTYPLLNNPVLPILFLFSSLSSGAAACLLLGIIGFKESAHSASVKWIHKFERPVVVFELFVLFAFFSGLYFGGGQREAAVMAAIGGGFWASWFWYGVIGLGMLVPLGLNAVSSDGVKYNKAFIMLVTTLSLIGVLMLRTFILYAGQMTLI

SEQ ID NO: 98487 - DNA, 939 bp, Azoarcus sp. EbN1
  CDS (1)..(939): transl_table=11
atggaagcggaactgacctggggtttgcccgtcatcgcctatctcttcatggcgggcgcgggagccggcgcggtggtggtatcggcgtcggtgttgttgcgcggcggcggtttcggcccgtcgcgggaggcggtggcccgctacggggcgctcatcggccccttgccggtgatcctcggcaccgcgctgatcgtgttcgagctcggtgcgccgtttcgcgcgttcaatctgttcaaggtgatcaacctgtcgccgatgtcgatcggctcgtggctgctcggcctgttcatggtgctgagcacactctatgccgcgacctttctcacccccgaacgctggcgctgggcgcgaacggccaagatcgcgctcgcctggatctgcgtgcccatcggaatcggcgtggcggtctataccggggtgatgatcggcgccatgccgtcgcggccgttctggaattcacccatcatcgccttcctgttcctgctgtcggcgctgtcggccggggtggcggcgatcgtgctgacgatgaccttggcgcgccggcgcagcgacgatcacgaggtggaacgcgatttcgagaacacctcctacctgctgaccgcttcggatgccgtcctgctcgccggcgaactgatcatcatcttcctgttcatcatgttcgcccacctgaccatcggcagcaccaaggaggcggtgaaagtcatcctctccggcggcccgctcgccacggcattctggggcatcgtggtggcgctgggcatcgtcctgccgctgctcgtggaactgaagctcgtcatgccgcggctgctgtacagccaggaattccgctcccatcgcgcattcgatgtggccttgccggtggcgatcctcgtcggcggtttctcgctgcgctacatcgtcgtcgtcgccggtcagatcaccggcccggtcggactctga

SEQ ID NO: 98488 - protein, 312 aa, Azoarcus sp. EbN1
MEAELTWGLPVIAYLFMAGAGAGAVVVSASVLLRGGGFGPSREAVARYGALIGPLPVILGTALIVFELGAPFRAFNLFKVINLSPMSIGSWLLGLFMVLSTLYAATFLTPERWRWARTAKIALAWICVPIGIGVAVYTGVMIGAMPSRPFWNSPIIAFLFLLSALSAGVAAIVLTMTLARRRSDDHEVERDFENTSYLLTASDAVLLAGELIIIFLFIMFAHLTIGSTKEAVKVILSGGPLATAFWGIVVALGIVLPLLVELKLVMPRLLYSQEFRSHRAFDVALPVAILVGGFSLRYIVVVAGQITGPVGL

SEQ ID NO: 98489 - DNA, 1089 bp, Azoarcus sp. EbN1
  CDS (1)..(1089): transl_table=11
atgaatgccgatatcgtcgaaaccgtcaacgtcgcgcgcgaaatcgcgtggctgccatgggcggtgcagtacttctttctcattggcctgtcgtacggcgcgttcctcgtgtcgctgccgggcctggtgttccggcgcaacggctgggaaggcatctcgcgcctggcgctgctcgcggcactcgtgtgcggcctgacggcgccggtcgcgctgctggccgacctgcaccagccggcacgcttctggcatttttatgcctacttcacgccgacgtcgtggatgtcgtggggcgcattcttcatccccgtctatctgaccgggctgatcctgtacgcgtggctcgcgtaccgtccgctgctcgcgcgccacgccgacgaaggcggcaggctcgccggcctcgcgcgccgcatcgcctacggcggtcacgaaagccgcaacgcgctcgtcgccgcggcgctgctcgcgttcgtcggcgccgcgctcgttgcgctctacaccggcgtcgaggtgatgctcgtgcgggcgcgcccgctgtggcacacgccgctgttgccggtgcagttcttcgtcacggcactcgcgggcgggctcgggctgacgctgctgttcaaccgcgcgctgccgggcggtggcgagccgggagcgacgtgccgcatggcgacggcgctcgccgcgacgcagttcgtcgcgctcctcgtcggcggcgtctggctcgcgctcgggctgagcggcctgtcgccgacccatgcgcaggcgctcgccgaagtcgcgccgtcggcgaactggcaggtcagcgccgtctgggcgatctccgccaccgtcgtcacgctgctgctggcgtggaagcgcccggcgtcgggtctgctgatcggcctgctcgcgctgcactcggcgtggatgatgcgctggacgatcttcatcggcgggcaggaagtgccgaagaccggcgccggctactacagctaccagcttccgctcggtcccgaaggcctgatgggcatcgtcggtaccgtcgggttgtggatctttctcttcgtcgtgctgaccacgctgctgccgctcgaccggctcggcaaggccggcgtctga

SEQ ID NO: 98490 - protein, 362 aa, Azoarcus sp. EbN1
MNADIVETVNVAREIAWLPWAVQYFFLIGLSYGAFLVSLPGLVFRRNGWEGISRLALLAALVCGLTAPVALLADLHQPARFWHFYAYFTPTSWMSWGAFFIPVYLTGLILYAWLAYRPLLARHADEGGRLAGLARRIAYGGHESRNALVAAALLAFVGAALVALYTGVEVMLVRARPLWHTPLLPVQFFVTALAGGLGLTLLFNRALPGGGEPGATCRMATALAATQFVALLVGGVWLALGLSGLSPTHAQALAEVAPSANWQVSAVWAISATVVTLLLAWKRPASGLLIGLLALHSAWMMRWTIFIGGQEVPKTGAGYYSYQLPLGPEGLMGIVGTVGLWIFLFVVLTTLLPLDRLGKAGV

SEQ ID NO: 98491 - DNA, 927 bp, Azoarcus sp. EbN1
  CDS (1)..(927): transl_table=11
atgaacacgcatgcgaagtacgaacagctgatccaggatttgcggatggacctgcggccgcagcgcgagtggggcgaggggcgcggcatctttctcgtcatcggccacttcgtcgtcggtatcgcggccggggcgtggctgttctcgctgttcttcgagcaggcggcgggccttgtcgtggcgtttgtgctcgccgctctgggagggatcgcgcacctcgggtttctcggccggcccgaccgcttctggcgcatggccacccgcgtacgcacgtcgtggatctcccgcgggttcatcggcttgagcctgttcctctccggcgccgcgctgtacctgttgccgctccattggccgggcgcatggtggcaacagggctcgctgccggcgagcgcgggctatgtgatggcactgctcgggacgctgatcatgatgggctatatgggtttcgtgtatacgtcggcgaaggcgataccgttctggaactcgccgttgcacccggcgctgtacattgcctatgcgctgcgcggcggcgtcgcggcccttttcgtcacggcgtggctgatggattcgggtcaggcgttgccggcggggctgctgccgatctggggcgggatcacgatcatcgtgagcctgttcttcgcgctggagcttcacggcgcggcgaccagcggcaatgcggcggcacggcgttccgtgcatgagctcctggccggacggatgtccggctatttttacggtggcatgctagcgctcggtgtgctcgtgcccgcctggctgatgttctcgagcctgtccgggccactgtccacgggcctgatggccgtgcttggcatcacgtcggcgatcggggatttcttcatgaaatacgcgacgatccgcgccggcgttcgcctgccggtgtggatgcacctcaccccgcagcggtaa

SEQ ID NO: 98492 - protein, 308 aa, Azoarcus sp. EbN1
MNTHAKYEQLIQDLRMDLRPQREWGEGRGIFLVIGHFVVGIAAGAWLFSLFFEQAAGLVVAFVLAALGGIAHLGFLGRPDRFWRMATRVRTSWISRGFIGLSLFLSGAALYLLPLHWPGAWWQQGSLPASAGYVMALLGTLIMMGYMGFVYTSAKAIPFWNSPLHPALYIAYALRGGVAALFVTAWLMDSGQALPAGLLPIWGGITIIVSLFFALELHGAATSGNAAARRSVHELLAGRMSGYFYGGMLALGVLVPAWLMFSSLSGPLSTGLMAVLGITSAIGDFFMKYATIRAGVRLPVWMHLTPQR

SEQ ID NO: 98493 - DNA, 852 bp, Azoarcus sp. EbN1
  CDS (1)..(852): transl_table=11
atgggtgactacgtctggttccacgatgtgtcgtggcacgcgacctacgcgatctacttcttcgtcatcggcatcgtcgccggcctggctttcctgtccttcctgtcgtggcacgacgaagcgctcaggccgatccgcgcgagtgcggcctggggcgcgctcgccctgctcgtgatcggcggcgtgctgctgatcgtggatctgtcccagccgctgcgctttctcaacatcctcaatcccttctatctcaacttcggctcgccgctggcctggggggcgctgaacatcgtcgccttcggcatcgcgctggtggcctatctgttcgtgctgcgccggggcgggggcggcaggtggctggcggcaatcgcggcgctgctggcgctcggcctgccgatctacaccggcttcgacctcacggtgcatcagtcgcggccggtgtggaacaccccgatcatgccggtgctgttcgttgcgatggcaatagcatcgggctccgcagtggcgtccctgctggctggcagcaacgctgcgacccaggccacgctgcgccagtacctgctgtggtcgaccggcgcggtcggcgtgatgctggtgtccatcctcggcacgacccactacggcggctcggcgcaggagctgacttacctgatcctcacgactggcacgatgggactgatcttcgtcgggatcggcatcgttgccggcaccgcagcgccgatcgcgctgctgctcgcgcctttcggccgccagcagttcggtgtggtgctggccggcctgctcgtgctcgcgggcggggcggcgctgcgttacgcgctgctgatgggcccccaacagttgcagaccctgtactga

SEQ ID NO: 98494 - protein, 283 aa, Azoarcus sp. EbN1
MGDYVWFHDVSWHATYAIYFFVIGIVAGLAFLSFLSWHDEALRPIRASAAWGALALLVIGGVLLIVDLSQPLRFLNILNPFYLNFGSPLAWGALNIVAFGIALVAYLFVLRRGGGGRWLAAIAALLALGLPIYTGFDLTVHQSRPVWNTPIMPVLFVAMAIASGSAVASLLAGSNAATQATLRQYLLWSTGAVGVMLVSILGTTHYGGSAQELTYLILTTGTMGLIFVGIGIVAGTAAPIALLLAPFGRQQFGVVLAGLLVLAGGAALRYALLMGPQQLQTLY

SEQ ID NO: 98495 - DNA, 1182 bp, Dehalococcoides ethenogenes 195
  CDS (1)..(1182): transl_table=11
atgaattggaaaaggatagccctgggtatattaatcctttccctggcggccggagtctggggattcctgatgctcctcaacaacggtcagcagatgctcggactgggcagtttcgtagtctggggcttgtggatggcactctacgtattttttgccagtaccgcagccggtatgttttttatagcctcgctggacctgctttttaaggttaaaacctttaccggcacgggcaagatatttatgctggcttcgctgaccagtctgggtgccggtctggtgcatattcttatcaacgaaggccgccccgaacgggtaatgaacgtatttctgcaccctaactttgattcggtgctggcctggtctgtctggatttataccctgattgccctggctacggccgcaattttattcgttctgtttatgccccaaaaacgcctgcctttccccaaagaaccggtagtaaaatggctgatgattttgggtttcccggtagcagttattgccagcggggcggtgggatttacccttagcacccagtcttcacattcattctggagcgtgggtctttttccggtactcttccctatcttcggtatgtccgccgggttcgccctgtcacgcattatagttgccctgtacggagataaaaaaagccccggttacccccgcctggccaggactatggtaatttccaccatgattttactgcttgccattacctacataataggctcggtgctgtttgtgggcatatatgacgccaccccgcccactatcgaagccgccaactatataatgttcggacagtactggtacggcttctggatagtccagatgggtctgggcattgtggtagccatggcagctctaatcaccattctggttaaacccggcttatccaaaaaaccggcctgggggctgagtgtaggtgtgctggtgcttctgggggcggctgttgcccgtttgaattttatcattccggctcaggtagtggccggggcagactttttatccagccccattatagacagcagatatatagacagctacatacccaccctgcccgaatgggcgctttcagcgggggtgacggccgcagccattctggtattttacatggtggccaggatgatgaaactgatacctgtcagaattggagatgaggaaaccggcaatgaataa

SEQ ID NO: 98496 - protein, 393 aa, Dehalococcoides ethenogenes 195
MNWKRIALGILILSLAAGVWGFLMLLNNGQQMLGLGSFVVWGLWMALYVFFASTAAGMFFIASLDLLFKVKTFTGTGKIFMLASLTSLGAGLVHILINEGRPERVMNVFLHPNFDSVLAWSVWIYTLIALATAAILFVLFMPQKRLPFPKEPVVKWLMILGFPVAVIASGAVGFTLSTQSSHSFWSVGLFPVLFPIFGMSAGFALSRIIVALYGDKKSPGYPRLARTMVISTMILLLAITYIIGSVLFVGIYDATPPTIEAANYIMFGQYWYGFWIVQMGLGIVVAMAALITILVKPGLSKKPAWGLSVGVLVLLGAAVARLNFIIPAQVVAGADFLSSPIIDSRYIDSYIPTLPEWALSAGVTAAAILVFYMVARMMKLIPVRIGDEETGNE

SEQ ID NO: 98497 - DNA, 957 bp, Vibrio fischeri ES114
  CDS (1)..(957): transl_table=11
atgagtgcatgggaagcagcgtttaatttcgactctttagtatgggattggatcattgcgatctaccttttcttagccggtatgtctgctggtgcggttatgatatcgatttacttaaaacgtaaagtgattgaaggtaaccctgcagataacggtattatcaaagcaaccgcaattttagcgccatttggcattattgcaggtttaaccattttgattttccacttaaccaaaccactctctttttggaaaattatgattttctttaacccaacatccgtgatgtcgatgggggttattctattccaagtgtatatggctgtgctatttgcttggcttggcgtaatgtttagaaaggatatcatgagctttctaaaaggaaagtttggttttatcgatactatcttgcttaagattgaacagtttgaaaatgcgttagaaatctttttagctgtgcttgctattatgcttgcggcttatactggtttcttattgtcagcattacaaacgtatccaatgttaaataacccggtattgccgattttattcttgttctcaagtttatcgtctggtgcagcggcgtgtttactgtttggtattttaggttttaaagaaccaagccatagccattcggtgaagtggatccataactttgaacgacctgttgtactgtttgagttgttcgtacttgttaccttctttactggtttaatctttagtggagggcagggcgaagctgctgcttgggctgctattggtggtggtttttggggaatatggttctgggttggcgttattggtttaggtatgatcacccctttaactttgaatgcatttgcgccaaaggaattggttcacggtaaagggtttatttttgttgtgacatcattaagtttacttggtgtattaatgcttcgtacgtttgtgttgtatgcaggacaaatgacggtcgtataa

SEQ ID NO: 98498 - protein, 318 aa, Vibrio fischeri ES114
MSAWEAAFNFDSLVWDWIIAIYLFLAGMSAGAVMISIYLKRKVIEGNPADNGIIKATAILAPFGIIAGLTILIFHLTKPLSFWKIMIFFNPTSVMSMGVILFQVYMAVLFAWLGVMFRKDIMSFLKGKFGFIDTILLKIEQFENALEIFLAVLAIMLAAYTGFLLSALQTYPMLNNPVLPILFLFSSLSSGAAACLLFGILGFKEPSHSHSVKWIHNFERPVVLFELFVLVTFFTGLIFSGGQGEAAAWAAIGGGFWGIWFWVGVIGLGMITPLTLNAFAPKELVHGKGFIFVVTSLSLLGVLMLRTFVLYAGQMTVV

SEQ ID NO: 98499 - DNA, 1242 bp, Desulfitobacterium hafniense DCB-2
  CDS (1)..(1242)
atggacaataagcaaaagaatcttatctggttcggtattttaggcttgctgaccctggccggactgggggcgtggctctatcagatggccaatggcctgatccttaccggaatgcgcaatatcgtctcctgggggctttatatcacggcctttatgtttttcgtcggtctttccgccggtggtctgattgtatcttcttccgccaccgtatttaatattgctccgtttaaaaaagtatccttgccggcggtgctcctttccgtagtctgtgttattatggccgcactcttcatcgttgttgacttgggaaaaccccaaagaatgttcaatctgctcctccattcccaattcaagtctcctctgatgtgggatgtcatcgttatcacggcctatctgcttatctcggtgctttatttgtattttatgacccggcctaatccggatcagagaaaaataaggatcatgtcccgaatcgccttgccggttgccataggtgttcactccgttacggcctggatctttggtttgcagattgcccgggttgcctggcacagtgccctcatggcgccgctgtttgtggcttcggccttggattccggactggccttgctcctgattgttctgttggccttgaatcgctccggcaagtataaagtcgaagatcagcttttcagcagcctggccggactgctggcagtcttcgtagcggtcgatgccttttttatcggctgtgaagtgctcaccttcatctatccgggtgaggaaaaagttatgaacgccgtgtccctccttttcacaggctctctggcacccttcttctggggagaaatccttctgggcctgttccttcctttcttaattctggtctttgccaggaaccgcgccaagaagagctctattctgctggcctcagtcctcattgtggttggtgtgtttttcaaacgggtctggctgctgttttcatcctttgttttccctttagtgcctggacagttaggggtaactctcggtgagtttaaagagggtgtggattcaattgtgatccccaatatctgggccacagcgggaagctattccccaacgatgattgagggccttattttcctagggattatatcttcaggaatcttgcttttcaggctgctcttccaggggctcatatctgctcaatccccaaaagctttgctcagcgaaaatatcaccagtcggtctaacaccagtcaagtgcttggaggtaaataa

SEQ ID NO: 98500 - protein, 413 aa, Desulfitobacterium hafniense DCB-2
MDNKQKNLIWFGILGLLTLAGLGAWLYQMANGLILTGMRNIVSWGLYITAFMFFVGLSAGGLIVSSSATVFNIAPFKKVSLPAVLLSVVCVIMAALFIVVDLGKPQRMFNLLLHSQFKSPLMWDVIVITAYLLISVLYLYFMTRPNPDQRKIRIMSRIALPVAIGVHSVTAWIFGLQIARVAWHSALMAPLFVASALDSGLALLLIVLLALNRSGKYKVEDQLFSSLAGLLAVFVAVDAFFIGCEVLTFIYPGEEKVMNAVSLLFTGSLAPFFWGEILLGLFLPFLILVFARNRAKKSSILLASVLIVVGVFFKRVWLLFSSFVFPLVPGQLGVTLGEFKEGVDSIVIPNIWATAGSYSPTMIEGLIFLGIISSGILLFRLLFQGLISAQSPKALLSENITSRSNTSQVLGGK

SEQ ID NO: 98501 - DNA, 1149 bp, Desulfitobacterium hafniense DCB-2
  CDS (1)..(1149)
atgggcataggagcctgggctttccagctggtcaatggacttggggtaacaggaatgaataatgtcgttacctggggatcctatatcgccatgttcatgctctttgtgggtctttccgccggggggctgattgtatcttcttcggcgacggtattcaatatcccgtcctttaaagttgtagcgaagcctgcagtcattctttctacggtctgtattatgatcgccgggatattcattattgtggatattggcagcccgtggcggatttgcaatttaatcctgcatcctcaatttcgttcgcctttgatgtgggatgtggtggtcattaccttgtacctggcgttgaatctggtctacctctatttcatgagccgatcggagcccgatgaaaggaagttaaagattatttccagaatcgccctgccgacggcagtcttggtccactccgtcacagcttggatttttggtttgcagatagcccgcgcaggctggcacagtgctctgatggcacctctattcgttgcctcggccttggattcaggactggcgttattgattatcgccttgttggccttgaacagattgaaactatttgcagtggagaaaaaactgattgggactttagccggccttctcgttacctgtgttgccgttgatgcttttttcgtcttctcagaagttctgacgatgctttatccgggagaagagtcgaccatggctgtattaagggaaatgaccggcgggtttgctgctccgtttttctggggggaaatcatccttggctttatcctgccctttatgattctggtatttaagaagaacagagagaatacgaattatgttatttttgcttcggcaatcgtgattttaggagtattttgcaaacgcttctggttgctgttttcctcgtttatccatcctaatgttcaaggggctcccggtgttacctatggaaaatttactgaaaacattggagatatgtggtcccttcatggcagttatgcgccaacctgggttgaattggccatcatcatcggcatgctgtccatgggtgccttgctcttctcgtacctcagcagccggtttcttttaggaagagccgacttcataccaacggtgaagcaaggacaagcagcggagaacaaataa

SEQ ID NO: 98502 - protein, 382 aa, Desulfitobacterium hafniense DCB-2
MGIGAWAFQLVNGLGVTGMNNVVTWGSYIAMFMLFVGLSAGGLIVSSSATVFNIPSFKVVAKPAVILSTVCIMIAGIFIIVDIGSPWRICNLILHPQFRSPLMWDVVVITLYLALNLVYLYFMSRSEPDERKLKIISRIALPTAVLVHSVTAWIFGLQIARAGWHSALMAPLFVASALDSGLALLIIALLALNRLKLFAVEKKLIGTLAGLLVTCVAVDAFFVFSEVLTMLYPGEESTMAVLREMTGGFAAPFFWGEIILGFILPFMILVFKKNRENTNYVIFASAIVILGVFCKRFWLLFSSFIHPNVQGAPGVTYGKFTENIGDMWSLHGSYAPTWVELAIIIGMLSMGALLFSYLSSRFLLGRADFIPTVKQGQAAENK

SEQ ID NO: 98503 - DNA, 1203 bp, Desulfitobacterium hafniense DCB-2
  CDS (1)..(1203)
atggaaataacctatttagccaatgtagaacatccggttcagctgggttatttaatttccatctatttcttctacacaggactcagtgcaggctccttcgtcctttccagcctgggaacagtttttggcatccaaaaatataagcccatcgctaaggccggggtggtcatggctattgccctgctggccgttgcccccttgcatcttatcgctgatttggagcagcccgcccgcttttataccctgttcttccgcttgaatcccacctccgccatttcctatggcaccttcctgcttaccctctatcccctgacctgtattttttatctctggtttatgatgcgcaaggactttgccctgggtgcccaaaaactaacgggctttcgccaagctctctattcctttttaacctttggcaaaaaggatctctccccagacgccctggccaaagaccaaaaatggattaagggtttgggaactttgggagtacccctggccctctcggtccatggctacacagggtttattcttgccaatatgcaggccagagccctttggcatacgggacttatgccccttatcttcctcatgtccgccatggtttcaggtacaggactgctgatcctcatcctgatcctgacccaacgctatttctccccggaaagggcacttaccccccggcgcaaagctgttcttcaggatattgcccgcctgatgatgtggtttattgtggtggatggggtactcatggcaattaactttattatcctctacttcggcaatgccgcaggctatgccgctgccgagatgctgcttgggggcagccacagcaccatgttcctgggcgtcgagattggcttgggtcttgtcatccctttcgtcatcaccttctggtccaagacccggaaatccctggggctcatatccctggcctccctattgacactgctgggggttatcgccatgcggatcaatttcgtagtaggcggacagcagattcctttaagcgggaatgctcttaacccttatcatgttgaacccagacatctgatgtttttaggctgctttgcagtcctcgaagtggtgattctctatctggcctttaagtttttaccggtttatggcatagaacccgaaaaggaaagaacctcagtcgaacaccatcttcctccttccagtggggtttcagtccgctcaaactga

SEQ ID NO: 98504 - protein, 400 aa, Desulfitobacterium hafniense DCB-2
MEITYLANVEHPVQLGYLISIYFFYTGLSAGSFVLSSLGTVFGIQKYKPIAKAGVVMAIALLAVAPLHLIADLEQPARFYTLFFRLNPTSAISYGTFLLTLYPLTCIFYLWFMMRKDFALGAQKLTGFRQALYSFLTFGKKDLSPDALAKDQKWIKGLGTLGVPLALSVHGYTGFILANMQARALWHTGLMPLIFLMSAMVSGTGLLILILILTQRYFSPERALTPRRKAVLQDIARLMMWFIVVDGVLMAINFIILYFGNAAGYAAAEMLLGGSHSTMFLGVEIGLGLVIPFVITFWSKTRKSLGLISLASLLTLLGVIAMRINFVVGGQQIPLSGNALNPYHVEPRHLMFLGCFAVLEVVILYLAFKFLPVYGIEPEKERTSVEHHLPPSSGVSVRSN

SEQ ID NO: 98505 - DNA, 939 bp, Desulfitobacterium hafniense DCB-2
  CDS (1)..(939)
atgggagggatagaaatgagccaaaaacatgaaacatggggctggatgttagccgtggacttcttttttgccggcatgggggccgccatgctgctctttgccgggatcgccgaattattgacaggcagcaatctctccacggtggggattctggccggggcagtgtttatcgctatgggagccgggttgttagtcctggaattagggagacctttccaggctttgcgggtatttatgaaccctaaagccatcttaacctttggggcatggaatatgtccatcgccattgtcgccggcctctttttaggtacgtcctggctggaagcttttccttggttcggcctggtcggatttcgtaaaatcctggccattgtctgtattttcaccggttttgtagttgctgcctatccgggggcactcctggcacggcataaagcccgtcctttctggaatgggccgggcatgatggtgctctttttaacctcttctttattgacgggcctatccgcctatgtggtagtaggttggctgagcggggcggcacctgtgatttatagtgctttcccggccataggggcggggctttgtgctttccaattggttatatggatcggctatctttggattaagagttcgggaactactgagcgggaagtggcggctgttaagcgctggaccagcgggaactttgccaaccctttccggatcgggtttatgttcctgggcacggtggtgcccttggtactgtttctcattcctaatggattctccacaggagtggccgggatcctggcaatcctgggcggagtaatcatgcgcaatctggtggtctatgccggtcaggatcgcacctggctgcccggagaagaaaaatatcggtcaagacttccccatggtgatgaagctttcttacaaaaggtttggacaaaacagatttaa

SEQ ID NO: 98506 - protein, 312 aa, Desulfitobacterium hafniense DCB-2
MGGIEMSQKHETWGWMLAVDFFFAGMGAAMLLFAGIAELLTGSNLSTVGILAGAVFIAMGAGLLVLELGRPFQALRVFMNPKAILTFGAWNMSIAIVAGLFLGTSWLEAFPWFGLVGFRKILAIVCIFTGFVVAAYPGALLARHKARPFWNGPGMMVLFLTSSLLTGLSAYVVVGWLSGAAPVIYSAFPAIGAGLCAFQLVIWIGYLWIKSSGTTEREVAAVKRWTSGNFANPFRIGFMFLGTVVPLVLFLIPNGFSTGVAGILAILGGVIMRNLVVYAGQDRTWLPGEEKYRSRLPHGDEAFLQKVWTKQI

SEQ ID NO: 98507 - DNA, 858 bp, Desulfitobacterium hafniense DCB-2
  CDS (1)..(858)
atgggaaattggggctggcttattattggcttcctgttctttggcggtcttggctcgggtgcttatctgacatcttttgcagcggaaaaaggtttgtttggcaaagagagtaatttggtgcgggccggttattttatttcaggtccttgcctggccgtggggctgtttcttttttccctgaatctgggtgtcagcatcactggaattttaaccatgatcggtaatcctacgtcggtgatgacttggggggtctatctcttaatcatgtttatggtcctggccttttggagtgcctatcataaacgtgaaaacaagcaagttccggcaatgatctcaggagcgggagcattactggcagtggtaacagccatatacaccggggggcagctttccgttctttttgctcaacccttctggaacacgatccttgtaccgggattatttgtagtgtcggcactgatcatgggattggcttcttcatccctgctggcccgcatcatcgaaaaacccgttcagcaagggggggctgcggtaaccaggataaacatcagcctcctcttggtggaatgggtgctcttagcggctttgcttctgctctctttttcaggggctaaaggtccggttgctgctgattctgcccaaatagttgtcaccggaagactagccgcctatttttggattttgttaattgctgtcggattggttttgccgcttttcaacaacgtctatcccaagaaaaagcaaaacgaaaagagtggcaagatcttcggtttgttaagcgaggtggccacactgatcggaggggcaaccctgcgggccgttatcgtattgtcggcattgcctatctggagtatataa

SEQ ID NO: 98508 - protein, 285 aa, Desulfitobacterium hafniense DCB-2
MGNWGWLIIGFLFFGGLGSGAYLTSFAAEKGLFGKESNLVRAGYFISGPCLAVGLFLFSLNLGVSITGILTMIGNPTSVMTWGVYLLIMFMVLAFWSAYHKRENKQVPAMISGAGALLAVVTAIYTGGQLSVLFAQPFWNTILVPGLFVVSALIMGLASSSLLARIIEKPVQQGGAAVTRINISLLLVEWVLLAALLLLSFSGAKGPVAADSAQIVVTGRLAAYFWILLIAVGLVLPLFNNVYPKKKQNEKSGKIFGLLSEVATLIGGATLRAVIVLSALPIWSI

SEQ ID NO: 98509 - DNA, 969 bp, Actinobacillus pleuropneumoniae serovar 1 str. 4074
  CDS (1)..(969)
atgaacagctatattccgttccaaaccccgaatttagtgtgggacagcaccattgcgatttaccttttcttattgggtatttcatcaggtgcggtgcagttggcgattgcttatcgtaatagcggtgccaaaattgcaaaaaacagcgataactgggttatccgtagtgcggcgattttaggtacgttaccgacgcttatcggtttaacattattaattttccacttgaccaaaccgtggacattctggaaattaatgtttaactataacggtacttccgtaatgtcgatgggggtaatgttattccaagtttacatggctgtgcttgtagtttggattgccattatgttcaaagattggctggctgttttagtgaatcgctacttaccgatgtttaaattcgtattaccgttggttgattttgccgaaactcgcttgcttaaagcgatcgaattcgtactctttgtattagcggcagtgttaggggcttataccggtttcctactttctgcattaatcagttatccgatgttgaataaccctgtattaccggcgttattcttagcatcaggtacgtcctcaggtattgcggcaacattcttagtgattctgcttgccggtaaattatccggcgaaagtaacgaagtacattttatgcataaattcgaagtaccgattatggttaccgaattaggtttactcgttgcattcttcgtcggtttacacttcggcggcgcagataaacagttggcattacaaaacgccttatcaggcttctggggaacgatattctgggttggggtgttctttatcggtatcttaatcccgttggtagcgaatatcttcggcagccatagcttgaaacataatgttaaatttatcattttagtttcaatcttcgacctaatcggcgtactctgcttacgttactttatcctctatgcaggacaattaaccgtagcgagttaa

SEQ ID NO: 98510 - protein, 322 aa, Actinobacillus pleuropneumoniae serovar 1 str. 4074
MNSYIPFQTPNLVWDSTIAIYLFLLGISSGAVQLAIAYRNSGAKIAKNSDNWVIRSAAILGTLPTLIGLTLLIFHLTKPWTFWKLMFNYNGTSVMSMGVMLFQVYMAVLVVWIAIMFKDWLAVLVNRYLPMFKFVLPLVDFAETRLLKAIEFVLFVLAAVLGAYTGFLLSALISYPMLNNPVLPALFLASGTSSGIAATFLVILLAGKLSGESNEVHFMHKFEVPIMVTELGLLVAFFVGLHFGGADKQLALQNALSGFWGTIFWVGVFFIGILIPLVANIFGSHSLKHNVKFIILVSIFDLIGVLCLRYFILYAGQLTVAS

SEQ ID NO: 98511 - DNA, 858 bp, Dechloromonas aromatica RCB
  CDS (1)..(858)
atgggtgattacgtctggttccatgatgtgtcttggcatgcgagttatgccgtctatttcttcgtgattggcatacttgccggcctctctttcatttcctacggctcgtggcgcacaccggcgctacgtcctctgcgggaaaagacagcctatgcctccttcgtcctgcttggcctgggcggcatgctgctgattgccgatctgtcgcagccgatgcgcttcctcaacatcctcaatccggcgtacctgaacttcacgtcgccgctggcctggggagctctcaatatcgtcgccttcagcatcgcgtccatcgtctatatcctggcgctgcgcaaaggcgatgaaaagaacggtcaattgctggccctgatcaccgccctgctcgctctcggtctgcccatctacaccggcttcgacctgacggtgcatcagtcgcggccggtctggaacacgccgatcatgccggtgctcttcgttgccttggccattgcctcgggttcggcggttggcgccttgcttgccgctggcaacgccgaagcacaaaaggttctgcgcgaatacatgctttggtcagccggcgcagtcgccgtcatgctggtttcgatcatgggcacgaccaattacggtggctcggccgccgaactgaccttcatgatcatgaccacggggacgatgggactgctctttatcggcgtcggctttctcggtggcagcgttgcgccagcgctgatgctgttcgcaccgatgggcaaaagccaaggggtggtgctggtttctgccctgctcattctggccggtagtgcagccttgcgctatgtcctgctgatggccccgcaacaactacagaccctgtattga

SEQ ID NO: 98512 - protein, 285 aa, Dechloromonas aromatica RCB
MGDYVWFHDVSWHASYAVYFFVIGILAGLSFISYGSWRTPALRPLREKTAYASFVLLGLGGMLLIADLSQPMRFLNILNPAYLNFTSPLAWGALNIVAFSIASIVYILALRKGDEKNGQLLALITALLALGLPIYTGFDLTVHQSRPVWNTPIMPVLFVALAIASGSAVGALLAAGNAEAQKVLREYMLWSAGAVAVMLVSIMGTTNYGGSAAELTFMIMTTGTMGLLFIGVGFLGGSVAPALMLFAPMGKSQGVVLVSALLILAGSAALRYVLLMAPQQLQTLY

SEQ ID NO: 98513 - DNA, 966 bp, Haemophilus influenzae R2846
  CDS (1)..(966)
atgacgttagattatccagttccatttcatacgcctaatctagtgtgggattataccattgcgatctacttgttcttattggggatctcatctggtgcagtacagttagcaattgcctataaacgcagtaataaactagaaaatctaagccaaaactggattattcgatctggggtaattttagggtctgtaccaacattaattggtttaacgctattaattttccacttgactcgaccttggacattctggaaattgatgtttaactatcaattcaactccgtaatgtcgatgggggtcatgctattccaaatctatatgttatttttagtaatttggggggtagtgattttcaaaaaagaaatcgaagcattaattaatcgctttataccaaaactgcaatttgtgatgaaactcatcggtattgcagaacgtattgcaagtccagtcgaagttattcttttcatattggctgctgtgcttggagcatacacagggttcttactttctgcattgattagctatccaatgttaaataacccagtattacccgcattattcttagcctctggcacatcatctggtattgctgcaaccttcttaattatcttaattgcaggaaaactaaaaggtgattctcacgaatcgcacttcatccacaaatttgaagtgccaattatggtgacagaacttggtttgattgtgtgtttcttcgttggattacattttggtggcggacaaaaaacagttgccttacataatgccttatctggtttttggggagcgatattctggattggagtattgattatcggtatcttgatcccattaattgccaatatgtttgtaaatgaccgtttaaaatacaatcgtaactttattatcttggtgtcaatttttgacttaattggggtattctgtttacgtttctttgttttatatgcgggacaactcactgtagcctaa

SEQ ID NO: 98514 - protein, 321 aa, Haemophilus influenzae R2846
MTLDYPVPFHTPNLVWDYTIAIYLFLLGISSGAVQLAIAYKRSNKLENLSQNWIIRSGVILGSVPTLIGLTLLIFHLTRPWTFWKLMFNYQFNSVMSMGVMLFQIYMLFLVIWGVVIFKKEIEALINRFIPKLQFVMKLIGIAERIASPVEVILFILAAVLGAYTGFLLSALISYPMLNNPVLPALFLASGTSSGIAATFLIILIAGKLKGDSHESHFIHKFEVPIMVTELGLIVCFFVGLHFGGGQKTVALHNALSGFWGAIFWIGVLIIGILIPLIANMFVNDRLKYNRNFIILVSIFDLIGVFCLRFFVLYAGQLTVA

SEQ ID NO: 98515 - DNA, 1215 bp, Magnetospirillum magnetotacticum MS-1
  CDS (1)..(1215)
atgagcagcagcaccaccaccacttatacccagctgcgcccctatacgcggggctggctggccctgatggctggcttgggcgcggtcatcgccgttgctctgggcgcagtctttcatatggagcatcaaggccattgggtcaccgggatgaccaatcaagtggtctggggcctgccccatgtcttcgccgtgttcctgatcgtcgccgcctcaggcgcgcttaacatcgcctccatcggttcggtcttcgggcgggtcgagtatcagccgctgggccgtctgtcctccctgctggccgtggctttgctggccggaggcctggcggttctggttctcgatctggggcggcccgaccgcctgttcgtggccatgacgcacttcaacttcaagtccatcttcgcctggaacgtcatcctctattccggcttcgtgggtgtggtggcggtctatctgtggactcagatggactggacggccaagcgcttctacaagcccgccgccctggtggcttttagctggcgcctgattctgaccaccggcacgggctgcatcttcggcttcctggcggcgcgcgaggcctatggcgcggcggtgatggcgcccttgtttatcgccatgtccttcgcctatggactggcggtgttcatcctggtcctttcggtgtcgttcaagatgacgcgccgccccctgggcgacgaagtcccggcgcggctggtgcggctactgggcctgttcgtcgccgccaacctctatttcaccgcattgctccacgtcacccagatgtatttcgccgggcgtggcggggtggaagccttcatcttgtggaacggcggactgcacaccaccctgttctgggcgggtcaggtgggtctgggcggaatcctgtcccctggtcatcgcctatggcggctgtggccatgcgccgcgcaggcgggccatgatggcgtccgtcctggtggtgttgggcgggctggcccaggtttgggtcatcatcattggcggtcaggcctggccgctggacctgttccccggcatggaggtgtcgtccaccttcgccgacgggcacatccacgactacgcccccagcgcctgggagaccatgctgggcctgggcggaatcgccatcgccctggtcatcacggtcctgggcatgacggccctgcgccttctgccttccggcctaggcgagcctggcgaacagtgctgccgtcataa

SEQ ID NO: 98516 - protein, 404 aa, Magnetospirillum magnetotacticum MS-1
MSSSTTTTYTQLRPYTRGWLALMAGLGAVIAVALGAVFHMEHQGHWVTGMTNQVVWGLPHVFAVFLIVAASGALNIASIGSVFGRVEYQPLGRLSSLLAVALLAGGLAVLVLDLGRPDRLFVAMTHFNFKSIFAWNVILYSGFVGVVAVYLWTQMDWTAKRFYKPAALVAFSWRLILTTGTGCIFGFLAAREAYGAAVMAPLFIAMSFAYGLAVFILVLSVSFKMTRRPLGDEVPARLVRLLGLFVAANLYFTALLHVTQMYFAGRGGVEAFILWNGGLHTTLFWAGQVGLGGILSPGHRLWRLWPCAAQAGHDGVRPGGVGRAGPGLGHHHWRSGLAAGPVPRHGGVVHLRRRAHPRLRPQRLGDHAGPGRNRHRPGHHGPGHDGPAPSAFRPRRAWRTVLPS

SEQ ID NO: 98517 - DNA, 1254 bp, Geobacter metallireducens GS-15
  CDS (1)..(1254)
atggtacacggtgaagcatggacgctgaaagagttgttcgtctaccccaacgagtacatctactggaccatccagatcgtcatgtacccgttcatgaccggcctcgtggccggcgcctttgtcctttcctccctctatcacgtcttcgggatcaagcagctgaaggatatcgcgcggttttcactggtcttctccttcgccctcctccccgtggcgatgatcccgctccaactccatctccagcacccggaacgggggatcgaggtgatgctgacaccccacttcacctcggccattgccgccttcggcatcgccttctccacctacggcatgatcgtcgcctcggagctttggttcgtctaccggcggcacttcgtggagacggccctggcgcttagggaaaagcgggacaaaaccatccccgagcggggacggcagctcctcttttcggccctcaccctcggtgcctgggacatcagcgagcaggctctggcaaaggatgaacgggccgtgaagatcatggcgactgccgggattccggtggcctgcctcctccacggctatgccggatttattttcggctccgtgaaggccaatgccctctggacgacccccctcatgcccttcatcttcatctgctccgccgtggtgtcggggatcgccctctgcgtcctcagctacatcgtgaccatggaggtccgcaagctcatggtcgcctggaggaggaagagcgacccgagcctccccactccggacgagatcaggaccgtggagatgtacgaggtcaccatgaccgcaaaatacctggtcctggccctcctggcggccctggggctggagcttctggacctcctctttcgggactacgccaagttcagctcgtgggagatcgtgcggagcctcatctacggcaaggatttcgtcaatgtcttcgtgatccagtacgggatcggcaacctggtccccctggccctcttcctcctgccgcggctcacggtgcgacgggcggtcgtggccacgctcctggtcctcatgggggtcttcatgatgcggtggaacctggtcatcggcggccaggccttctcggcctccttttccggctacatgcactacgagcttccgatcatcccccacgacatcgagaccttcaaggaggggctcctgggtgccctgctggtgggggtgctgccgttcatctttttctgggggctgaacaagattttcccggttttcaagtgcgaggatacccactga

SEQ ID NO: 98518 - protein, 417 aa, Geobacter metallireducens GS-15
MVHGEAWTLKELFVYPNEYIYWTIQIVMYPFMTGLVAGAFVLSSLYHVFGIKQLKDIARFSLVFSFALLPVAMIPLQLHLQHPERGIEVMLTPHFTSAIAAFGIAFSTYGMIVASELWFVYRRHFVETALALREKRDKTIPERGRQLLFSALTLGAWDISEQALAKDERAVKIMATAGIPVACLLHGYAGFIFGSVKANALWTTPLMPFIFICSAVVSGIALCVLSYIVTMEVRKLMVAWRRKSDPSLPTPDEIRTVEMYEVTMTAKYLVLALLAALGLELLDLLFRDYAKFSSWEIVRSLIYGKDFVNVFVIQYGIGNLVPLALFLLPRLTVRRAVVATLLVLMGVFMMRWNLVIGGQAFSASFSGYMHYELPIIPHDIETFKEGLLGALLVGVLPFIFFWGLNKIFPVFKCEDTH

SEQ ID NO: 98519 - DNA, 1416 bp, Chloroflexus aurantiacus
  CDS (1)..(1416)
atgtatcagcgcaccgacgggattgtagagtttgatccgaaggtgtgcatcggctgcaaagcctgtttgcaggcctgtccttacgacgccatttacattgatccagagagccacaatgcggcgaagtgccacttctgtgcgcaccgtatcgatcaggggttgaaaccggcttgtgaaattgtctgtcccgaacaggcgatcatctctggcgatctcgatgatcccaatagtctgatcagccaattaattgcccgtgagccggtttcggtgcgcaagcctgaacagggcaccgcacccaagctgttttacattgatgctgaccaaaccacattgacgccaaccgcctcgacgaccagttctacctttatgtgggctgatgtggtgagcgagcaactggttggtcaccaccatacgaacggacgaaaacaacatgcccgtgaggtcattccgcttactgcggcttcgggagcaaagattcgcccgccgcgtgaacaggggctgggaagtggtcagagcgcgctgatgctgggtggccgggtggccggtcacatggtgcaaaccggctacaacgctcaacacaagattccgtggcactggccggtaccggcatatctggtgacaaaagggattgggagtggtgtctttctcgcagtggccgccgctgttggtcttggactggcgccgctgactgcaccactgctggcaattgcgctctttgtaagtctgctcttcattggtattacaaccgctctgctggtgtttgatctggaaaagccgcatctgttctttaccattctcacccgcccacaatggcggagctggctgacacgcggggcgtttatcctgattgcctttacgctggttggcgggctgtggttcctggctgaggccggcgctgccttgaatatctggccagaagccgctgtctcaggcttgcggccaatcctggcctggatcgggatgccgctggccgtgctggcagccatttacaccgcgttcctcttcgcgcaggccgaggggcgtgacctgtggcaaagtcccctcttgccggcccatctcctggtgcaggctgtgatggttggtgccggtacgctcttgctgctcgcaccgtttgtggctatgccggcagcatttctcaccctgctcggctggctctttgccggtagtttgctgatcgatctctttatgctcctggttggtgagttcggtatccctcatgccagtgaagttgctgcccgcgccgcgcacgatattagccacggccgctaccgcaaccacttctggcaaggagcgattgctctcggtcacgttctcccggtgctgtgcatcatcctggcgttcattgctccgaccctggcgatgccactcgctggcagtagccggactggccgcaattgccgggttgtacgcctttga

SEQ ID NO: 98520 - protein, 471 aa, Chloroflexus aurantiacus
MYQRTDGIVEFDPKVCIGCKACLQACPYDAIYIDPESHNAAKCHFCAHRIDQGLKPACEIVCPEQAIISGDLDDPNSLISQLIAREPVSVRKPEQGTAPKLFYIDADQTTLTPTASTTSSTFMWADVVSEQLVGHHHTNGRKQHAREVIPLTAASGAKIRPPREQGLGSGQSALMLGGRVAGHMVQTGYNAQHKIPWHWPVPAYLVTKGIGSGVFLAVAAAVGLGLAPLTAPLLAIALFVSLLFIGITTALLVFDLEKPHLFFTILTRPQWRSWLTRGAFILIAFTLVGGLWFLAEAGAALNIWPEAAVSGLRPILAWIGMPLAVLAAIYTAFLFAQAEGRDLWQSPLLPAHLLVQAVMVGAGTLLLLAPFVAMPAAFLTLLGWLFAGSLLIDLFMLLVGEFGIPHASEVAARAAHDISHGRYRNHFWQGAIALGHVLPVLCIILAFIAPTLAMPLAGSSRTGRNCRVVRL

SEQ ID NO: 98521 - DNA, 1146 bp, Chloroflexus aurantiacus
  CDS (1)..(1146)
atgcttaagcgactcctctatctcgccggcacccttggcctgctcgtcggcctgtggggattgtacgaccgccttgtctacggtcatatgcatgccaattacggctcatacgttgtctgggggctgtgggtagcgctgtatatgttcttcgccggggtagcaaccggagcctttatgctggcaaccctcgatctgctcttcgagctgccgatcttccgtgggagcggacgcatggcactctggggatcgctggtggcaatgccggcagggctggtagcaatcggccttgacctcggtcacatgacgcgcatctggaaagtctatctccagcccaatttcggttcggttatggcgcaactggtctggggctacaccatctttttgggtatcgttgtgatcagcctctggctcagtttacggccacaaccctcacgctggttaaagccggtaatggcaattggccttattctcgccatcttcctcagtggtgggatcggtgccctgctcggtgtcaaccaaaaccggatcagttggcacgtcagcaacttaccggcgcagttccccgtcttcaacctcacctctggtgtggcgctaatgctgatcgccatcggctggttcggcccactccgcgatccacgccgctcgcaacagttacgcattctcagcctggcgatggtcgtgcttttgctggtgaaaggctactacctctggagcgacgtctcgcaagccctctaccagaacagtagccacggcgcagcagcgatcaatctcgtcctgtttggcccctacggctgggcattctggctgttgcaactcggactcggcatgctgatcccgctcattgtgctgactatgccggttggacagcgcggctttgctgccggtttgatgggtgtatgtgtgctgatcggcctggcggtagcgcgtgccaacatcatcttcccggctctcagcctgcccgaactgcaaggtctgggtgaagcgttccacggcccacatctgagcttcacctacagccccagtttgatggaatgggcggttacggcgggtatcgtcggtgctgcaaccatcgggttcctgctcggcacagatcgattaccgctcttcaatcgtctaccaacggaagcaagtagcgctgccgattag

SEQ ID NO: 98522 - protein, 381 aa, Chloroflexus aurantiacus
MLKRLLYLAGTLGLLVGLWGLYDRLVYGHMHANYGSYVVWGLWVALYMFFAGVATGAFMLATLDLLFELPIFRGSGRMALWGSLVAMPAGLVAIGLDLGHMTRIWKVYLQPNFGSVMAQLVWGYTIFLGIVVISLWLSLRPQPSRWLKPVMAIGLILAIFLSGGIGALLGVNQNRISWHVSNLPAQFPVFNLTSGVALMLIAIGWFGPLRDPRRSQQLRILSLAMVVLLLVKGYYLWSDVSQALYQNSSHGAAAINLVLFGPYGWAFWLLQLGLGMLIPLIVLTMPVGQRGFAAGLMGVCVLIGLAVARANIIFPALSLPELQGLGEAFHGPHLSFTYSPSLMEWAVTAGIVGAATIGFLLGTDRLPLFNRLPTEASSAAD

SEQ ID NO: 98523 - DNA, 1251 bp, Chromatium vinosum
  CDS (1)..(1251): transl_table=11
atgaaacgagtcgtctatcgcgaatggcgcatcccgcccgagcgttactggagtctgctgggcttcctggcggccctgatcgggatcgcggcgctctcattcggctacatggaacaccagggccactgggtcagcggcatgaacaactcggtggtctggggcacgccgcatgtgttcgcggtcttcctcatcatcgcggcctcgggggcgctcaacatcgcctcgatcggcaccgtgttcaagaagccgatctacaaaccgctcggacggctctccggcctgctggcggtagcgatgctgatgggcggtctgctggtgctggtcatggatctcgggcgcccggagcgtctgatcgtggccatgaccaactacaacttcagctcgatcttcgcctggaacatcttcctctataccggcttcatggccatcgtcatcgcgtatctgtggtcgatggccgaccgtcagggcggaccgttcaactatccgatcggcatcctggcgctggtctggcgtctggcgctgaccacgggtaccggctcgatcttcggcttcctggtggcgcgtcaggcctatgatgccgccatcctcggtccgatgttcgtggcgctgtccttcgcctatgggctggcggtgttcatgctggtgctgatgttcggcttcgaggaggagggacgcccgatcggcccgcgcatgatgcgccggttgcgcaatctgctggcgctcttcatcggcatcgcgctctatttcacgctggtctatcacctgaccaatctctacatggccaagaacgacagcctggagcactggttgctgctcagcggcgggatctacaccttcctgttctgggtcggctggatcctggtcggcagtctggcaccgatgtggatcctctatcatccggtgctgagtcagaagcgcgagtggatcattggcgcctgcaccctggtcatcgtcggcggcttctcggccatgtatgtcatcatcatcggcagccaggcgttcccgatcgcgatgttccccggtcacaccatcctcgaatccggcttcgccgatggcgtcaatggcgctgccgcgccctactggccgaccatccctgagatcctgctcggcgtcggcggcgtggccgtagcgctgctgatcacggcggtcggcgtgcgggtgctgcaattcatgcccgagtcgctggccgatgacgtggtcgcaccggacgaggagacgctggacgcggcgcccttcgccaagccggcctga

SEQ ID NO: 98524 - protein, 416 aa, Chromatium vinosum
MKRVVYREWRIPPERYWSLLGFLAALIGIAALSFGYMEHQGHWVSGMNNSVVWGTPHVFAVFLIIAASGALNIASIGTVFKKPIYKPLGRLSGLLAVAMLMGGLLVLVMDLGRPERLIVAMTNYNFSSIFAWNIFLYTGFMAIVIAYLWSMADRQGGPFNYPIGILALVWRLALTTGTGSIFGFLVARQAYDAAILGPMFVALSFAYGLAVFMLVLMFGFEEEGRPIGPRMMRRLRNLLALFIGIALYFTLVYHLTNLYMAKNDSLEHWLLLSGGIYTFLFWVGWILVGSLAPMWILYHPVLSQKREWIIGACTLVIVGGFSAMYVIIIGSQAFPIAMFPGHTILESGFADGVNGAAAPYWPTIPEILLGVGGVAVALLITAVGVRVLQFMPESLADDVVAPDEETLDAAPFAKPA

SEQ ID NO: 98525 - DNA, 954 bp, Wolinella succinogenes
  CDS (1)..(954): transl_table=11
atgaaccaaatgtggggatcaatcgaacaatacaacacagtcgtatggcattggcctatcgcggtctatctctttttggcgggtctctcggctggagccatcatctcagcgattatcatcaaatggatgaaaggcaatgagagctctccttgggatggaatcatcaaagcgggcgcgctgattgcgcctttgacgatcggagcaggacttttgctcttgatttttgacctaacgcgaccgcttcatttctggaagctgttgattttctacaatttcagttctgtaatgaccttgggcgttttggcgctttttgcctatttccccgtggtgcttatcttcttgttgggtgtattcaaaaaagagctttgcgatgagggaccctttggcttccttgcacccctagccaatatcgcctatagcatggctagacctcttgagattgtcacttttgttttggccattggcgtaggagcttacacaggattcttgctctcagcgatgtatagctatccgttgctcaatacgcctatcttacctttgcttttcctcgcttcaggaatctcagcgggaatctcaggcaaccttctcatcggtcttctcttctttggtaagagcaccaaaggtgagaatgtaggctatcttcatgggcttgacttcaaggttatcttgtttgaggcctttttgctctttattctttttgtgggaatgtattaccaaggtggaagcaccgctgaagtcgccaaagcggcgctgaccacaggagggctggcttcactcttctggcttggtgtggctgggatgggcttggcgttgcctgtagtgctcaatgtcgcgcttcctcatggaatcaagcactccagcggctttgtcatgctcaacgcgctcattgtgctagcgggtgtgatggcacttcgcttctatatcctctacgcgggacagactttcgtaggctga

SEQ ID NO: 98526 - protein, 317 aa, Wolinella succinogenes
MNQMWGSIEQYNTVVWHWPIAVYLFLAGLSAGAIISAIIIKWMKGNESSPWDGIIKAGALIAPLTIGAGLLLLIFDLTRPLHFWKLLIFYNFSSVMTLGVLALFAYFPVVLIFLLGVFKKELCDEGPFGFLAPLANIAYSMARPLEIVTFVLAIGVGAYTGFLLSAMYSYPLLNTPILPLLFLASGISAGISGNLLIGLLFFGKSTKGENVGYLHGLDFKVILFEAFLLFILFVGMYYQGGSTAEVAKAALTTGGLASLFWLGVAGMGLALPVVLNVALPHGIKHSSGFVMLNALIVLAGVMALRFYILYAGQTFVG

SEQ ID NO: 98527 - DNA, 23 bp, Primer
atgacgcagacttccgcatttca

SEQ ID NO: 98528 - DNA, 22 bp, Primer
ttacgccaccgtcaactgtccg

SEQ ID NO: 98529 - protein, 349 aa, consensus
  MISC_FEATURE (1)..(349): consensus for the disclosure of xaa see table XV
WXXXXXXXXFXXGXXXGXXXXXXXXXXXXXXXXXXXXXXXXXXXXXXXXXXXXXXXXXXXXXLXXPXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTGXXXXXXXXXXXXXXXXXPXXFXXXXXXXGXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXGXXXPXXXXXXXXXXXXXXXXXXXXXXXXXXXXXXXXXXGXXXXR

SEQ ID NO: 98530 - protein, 22 aa, consensus
  MISC_FEATURE (1)..(22): consensus for the disclosure of xaa see table XV
WXXXXXXXXXXXXXXXXXXXXX

SEQ ID NO: 98531 - protein, 40 aa, consensus; identical to SEQ ID NO: 28591
  MISC_FEATURE (1)..(40): consensus for the disclosure of xaa see table XV

SEQ ID NO: 98532 - protein, 41 aa, consensus; identical to SEQ ID NO: 82090
  MISC_FEATURE (1)..(41): consensus for the disclosure of xaa see table XV

SEQ ID NO: 98533 - DNA, 2196 bp, Saccharomyces cerevisiae
  CDS (1)..(2196)
atgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtgacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaa

SEQ ID NO: 98534 - protein, 731 aa, Saccharomyces cerevisiae
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGDIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 98535 - DNA, 1671 bp, Bacillus subtilis
  CDS (1)..(1671)
atgggcacacttcaggagaaagtgaggcgttttcaaaagaaaaccattaccgagttaagagacaggcaaaatgctgatggttcatggacattttgctttgaaggaccaatcatgacaaattccttttttattttgctccttacctcactagatgaaggcgaaaatgaaaaagaactgatatcatcccttgcagccggcattcatgcaaaacagcagccagacggcacatttatcaactatcccgatgaaacgcgcggaaatctaacggctaccgtccaaggatatgtcgggatgctggcttcaggatgttttcacagaactgagccgcacatgaagaaagctgaacaatttatcatctcacatggcggtttgagacatgttcattttatgacaaaatggatgcttgccgcgaacgggctttatccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcaccatctcgatccgcacatgacaaaaaatcctttcacttggcttcggtctgatgctttcgaagaaagagatctcacgtctattttgttacattggaaacgcgtttttcatgcaccatttgcttttcagcagctgggcctacagacagctaaaacgtatatgctggaccggattgaaaaagatggaacattatacagctatgcgagcgcaaccatatatatggtttacagccttctgtcacttggtgtgtcacgctattctcctattatcaggagggcgattaccggcattaaatcactggtgactaaatgcaacgggattccttatctggaaaactctacttcaactgtttgggatacagctttaataagctatgcccttcaaaaaaatggtgtgaccgaaacggatggctctgttacaaaagcagccgactttttgctagaacgccagcataccaaaatagcagattggtctgtcaaaaatccaaattcagttcctggcggctgggggttttcaaacattaatacaaataaccctgactgtgacgacactacagccgttttaaaggcgattccccgcaatcattctcctgcagcatgggagcggggggtatcttggcttttatcgatgcaaaacaatgacggcggattttctgctttcgaaaaaaatgtgaaccatccactgatccgccttctgccgcttgaatccgccgaggacgctgcagttgacccttcaaccgccgacctcaccggacgtgtactgcactttttaggcgagaaagttggcttcacagaaaaacatcaacatattcaacgcgcagtgaagtggcttttcgaacatcaggaacaaaatgggtcttggtacggcagatggggtgtttgctacatttacggcacttgggctgctcttactggtatgcatgcatgcgggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttag

SEQ ID NO: 98536 - protein, 556 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGLTESIPVYKRLCVGSNPYKMMTEAGENPAKAPKSKHMYRFIEEPLYKRPGL

SEQ ID NO: 98537 - DNA, 1914 bp, Nostoc sp. PCC 7120
  CDS (1)..(1914)
atgcgaacacaagacagggtacaagtcaattctattgcagaggcgatcgcagctagtcaaaaatatctgctatcactacaaaatccggctggttactggtgggcggagttggaatcgaacgtcaccatcacggctgaagttgtcttactccacaaaatttggggaacagataaaactcgacctctacataaagtagaagcttatctgcgatcgcaacaaaagcagcatggcggttgggaattattttatggggatgggggcgaactcagtacatcggttgaggcgtacatggcgctgaagttgcttggtgtacctgcaaccgaccccgccatgattcaggcgcgagattttattctccagcgtggtggtatcagcaaaacccgcatttttaccaagtttcacctcgcactcatcggctgctacaactggcgtggtcttccttctctcccagcttgggtgatgctgttacccaatcagttccctgtgaatatttacgaaatgtccagttgggcgcgttccagcactgtcccactgttgattgtctttgaccaaaaacctgtctaccaagtcaacccaactattaccctggatgagttatacgcggaaggtgtggagaatgtccgctatgaattaccccgcagtggtgactggactgatttattcctcactttagatgaaggcttcaagctggcagaaagtttcaattttattccctttcgagaagaaggtatcaaagccgccgagaagtggattatagaacgccaagaagccacaggcgactgggggggaatcattcccgctatgttaaattccatgctggctttgcgctctttgggttatgacaccaacgacccaattgtagaacgaggtttacaagcccttgataactttgccatcgaaacagtagattgttatcgagtccagccttgtgtgtcacctgtgtgggatacagcttgggttatccgggcgttgattgactctggtatagcaccagaccatccggctatagtcaaggcgggagaatggctattacaaaagcaaattcttgactatggtgactggaatgtcaaaaatcgccaaggtaagccaggggcttgggcgtttgagtttgagaatcgcttttacccagatgtggatgatacggctgttgtcgttatggcactccacgccgctaaactccctaatgaacaattaaagcagaaggcgtgcgatcgcgccctgcaatgggtagcatcaatgcaatgcaaacccggcggctgggcagcttttgatcttgataatgaccaggattggctcaattccgtaccctatggcgacttaaaggccatgattgaccccaacacagcagatgttaccgccagggtaatcgaaatgttgggtgcttgtaatttatctatcgattcccacaatctggaacgggcgctgacctatctgttaaatgaacaggaagcagaaggctgttggtttgggcgttggggtgtaaattacatttatggaactagcggtgttctctccgccttagctttaatcaatccgcaaaaatatcaacgccatattcaacagggtgctacttggttagttggttgtcaaaaccccgatggcggttggggtgaaacttgctttagctacaacgaccccagcctgaaaggtcaaggtgacagtacaccatcccaaacagcctgggcgttaattgggttgatagcagctggtgaagccactggtaattttgctcatgatgctattgaacggggaattaatcatctggtatccacacaacaaccagacggtagttggtttgaggcatactttaccggaacaggcttcccttgtcacttttacttgaagtatcactactatcaacagtactttcctttaattgcccttggacgttatcaagcaattaagtctctttaa

SEQ ID NO: 98538 - protein, 637 aa, Nostoc sp. PCC 7120
MRTQDRVQVNSIAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKSL

SEQ ID NO: 98539 - DNA, 2292 bp, Arabidopsis thaliana (mouse-ear cress)
  CDS (1)..(2292)
atgtggaggttaaaggtaggagaaggaaaaggaaaagatccttatttattcagcagcaacaacttcgtgggacgtcaaacatgggagtttgaccccaaagccggcacacgggaggaacgaaccgcagtcgaagaagctcgccggagtttcttcgacaaccgttctcgtgttaaaccttccagtgatctattgtggaaaatgcaatttctaaaagaggcaaaatttgagcaagtgattccgccggtaaaaattgacggtggggaagccataacttatgaaaaagcgacaaatgcattacggcgaggagttgctttcttatcagctttgcaagcctccgacggccactggccgggagagttcaccggaccgctctgcatgcttccgccattggtattttgtttgtacattactggacacttggaagaggtattcgatgcagagcatcgcaaagagatgcttcgatatatctattgtcaccagaacgaagatggtggatggggattccacattgagagcaaaagcattatgttcactaccacgctgaattacatatgcttgcgtatacttggagtaggtcccgatggaggactagaaaacgcatgcaaacgggccaggcaatggattcttagccatggcggtgtgatttatattccttgttggggaaaagtttggctctcggtacttggaatctatgattggtctggagtcaacccgatgcctcccgagatttggttgctaccttatttcctaccaattcacctagggaaagcttttagctatacccggataacatatatgcccatctcttatctatatggcaaaaaattcgtgggtcaaattacacctcttattatgcaactacgtgaagaactacacttacaaccttatgaagaaatcaactggaacaaagcgcgacatctatgcgcaaaggaagacaagtactatccccatcctctagttcaagatttgatatgggatgctctccacaccttcgtggagcctttgcttgcaagttggccgataaacaaacttgtaaggaaaaaggctcttcaggtggcaatgaaacacatacattacgaggacgaaaacagtcactatatcaccattggatgtattgaaaagaatttgtgcatgcttgcttgctggattgacaacccggacgggaatcactttaaaaagcatctctctagaattccggacatgatgtgggtagctgaagatggaatgaaaatgcagtgctttggaagtcaactttggatgacgggatttgcagttcaggctttactagcaagtgatccacgcgatgaaacctatgacgtgctcaggagagcacacgattacataaagaaatcacaggttagagacaacccatcaggtgacttcaagagcatgtaccgccacatctccaaaggaggatggactctttctgatcgagatcatggatggcaagtttcagattgtacagctgaagctgctaagtgttgcatgttgctttccacaatgccaactgatatcactggagagaaaatcaatcttgaacaactatacgattctgttaatctcatgttatctctacaaagtgaaaatggaggttttactgcatgggaacctgttcgcgcctataaatggatggaattgatgaatcccacagatttgtttgctaatgctatgaccgagcgtgaatatacagaatgtacctcagctgtgttacaagctttggttatattcaatcaactatatccggatcataggacaaaagagatcactaagtcgattgagaaagcagtgcaattcatagaaagcaaacaattgcgagatggttcatggtacggaagctggggtatttgtttcacttatgggacatggtttgctctttgcggcctagcagcgattggtaagacatacaacaattgtctatctatgcgcgacggtgtacatttccttcttaatatacaaaatgaagatgggggttggggtgaaagctatatgtcatgccctgaacagagatacataccattagaggggaatagatcaaacgtagtgcaaaccgcgtgggctatgatggctctgattcacgctggacaggctaagagagatcttatacctctacatagtgctgcaaaatttattatcacgtcgcaactggaaaacggagattttcctcaacaggaactattaggagcgtctatgagtacatgcatgctacactattctacatacaaagacatcttcccaccatgggcacttgcagagtaccggaaagctgcgttcatacatcacgcagatctatag

SEQ ID NO: 98540 - protein, 763 aa, Arabidopsis thaliana (mouse-ear cress)
MWRLKVGEGKGKDPYLFSSNNFVGRQTWEFDPKAGTREERTAVEEARRSFFDNRSRVKPSSDLLWKMQFLKEAKFEQVIPPVKIDGGEAITYEKATNALRRGVAFLSALQASDGHWPGEFTGPLCMLPPLVFCLYITGHLEEVFDAEHRKEMLRYIYCHQNEDGGWGFHIESKSIMFTTTLNYICLRILGVGPDGGLENACKRARQWILSHGGVIYIPCWGKVWLSVLGIYDWSGVNPMPPEIWLLPYFLPIHLGKAFSYTRITYMPISYLYGKKFVGQITPLIMQLREELHLQPYEEINWNKARHLCAKEDKYYPHPLVQDLIWDALHTFVEPLLASWPINKLVRKKALQVAMKHIHYEDENSHYITIGCIEKNLCMLACWIDNPDGNHFKKHLSRIPDMMWVAEDGMKMQCFGSQLWMTGFAVQALLASDPRDETYDVLRRAHDYIKKSQVRDNPSGDFKSMYRHISKGGWTLSDRDHGWQVSDCTAEAAKCCMLLSTMPTDITGEKINLEQLYDSVNLMLSLQSENGGFTAWEPVRAYKWMELMNPTDLFANAMTEREYTECTSAVLQALVIFNQLYPDHRTKEITKSIEKAVQFIESKQLRDGSWYGSWGICFTYGTWFALCGLAAIGKTYNNCLSMRDGVHFLLNIQNEDGGWGESYMSCPEQRYIPLEGNRSNVVQTAWAMMALIHAGQAKRDLIPLHSAAKFIITSQLENGDFPQQELLGASMSTCMLHYSTYKDIFPPWALAEYRKAAFIHHADL

SEQ ID NO: 98541 - DNA, 2304 bp, Arabidopsis thaliana (mouse-ear cress)
  CDS (1)..(2304)
atgtggaggctgaagatcggggctaagggcggagatgagactcacttattcaccaccaacaactacaccggaaggcagacttgggagtttgatgccgatgcatgctctccagaggaactcgctgaggtcgatgaagctcgtcagaatttctccataaaccgatcacgtttcaagatcagtgctgatctcctttggcgaatgcagttcctgagggagaagaagttcgagcagaagattccgagagtggagataggagatgcggaaaatataacgtacaaagacgcaaagacggcactgagaagagggatactctatttcaaggcattgcaagctgaggatggacattggcctgctgaaaactctggttgcttgttcttcgaagctccctttgtcatatgcttgtacatcactggacatttggagaaaatcttgactttggaacatcgcaaagaactattgcgttacatgtacaaccatcagaacgaagatggtgggtggggaatacacgtggaaggccaaagcgctatgttctgcacagtcatcaactacatttgcctacggattctgggagtagaagcagatcttgatgatattaaaggaagtggttgtgcaagggctcgtaagtggatcctcgatcacggtggtgctacttatacgcccttgatcggaaaagcttggttatcgattcttggagtgtatgattggtcaggttgcaaaccaataccgcctgaggtgtggatgctccctactttttcgcccttcaacggaggtactctatggatttatttccgggacatttttatgggagtgtcatacttgtatggtaagaaatttgtagctacaccaacacctctcattttacagcttcgggaagagctttatcctcaaccttatgacaaaatcttatggagtcaagctcgcaatcagtgcgcaaaggaagatctctactatccacagtcatttttacaagaaatgttttggaaatgtgttcatatattgtcagagaatatcctgaatcgatggccttgcaacaagcttatcaggcaaaaagctcttcgaaccacaatggaacttcttcattatcaagatgaagccagccgttactttaccggtggatgtgtgcctaagccgtttcatatgcttgcttgttgggtagaagaccccgacggtgattattttaagaaacatcttgctcgagtcccggattacatatggattggggaggatggtctgaaaatccaatcttttggtagccaactgtgggatacagcattctcacttcaagtcatgttagcttatcaagatgttgatgacgatgatgatgagattagatcaacgttaatcaaaggatacagtttcttgaataaatctcagcttacacaaaatcctcctggtgaccatagaaaaatgttgaaagacattgcgaaaggaggatggacattttcggaccaagaccaaggatggcctgtttcggattgtactgctgagagtttagagtgttgccttgtctttggaagcatgccatcggagttgattggcgagaaaatggatgtagagaggctctatgatgccgttaatttacttctctattttcagagcaaaaatggaggtataacagtgtgggaggcagctcgtggaagaacatggttagagtggcttagtccagtggagtttatggaagacacaatcgtcgagcatgagtatgtagaatgtacggggtcagcgatagtggcattggctcggttcttgaaggagtttccggagcacagaagggaagaggttgaaaagtttatcaagaatgctgtcaaatacatagaaagctttcaaatgcccgatggttcgtggtacggaaactggggtgtgtgtttcatgtatggaacctttttcgcggtaaggggtctagtggctgcaggcaagacgtaccagaactgtgagccgattcgtaaagcggttcagttcattctggagacacaaaacgttgaaggcggttggggtgagagttatctctcttgccccaacaagaaatatacacttctagagggaaacagaaccaatgtggtgaatactggacaagcattgatggttcttattatgggtggtcagatggagagagaccctttgcctgttcatcgcgcagctaaagtgttgatcaattctcagttggataatggcgattttccgcaagaggaaataatgggagtgttcaagatgaacgtgatggtccattatgcaacctatagaaacattttcactctttgggcactcacatactacacaaaggcgctgcgcgtgcccctctgttga

SEQ ID NO: 98542 - protein, 767 aa, Arabidopsis thaliana (mouse-ear cress)
MWRLKIGAKGGDETHLFTTNNYTGRQTWEFDADACSPEELAEVDEARQNFSINRSRFKISADLLWRMQFLREKKFEQKIPRVEIGDAENITYKDAKTALRRGILYFKALQAEDGHWPAENSGCLFFEAPFVICLYITGHLEKILTLEHRKELLRYMYNHQNEDGGWGIHVEGQSAMFCTVINYICLRILGVEADLDDIKGSGCARARKWILDHGGATYTPLIGKAWLSILGVYDWSGCKPIPPEVWMLPTFSPFNGGTLWIYFRDIFMGVSYLYGKKFVATPTPLILQLREELYPQPYDKILWSQARNQCAKEDLYYPQSFLQEMFWKCVHILSENILNRWPCNKLIRQKALRTTMELLHYQDEASRYFTGGCVPKPFHMLACWVEDPDGDYFKKHLARVPDYIWIGEDGLKIQSFGSQLWDTAFSLQVMLAYQDVDDDDDEIRSTLIKGYSFLNKSQLTQNPPGDHRKMLKDIAKGGWTFSDQDQGWPVSDCTAESLECCLVFGSMPSELIGEKMDVERLYDAVNLLLYFQSKNGGITVWEAARGRTWLEWLSPVEFMEDTIVEHEYVECTGSAIVALARFLKEFPEHRREEVEKFIKNAVKYIESFQMPDGSWYGNWGVCFMYGTFFAVRGLVAAGKTYQNCEPIRKAVQFILETQNVEGGWGESYLSCPNKKYTLLEGNRTNVVNTGQALMVLIMGGQMERDPLPVHRAAKVLINSQLDNGDFPQEEIMGVFKMNVMVHYATYRNIFTLWALTYYTKALRVPLC

SEQ ID NO: 98543 - DNA, 2280 bp, Arabidopsis thaliana (mouse-ear cress)
  CDS (1)..(2280)
atgtggaaactgaagatcgcggaaggaggtagtccatggcttagaaccaccaataatcacgtcggaagacagttttgggagttcgatccgaatctcggtactcctgaggatctcgccgccgtcgaagaagctaggaagtctttttcggataatcgattcgtgcagaaacatagcgccgatctgcttatgcgccttcagttttcaagagaaaatttgattagcccagttttacctcaagtcaaaatcgaagacactgatgatgttacagaggagatggtggaaaccacgttaaagaggggtctagatttctattcaactatacaggcacacgacgggcactggccaggtgattatggtggtcctatgtttcttctcccaggactgataattacactctccataactggagcactgaatacagtattgtcggaacaacataaacaagaaatgcgccgttatctctataatcaccagaatgaggacggaggttggggtttacatattgagggccctagcaccatgtttgggtctgtgttgaactatgttactctaaggttgcttggagaaggacctaacgatggagatggagatatggagaaaggacgagactggatactaaatcatggtggtgctaccaatattacatcttgggggaaaatgtggctatcggtacttggagcttttgaatggtccggaaataacccactgccacctgagatatggcttctcccatatttcctgccaatacatccaggaaggatgtggtgccattgtcgaatggtgtacttgccgatgtcgtatttgtatggaaaaaggtttgtgggtcccataacgtccactgttttatcactgagaaaggagcttttcacagtaccatatcatgaagtcaactggaatgaagcacgcaacctttgcgcaaaggaggatttatactacccacatccacttgtgcaagatattctttgggcatcacttcataagattgttgagcctgttctgatgcgatggcctggtgcaaatttgagagaaaaggctataagaaccgcaatagaacatattcattatgaagatgagaatactaggtacatctgcataggtcccgtgaacaaggtattaaatatgctttgctgttgggtagaagacccaaactcagaggctttcaagttgcacctaccaagaatccatgactttctctggttagctgaagatggaatgaagatgcagggttataacggaagccagctatgggatacaggttttgctattcaagcgattttggcaactaacctcgtcgaagaatatgggcccgttttggaaaaagcacattcatttgtcaagaattcccaggtgttagaagactgccctggagatctgaattactggtatcgccacatttctaaaggggcttggcctttctcaactgcagatcacggttggcccatctctgactgcaccgcagaaggactgaaagctgctcttttgctatccaaagttcccaaggcgattgttggtgaaccaatagatgcaaaacggttatatgaagctgttaatgttatcatttctttacagaatgcagatggaggcctcgcaacatatgagctcaccaggtcatacccttggttagagctaatcaacccagcagaaacctttggcgatattgttattgattatccttacgtggaatgtacatcagctgctatccaagctttgatatcatttcgaaagctgtatcctggtcatcgaaagaaggaagtagatgagtgcattgagaaggcggttaagttcattgaatccattcaagcagcagatggctcatggtatggatcatgggctgtttgcttcacgtatggtacgtggtttggagtgaaagggctggtagctgttggaaaaacattgaaaaactctccacatgttgctaaagcttgtgaatttctattgtcgaaacaacaaccttcgggcggctggggagaaagctatctttcatgtcaagacaaggtctattcaaaccttgatggcaacagatctcacgtcgtgaatacagcatgggctatgctcgcactcattggtgctgggcaagctgaggtagaccggaaaccactacaccgggctgcaagatacttgattaatgctcaaatggagaatggtgattttccacaacaggaaataatgggagtcttcaataggaactgcatgataacatatgccgcgtatcgaaacatttttccgatatgggctttgggggagtaccgttgtcaggtattattgcaacaaggagaatga

SEQ ID NO: 98544 - protein, 759 aa, Arabidopsis thaliana (mouse-ear cress)
MWKLKIAEGGSPWLRTTNNHVGRQFWEFDPNLGTPEDLAAVEEARKSFSDNRFVQKHSADLLMRLQFSRENLISPVLPQVKIEDTDDVTEEMVETTLKRGLDFYSTIQAHDGHWPGDYGGPMFLLPGLIITLSITGALNTVLSEQHKQEMRRYLYNHQNEDGGWGLHIEGPSTMFGSVLNYVTLRLLGEGPNDGDGDMEKGRDWILNHGGATNITSWGKMWLSVLGAFEWSGNNPLPPEIWLLPYFLPIHPGRMWCHCRMVYLPMSYLYGKRFVGPITSTVLSLRKELFTVPYHEVNWNEARNLCAKEDLYYPHPLVQDILWASLHKIVEPVLMRWPGANLREKAIRTAIEHIHYEDENTRYICIGPVNKVLNMLCCWVEDPNSEAFKLHLPRIHDFLWLAEDGMKMQGYNGSQLWDTGFAIQAILATNLVEEYGPVLEKAHSFVKNSQVLEDCPGDLNYWYRHISKGAWPFSTADHGWPISDCTAEGLKAALLLSKVPKAIVGEPIDAKRLYEAVNVIISLQNADGGLATYELTRSYPWLELINPAETFGDIVIDYPYVECTSAAIQALISFRKLYPGHRKKEVDECIEKAVKFIESIQAADGSWYGSWAVCFTYGTWFGVKGLVAVGKTLKNSPHVAKACEFLLSKQQPSGGWGESYLSCQDKVYSNLDGNRSHVVNTAWAMLALIGAGQAEVDRKPLHRAARYLINAQMENGDFPQQEIMGVFNRNCMITYAAYRNIFPIWALGEYRCQVLLQQGE

SEQ ID NO: 98545 - DNA, 2637 bp, Homo sapiens (man)
  CDS (19)..(2217)
gagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatctttcccatctgggccctcggccgcttctcccagctgtaccctgagagagcccttgctggccacccctgagaacatgcctacctgctgggtgccgtctgtgcgttccatggccttcaagtcacaggacgcagcgattcccattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaaga

SEQ ID NO: 98546 - protein, 732 aa, Homo sapiens (man)
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 98547 - DNA, 2284 bp, Schizosaccharomyces pombe
  CDS (105)..(2270)
ccttttttgattattttgttgcatttacaattaacatagagtaaagacgagtctaatcaccttttctggaactgcttgatagataggatttttttgcgaaaaaaatggaggcttgcagagtccgtcctgaattatctaaaacggttgaacaaatcgataaaagcttgtggcgcttgaatatcgattcagctggtggagagacatgggagtatgttacaaaagaagaggctgaaaagcgtccactcaccattgcggagaagtatttcctaggttttgatttagatctacctaaacgacctccagcgaaaactccattagagagtgctgagtatggttatgaattttttcgtcgcttgcagctaccagacggtcactgggcttctccttatgaagggccgatgtttctcatttgcggtgccgtttttgctttttatatttcgcaaacaccatttcctaaaggttgggctccagaaattatccaatacttaattaatcacacaaatgacgatggtggatggggtattcacacagaaggagtttctactgtattcggaacctccatgaattatgtagttcttcgaattttgggtatggatgcgggacatccagttgctacacgagctcgtaacagattacatgaacttggaggagctattggatgcccgcattggggaaaattttggctcgctacacttaactgttacgactgggatggtgttaaccctatccccccagaactatggttattacctgactggattccatttcatcctggaaaatggtggtgtcacgttcgtttagtatacttgcctatgggatatatgtatggagagaggctgaaatgccctaaggattcgttaataatgcaattgcgaaaggagttgtacgtagaaaactatgacagcattaattttgcggatcatagaaatacgattagtgatgtggacctctattttcctcatactcaaatattagatcgtttgaattggatattggaaaaatattttacttatctaagaccctcttggcttaaaaaactgggtactcgacgggcatacgaacttataaaaatagaagatcagaataccgattactcttgtattggcccagtaaatgcagcaatgaacactgtttgcgtttactttcatgaaggaccttctagtaaagctttccaaaagcacattcaacgtttgcatgatttcatgtgggtccaaccagaaggaatgcttatgcgtggtactaatggtttgcaagtttgggaaacttccttcacattgcaagcgctcgtagaatcaggtctttacgaaaaagaggccttcaaaccagatatcgccaaagctctggagtttttggatcgacaacagattcgaacgcaatatgaagggagtggatataggtacaattctttgggggcatggccatttagtaatataactcaaggttatacggtgtcagatactacatctgaagctctgcgtgctgtattgcttgtccaatcattgccagattttgaaaaactggttgatatacctaggctaaggttatcggttgatgtgatattgggaatgcaaaatgagaaccttgggtttgcttcatatgagcctgcgcgaacaggtgaatggatggagttgttaaatcctgccgaagtttttggaaatattatggtcgaatactcttatcccgagtgcaccacatctgtcatattggcactccgggcttttacaaagtatgatcctggatatcgtcgtgatgaaattgaaaatactattgaaaatgctttggaatacgttgtaaagatgcaacgaccagacggaagctggtatggaagttgggctatttgttttacgtatgcagccatgtttgcgacaggttctttggcatcagccggtcgatattacgaaaactgcccagtccagaagaaggcgtgcgaatttttactgtcgaagcaaagaccagatggtggatggagtgagagttacatggcttgtgttactggagtttacacagaaacagaatcaagtttggtaacacaaactggttgggctttggacgcactgattaatgcaaagtaccctgatagaaaaccgatagaaaagggaattaaatttttgatggcgtctcaaaagagcgatgggagctggcagcaaaaatcgatggaagggatctttaacaagaatgttgccattgcatatcccaactacaagttgtacttttccatatacacattgggaaagtttgcaaagcaatacggcaattacctgaccatttagtttagtttagtatg

SEQ ID NO: 98548 - protein, 721 aa, Schizosaccharomyces pombe
MEACRVRPELSKTVEQIDKSLWRLNIDSAGGETWEYVTKEEAEKRPLTIAEKYFLGFDLDLPKRPPAKTPLESAEYGYEFFRRLQLPDGHWASPYEGPMFLICGAVFAFYISQTPFPKGWAPEIIQYLINHTNDDGGWGIHTEGVSTVFGTSMNYVVLRILGMDAGHPVATRARNRLHELGGAIGCPHWGKFWLATLNCYDWDGVNPIPPELWLLPDWIPFHPGKWWCHVRLVYLPMGYMYGERLKCPKDSLIMQLRKELYVENYDSINFADHRNTISDVDLYFPHTQILDRLNWILEKYFTYLRPSWLKKLGTRRAYELIKIEDQNTDYSCIGPVNAAMNTVCVYFHEGPSSKAFQKHIQRLHDFMWVQPEGMLMRGTNGLQVWETSFTLQALVESGLYEKEAFKPDIAKALEFLDRQQIRTQYEGSGYRYNSLGAWPFSNITQGYTVSDTTSEALRAVLLVQSLPDFEKLVDIPRLRLSVDVILGMQNENLGFASYEPARTGEWMELLNPAEVFGNIMVEYSYPECTTSVILALRAFTKYDPGYRRDEIENTIENALEYVVKMQRPDGSWYGSWAICFTYAAMFATGSLASAGRYYENCPVQKKACEFLLSKQRPDGGWSESYMACVTGVYTETESSLVTQTGWALDALINAKYPDRKPIEKGIKFLMASQKSDGSWQQKSMEGIFNKNVAIAYPNYKLYFSIYTLGKFAKQYGNYLTI

SEQ ID NO: 98549 - DNA, 2677 bp, Pisum sativum (garden pea)
  CDS (116)..(2386)
gaaaaatcacgctacacacatacacacagttttgttactcctcatgattaatcctcactttatttaatcctcattttttattgaacccccaccgcaatacagtttgtttagaaaaatgtggaagctcaaggttgcggaaggaggtactccatggcttcggacattgaacaaccacgtcggaagacaggtatgggagttcgatcctcattccggatcgccacaagatctcgacgatatcgaaaccgctcgccgcaatttccacgataatcgcttcactcacaaacacagtgatgatctacttatgcgccttcagtttgcgaaagagaaccctatgaacgaagttttacctaaagtgaaagtcaaagatgtcgaggatgtaacggaagaggctgttgcaacgacattaagaaggggattgaatttctattcaactatccagagtcatgatggacactggccaggagattatggaggtcccatgtttcttatgcctggattggttattactctgtctgtcaccggggctttgaatgcagtcttaacagacgagcatagaaaggaaatgcgtcgttacctttataatcatcagaacaaggatggtgggtggggtttgcatattgagggtccaagcacaatgtttggctctgtcttgtgttatgttactctaagattgctaggggagggacctaatgatggagaaggggatatggagagggggcgtgattggattcttgagcatggtggtgctacttatataacatcctgggggaaaatgtggctatcagtacttggagtgtttgagtggtctggaaataatcccatgcctcctgaaatatggctccttccatacgcgcttcctgttcatccaggaaggatgtggtgtcactgccggatggtctatttgccaatgtcctacttgtatggcaagaggtttgttggtccaatcacaccaacagtattatctttgagaaaagagctttttaccgttccataccatgatatagactggaaccaggctcgcaatttgtgtgcaaaggaagacttatattatcctcatccgcttgtgcaagatattctttgggcaactctacacaagtttgttgagcctgttttcatgaattggcctggcaaaaagttgagagaaaaggctatcaagactgcaattgagcatatacattatgaagatgagaacactcgttatatttgcataggtcctgtaaataaggtgttaaatatgctttgctgctgggtagaagatccaaattcagaggctttcaagttgcatcttcccaggatctatgattatctatgggttgctgaagatggcatgaaaatgcagggctacaatggaagtcaactatgggatactgcatttgctgcacaagcaattatttcaactaacctaattgacgaatttggtccaactctaaaaaaggctcatgcattcattaagaattcacaggtttcggaagattgtccgggggatcttagtaaatggtaccgtcacatttcaaaaggtgcttggcctttttcaactgcagaccatggatggccaatatctgactgcacggcagaaggactgaaagctgttctattgctatctaaaattgcacctgagattgttggtgaaccattggactcaaagagattatatgatgctgtaaatgttattctctcattacagaatgaaaatggtggccttgcaacatatgagctcacacgatcttatacctggttggagataatcaatcctgctgaaacatttggtgacattgttattgattgtccttacgtggaatgtacctcagcagcaattcaagctttagcaacatttgggaaactatatcccgggcatcgtcgagaagaaatacaatgttgtatagaaaaagctgttgcctttattgaaaaaattcaagcttcagatggttcatggtatggttcttggggagtttgctttacatatggcacttggtttgggataaaagggctgattgctgctggaaagaatttcagtaattgtttaagcatccgtaaagcttgtgagtttctgctgtctaagcagctcccatctggtggttgggcagaaagttatctgtcatgtcaaaacaaggtgtattcaaatttggaaggcaacaggtcccatgtagtaaacactgggtgggctatgctggctctcattgaggctgaacaggcaaagagagatccaacaccactgcaccgtgcagctgtatgcttgataaattcccaattggagaatggtgactttccgcaagaggaaataatgggagtcttcaacaagaattgcatgatcacttatgctgcatacagatgcatattccccatatgggcgttaggagaataccgccgtgtattgcaggcctgctaatatcgctttatttaggccaccattcaaattatttcgaccttttattaggctccacggttttattctaaaaaaggtttatagcttatgagtttggcatcctgctaaacctagtgaaactaaatttacaggaatttgttgtgttgccctttttgtagcacaaggagcacggttgtgcgtttttagtcatgttcaaatagtttgagttcattccaattgggaagagattttaacgtggttggtatatgtaagaagaacgtaagaaaaaataaagttaatttgggactattatat

SEQ ID NO: 98550 - protein, 756 aa, Pisum sativum (garden pea)
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDYGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 98551 - DNA, 3769 bp, Candida albicans
  CDS (186)..(2372)
aagcttataatatgcaggattcacgtgaatgaaattatgcacgaccacacacacactcacaaaaaaaaataataacagaattggctgttctacgcgatcgtttaaaatctgggcaacgtcaaatcaaacatcagtaggttcttgttattggcattccataattaaacaccctggaacattgacaaatgtattattcagaggaaattggtcttcccaaaactgatatttcaagatggaggttacgaagtgacgctcttggtagggaaacatggcattatctatcacaatctgaatgtgaaagtgaaccacaatcaacatttgtccaatggcttttagagtcgccagattttccatctccgccatcgtcagatattcatacttcaggcgaggcagcaagaaagggagctgattttttgaaactattgcaattggataatggtatcttcccctgccagtacaaaggtccaatgtttatgacaattggctatgtaactgctaattattatagcaagactgagatacctgagccgtatagagttgagatgatacgttatattgtcaacactgcacacccagtcgatggtggttggggacttcattctgttgataaatctacttgttttgggacaaccatgaattatgtatgtctccggttattaggaatggaaaaggatcatccagttttggttaaggcgagaaaaacattacatcgtttgggtggtgccattaagaatccacattggggtaaggcttggctatctattttgaatttatatgaatgggagggtgtgaacccagctccaccagaactttggagattaccgtactggttaccaattcatccagcgaaatggtgggtacatactagggctatctatttgccattgggatatacgtctgcaaacagagttcaatgtgagcttgatccacttttaaaagagatcagaaatgaaatttacgttccaagtcaattaccttatgagtcaatcaaatttggtaaccagagaaataatgtttgtggtgtcgatttatattacccacatacaaagattcttgattttgcaaattctatattgagtaaatgggaagctgttagacctaagtggttattgaattgggttaacaagaaagtttatgatttaattgtaaaggagtatcagaatacagagtacttgtgtattgctcctgtgagttttgccttcaatatggttgtgacgtgtcattatgagggctctgaatcagaaaactttaagaaactccaaaacagaatgaacgatgttttgtttcatggacctcagggaatgactgttatggggacaaatggtgtacaagtttgggatgccgcctttatggtacagtactttttcatgacaggcttagttgatgacccaaaatatcacgatatgatcagaaagagttatttatttttagtgagatctcaatttacagaaaattgtgtcgatggaagtttcagagatagacgtaaaggtgcttggccatttagtactaaggaacaaggatatactgttagtgactgtactgcagaagcaatgaaggctattattatggttaggaatcatgcaagttttgctgacatcagggacgaaataaaagatgaaaacttgtttgatgctgttgaagttttgttgcaaattcaaaatgtgggagaatgggaatatggctcattctcgacttatgaaggtataaaagcccctttgttgctagaaaaattgaatcctgccgaggtttttaataatattatggtggagtatccatacgtggaatgtacagactcttccgttttagggcttacttactttgccaaatattaccctgactacaagcccgaattgattcagaaaactatttcctctgccattcaatatattcttgattcacaagataacattgatggctcttggtatggttgttggggaatttgttatacttatgcgtcgatgtttgcattagaagctttgcatacagttggtcttgattatgaatcctcatcagctgtgaaaaaaggatgtgattttcttatttcaaaacaacttccagacggtggatggtcagaatcaatgaaaggttgtgaaacacactcttatgtcaatggtgaaaactctcttgttgttcaatcggcttgggctttgatagggttgatattgggaaattatcctgatgaagagccaatcaaaagaggaattcaatttttgatgaaacgacaattaccgactggtgagtggaagtatgaagatattgaaggtgtatttaatcacagttgtgcaatagaatatccttcatataggtttttatttccaattaaggcattaggtttatataaaaacaagtatggtgataaagtgttagtttaagtagtcgtgcatgttttcaaaaaaagagaaaatgttgcaaaataaacacaaacttcttttttttttgcttcaaaattttctacaaaatctcctcaataatataaatcaattattgaaacaaccgtaatttcccccctaaaattatgtattaagtatagaacacaataattaatgattataaatattaaagaaattattaaaaaaaaatagaaaaatgaaagaaatccaaataaaccgttttccagctctcaacctttgctatttctcttgttttgcctcacttcctggcaatggaatcacaggaagtgtaaagtaagagttctgttttgttgccaataaggcgaaagtatcataaagtgcagcaacaactgcaattacaccaaaggcaccagcagctttggttaatgcaaccgaaccaacaaaatatgatgccgacaacaatgaaaaaagtgcagtaagacaaaggaaaaacccacttaataaaaccgtactcttgaaagtaagcaacataaagataaaactaagaattgcccaggcaatcaaataaaatgccaaggcactggaaagttgtgtcatatccttttgataggctgcgagaataccaaaagtagggatgtttatagcagcaaaggataaccagaatgctccatacgatgtcaaagcagtaaaaactaataacaatttggttagtaagctaatttgttttataaattgatttccaattttgatatatacatactcaaggtatctccagaaaagaaaacccaaataccagctattgtttgaacgacaccaccgtagaaggtagccaatgaaactgcaacattgatggttttgatgccacgagcttgtaataaatacaaacttaaaaccaaagtagttatagcaaaagcacacaaacctaatggtgttgagcttgcaaatttgctgctcagtgattgtgcattatgggcaaggacagacattatctcatgtctataatacttcttgtttcctaaaataacaaactcaccaccatcaccagaaatctcaactttggtgacgttgttgccattggggctgccgacagaatcaacgtctttagactcagctgtagatgcagataccattacttataatttgattttataacttttttggtcaagtatttctcttgcaaatggaacattcaaaaaatactgattaccaaacctatttataactgagctgtaaagtacttttacttatgatgtataattgaactagatttgatgcattattaagcagtttgcaattgtaactagagaaaaggtttaaaatcaggtaagatattattaaaatataaagagtgatactttcttgtcactgtaattaaagcaatattataacaagctaggtgtggatattataactctaga

SEQ ID NO: 98552 - protein, 728 aa, Candida albicans
MYYSEEIGLPKTDISRWRLRSDALGRETWHYLSQSECESEPQSTFVQWLLESPDFPSPPSSDIHTSGEAARKGADFLKLLQLDNGIFPCQYKGPMFMTIGYVTANYYSKTEIPEPYRVEMIRYIVNTAHPVDGGWGLHSVDKSTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTEYLCIAPVSFAFNMVVTCHYEGSESENFKKLQNRMNDVLFHGPQGMTVMGTNGVQVWDAAFMVQYFFMTGLVDDPKYHDMIRKSYLFLVRSQFTENCVDGSFRDRRKGAWPFSTKEQGYTVSDCTAEAMKAIIMVRNHASFADIRDEIKDENLFDAVEVLLQIQNVGEWEYGSFSTYEGIKAPLLLEKLNPAEVFNNIMVEYPYVECTDSSVLGLTYFAKYYPDYKPELIQKTISSAIQYILDSQDNIDGSWYGCWGICYTYASMFALEALHTVGLDYESSSAVKKGCDFLISKQLPDGGWSESMKGCETHSYVNGENSLVVQSAWALIGLILGNYPDEEPIKRGIQFLMKRQLPTGEWKYEDIEGVFNHSCAIEYPSYRFLFPIKALGLYKNKYGDKVLV

SEQ ID NO: 98553 - DNA, 2173 bp, Zymomonas mobilis
  CDS (91)..(2067)
aggcctgcctgcgactattgaaagcgctatacgatctggccagactgcggctgatctcgctttatcccattcataattagaaagcccataatgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaacaggctgattttataacctgttagtaatgaaatacgtctaaatcaaaatacggctgattttttggccgtatttttttgtattatcatattgtttttataaaatatt

SEQ ID NO: 98554 - protein, 658 aa, Zymomonas mobilis
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 98555 - DNA, 1905 bp, Alicyclobacillus acidoterrestris
  CDS (1)..(1905)
atgacgaagcaactcctggatacacctatggtacaagcgacgctggaagcaggcgtcgcacatcttttgcgccgacaggcacccgacggatactggtgggcgccgctattgtcaaatgtctgcatggaagcggaatatgtgcttctctgtcactgcttggggaaaaagaatcccgagcgcgaggcgcaaatccgcaagtatatcattagtcagcgccgcgaagacggcacctggtccatttatccgggtggcccaagtgacttgaatgccacggttgaggcgtatgtggcgctcaaatacttgggtgagccagcatctgacccgcaaatggtacaggccaaggaattcattcaaaacgagggcggcattgaatctacgcgtgtctttacacgcttgtggttggccatggttgggcagtatccgtgggataagttgccggtgattccacctgaaatcatgcaccttccgaaaagcgtgccgctgaacatctatgattttgcgtcttgggcgagagcgactatcgtcacgctgagctatcgtcatgaatcgccgacctgtgacgccacttccggattatgcaaaggttccggaattgttcgaggcgaaggcccgccgaagcgacgttcggccaagggtggagattcgggcttttttgtcgcattggataagtttctgaaggcgtacaacaaatggccgattcaaccgggtcgcaagagtggggaacaaaaggcgctcgagtggatactcgcgcaccaggaagccgacggctgctggggcggtattcaaccaccgtggttttacgctctgttggcgcttaaatgtcttaatatgactgaccatcctgcgtttgtaaaagggtttgaagggctcgaggcctatggtgtgcacacgagtgacgggggttggatgttccaggcgagtatttctccaatctgggatactggcttgaccgtcttggcactgcgttcggctggattgccaccagatcatccagcgctgattaaagcgggtgagtggttggtcagtaaacaaattctcaaggatggcgactggaaagttcgtcgacgcaaggcgaaaccaggcggttgggcatttgaattccactgcgaaaactacccagacgtcgacgatacggcgatggtcgtcttggcgctcaatggcattcaattgccggatgaagggaagcgtcgtgacgcattgacccgtggcttccgttggttgcgcgagatgcagagttcgaacgggggctggggcgcatacgatgtggacaacacgcgtcagttgaccaaatcggattccatttttgcgacttcgggcgaagtgattgatccgccatcggaagacgtcaccgcacacgtcttggagtgcttcggcagctttgggtacgacgaggcatggaaggtgattcgcaaggcggtcgagtatctcaaggcgcaacaacgcccagatgggtcatggtttggccgctggggcgtcaactacgtgtatggcatcggcgcggtcgttccgggactcaaggccgtcggtgtcgatatgcgtgagccgtgggtgcaaaagtcgctcgactggctcgtcgagcatcaaaatgaggatggcggttggggtgaagattgccgttcctatgatgatccacgtctcgcaggtcagggtgtgagtacaccgtcgcagaccgcctgggcgttgatggcgctcatcgcgggcggccgtgtcgagtcagatgcggtattgcgcggggtcacttaccttcacgacacgcagcgcgcagatggtggctgggacgaagaggtctacacgggaactggttttccgggagatttctatcttgcgtatacgatgtatcgtgatattttacctgtgtgggcgttgggccgctatcaggaagcgatgcagcgaatccgggggtaa

SEQ ID NO: 98556 - protein, 634 aa, Alicyclobacillus acidoterrestris
MTKQLLDTPMVQATLEAGVAHLLRRQAPDGYWWAPLLSNVCMEAEYVLLCHCLGKKNPEREAQIRKYIISQRREDGTWSIYPGGPSDLNATVEAYVALKYLGEPASDPQMVQAKEFIQNEGGIESTRVFTRLWLAMVGQYPWDKLPVIPPEIMHLPKSVPLNIYDFASWARATIVTLSYRHESPTCDATSGLCKGSGIVRGEGPPKRRSAKGGDSGFFVALDKFLKAYNKWPIQPGRKSGEQKALEWILAHQEADGCWGGIQPPWFYALLALKCLNMTDHPAFVKGFEGLEAYGVHTSDGGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTKSDSIFATSGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGEDCRSYDDPRLAGQGVSTPSQTAWALMALIAGGRVESDAVLRGVTYLHDTQRADGGWDEEVYTGTGFPGDFYLAYTMYRDILPVWALGRYQEAMQRIRG

SEQ ID NO: 98557 - DNA, 1944 bp, Synechocystis sp
  CDS (1)..(1944)
atggttattgccgcctctccctccgttccttgtcctagcaccgagcaggtgcgccaggcgatcgccgctagtcgggacttcctgctatcggaacaatatgccgatggctactggtggtctgagttggaatccaatgtcaccatcactgccgaagtggtcatactgcacaaaatttggggcacagcggcccaaagacccctggagaaggcgaagaattacctgttgcaacaacaacgggaccatggcggttgggaactgtactatggtgatggcggtgaactaagtaccagtgtggaagcctacactgccctgcgaattttgggggttccagccaccgatcctgccttggtcaaagcgaaaaatttcattgtcggccgggggggcattagcaaatcccgcatttttaccaaaatgcatctggcgttaatcggttgctacgactggcggggtactccttccattcccccctgggtgatgcttttgcccaacaattttttctttaacatttacgaaatgtccagttgggcccgttctagtacggtccccctgatgattgtttgtgaccaaaagcccgtttacgacattgcccagggtctgcgggtggacgaactctatgcggaagggatggaaaatgtccagtataaattgccggagagtggcactatttgggatattttcatcggtttggatagcctatttaagctacaggaacaagccaaggtagtacctttccgagaacagggtttggccctggcggaaaagtggattttagaacgacaagaagtcagtggcgattggggcggcattattcccgctatgctgaattccctgctggcgttgaaagtgttgggctatgacgttaacgatctctatgtgcaaaggggcctagcggcgatcgataatttcgcggtggaaacggaagatagctatgccattcaagcctgtgtttcccctgtgtgggatacggcctgggttgtgcgggctttggcggaagcggatctaggtaaggatcatcccgccttggttaaagcggggcaatggttgttggataaacaaattctcacctacggcgattggcagatcaaaaatccccacggtgaaccgggagcttgggcgtttgaatttgataataatttctaccctgacattgacgacacctgcgtggtgatgatggcgttacagggcattaccctccccgatgaggaacgtaaacagggggccattaataaggccttgcagtggatagccaccatgcaatgtaaaaccggaggctgggccgcctttgacattgacaatgaccaagattggcttaaccagttaccctacggtgatttgaaagccatgattgaccccagcaccgccgatattaccgcccgggtggttgaaatgctgggagcctgtggtttgaccatggattccccacgagtggaacggggtttgacctatttactccaagaacaggaacaggatggtagttggttcggccgctggggcgtgaattatctctatggcaccagcggggccctttctgccctagccatttacgatgcccaacgttttgccccccaaatcaaaacggcgatcgcctggttgttgagctgtcaaaatgcggatgggggttggggagaaacctgtgaaagttataaaaacaagcagttaaagggtcaaggtaacagcactgcttcccaaacagcctgggccctaattggtttgttagatgccctcaaatatttacccagcctgggacaagatgccaaactaaccacggcgatcgaggggggcgtggcttttcttgtccagggacaaacccccaagggcacctgggaagaagcagaatataccggcaccggttttccctgtcacttttatatccgctatcactactaccgccaatattttcccctcattgccctagctcgttatagccatttacaagcatcttaa

SEQ ID NO: 98558 - protein, 647 aa, Synechocystis sp
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 98559 - DNA, 2493 bp, Arabidopsis thaliana (mouse-ear cress)
  CDS (1)..(2493)
atgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaatttctaagagagaagaaattcgaacaaggcataccacaactaaaagctactaacatagaagaaataacgtatgaaacaacgacaaatgcattacgaagaggcgttcgttacttcacggctttgcaagcctccgacggccattggccgggagaaatcaccggtccgcttttcttccttcctcctctcatattttgtttgtacattaccggacatctggaggaagtattcgatgctgaacatcgcaaagagatgctaagacatatctattgtcaccagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgcggtggagtgatctttattccttcttgggggaaattttggctctcgatacttggagtctatgattggtctggaactaatccgacgccaccagaactcttgatgctgccttcttttcttccaatacatccaggtttgctatgttctgctgattctatatttgtgtttcgttttttctcttcaaataatgtttgtcctgctccaaaaaaatttgaaaacacacagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagtatgtatgcttgactactttcaatcttgaaattttatttttcttggaagaaaactccacaaacattctgccattccttatgcaggaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggcaaaccattttaagaaccctttaataaaagaagaattatatgtactgtgcatgctagcttgttgggttgaaaatccgaatggagattatttcaagaagcatctggctagaattccagattatatgtgggtcgctgaagatggaatgaaaatgcagagctttggatgtcaactgtgggatactggatttgctattcaagctttgcttgcaagtaatctccctgatgaaactgatgatgcactaaagagaggacataattacataaaggcatctcaggttagagaaaacccttcaggtgattttaggagcatgtaccgccacatttcgaaaggagcatggacattttctgatcgagatcatggatggcaagtttcagattgtacagctgaagctttaaagtgttgcctgctgctttccatgatgtcagctgatatcgtcggccagaaaatagatgatgaacaattatatgactctgttaacctcttgctgtctttacagagcggaaatggaggtgtcaatgcgtgggagccatcccgtgcatataaatggttggaactgctcaatcctacagaattcatggctaataccatggtcgagcgggagtttgtggaatgcacctcatctgttatacaagcacttgatctatttagaaaattgtatccagatcacaggaagaaagagatcaacaggtccatcgaaaaagctgtgcaatttatacaagacaatcaaacaccagacggttcatggtacggaaattggggtgtttgcttcatttacgctacttggtttgctcttggaggcctagcagcagctggtgaaacttacaacgattgtttagctatgcgcaatggtgtccactttttgctcacgacacaaagagatgatggaggttggggtgaaagctatttatcatgctccgaacagagatatataccatcagaaggagaaagatcaaaccttgtgcaaacatcatgggctatgatggctctaattcatacgggacaggctgagagagatttgattcctcttcatcgtgctgccaaacttatcatcaattcacaacttgaaaacggcgattttcctcaacaggaaatagtaggagcgttcatgaatacatgcatgctacactatgctacatacagaaacaccttcccattatgggcactcgcagaataccgaaaagttgtgtttatcgttaattaa

SEQ ID NO: 98560 - protein, 830 aa, Arabidopsis thaliana (mouse-ear cress)
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGLLCSADSIFVFRFFSSNNVCPAPKKFENTQGKFCVIAGWLVYLCRIYMGRGLLVQLHLLFYSCAKNFTWNLMKKSIGKKVDVYMQKYVCLTTFNLEILFFLEENSTNILPFLMQEDMYYAHPLVQDLLSDTLQNFVEPLLTRWPLNKLVREKALQLTMKHIHYEDENSHYITIGCVEKANHFKNPLIKEELYVLCMLACWVENPNGDYFKKHLARIPDYMWVAEDGMKMQSFGCQLWDTGFAIQALLASNLPDETDDALKRGHNYIKASQVRENPSGDFRSMYRHISKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNTCMLHYATYRNTFPLWALAEYRKVVFIVN

SEQ ID NO: 98561 - DNA, 2043 bp, Streptomyces coelicolor
  CDS (1)..(2043)
atgacagcgacgaccgacggaagcaccggagcctccctgcggcccctggcagcctcggccagcgacaccgacatcacgatccccgccgcggcggccggggtacccgaagccgccgcccgcgccacccggcgtgccaccgacttcctgctcgccaagcaggacgccgagggctggtggaagggcgacctcgagacgaacgtcacgatggacgccgaggacctgctcctgcgtcagttcctgggcatccaggacgaggagaccacccgcgccgccgcgctgttcatccgcggcgagcagcgcgaggacggcacctgggccaccttctacggcggccccggcgaactgtccacgaccatcgaggcctacgtcgccctccgcctggccggcgactcacccgaggcgccccacatggcgcgggccgcggagtggatcaggtcccgcggcggcatcgcctccgcccgggtcttcacccggatctggctggccctgttcggctggtggaagtgggacgacctgcccgaactcccgccggagctgatctacttccccacctgggtcccgctcaacatctacgacttcggctgctgggcccggcagaccatcgtgccgctcaccatcgtctccgcgaagcggccggtgcgtcccgcgccgttcccgctggacgaactgcacaccgacccggcccgccccaacccgccacgccccctggcacccgtggccagctgggacggcgccttccagcgcatcgacaaggccctgcacgcctaccgcaaggtcgccccgcgccggctgcgccgggccgcgatgaacagcgccgcccgctggatcatcgagcggcaggagaacgacggctgctggggcggcatccagccgcctgcggtctactcggtcatcgccctctacctgctcggctacgacctcgaacaccccgtgatgcgcgcgggactggagtcgctggaccgtttcgccgtctggcgcgaggacggcgcccggatgatcgaggcctgccagtccccggtgtgggacacctgcctggccaccatcgcgctggccgacgcgggcgtgcccgaggaccacccgcagctggtgaaggcctcggactggatgctcggcgaacagatcgtgcgccccggcgactggtcggtgaagcgccccggactcccgcccggcggctgggcgttcgagttccacaacgacaactaccccgacatcgacgacaccgccgaggtggtcctcgccctgcgccgggtcaggcaccacgacccggaacgggtggagaaggcgatcgggcgcggggtgcgctggaacctcggcatgcagtcgaagaacggcgcctggggcgccttcgacgtcgacaacaccagcgccttccccaaccggctgccgttctgcgacttcggcgaggtcatcgacccgccgtccgcggacgtcaccgcgcacgtcgtcgagatgctcgccgtcgagggcctcgcccacgacccgcgcacccgccgcggcatccagtggctgctcgacgcccaggagacggacggttcgtggttcggccgctggggcgtcaactacgtctacggcaccggttccgtgatccccgcgctgaccgcggccggactgcccacctcgcacccggccatccgccgggcggtgcgctggctggagtccgtccagaacgaggacggcggctggggcgaggacctgcgctcctaccgctacgtccgggagtggagcggccggggcgcctcgaccgcctcgcagaccggctgggcgctgatggccctgctggcggcaggggagcgggactccaaagccgtggagcgcggcgtcgcatggctcgcggccacccagcgggaggacggctcctgggacgagccctacttcacgggcaccggcttcccgtgggacttctccatcaactacaacctctaccgccaggtcttcccgctcaccgctctcggccggtacgtccacggggagcccttcgccaagaagccccgcgcggccgacgcccccgccgaagccgccccggccgaggtgaagggcagctga

SEQ ID NO: 98562 - protein, 680 aa, Streptomyces coelicolor
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 98563 - DNA, 1965 bp, Methylococcus capsulatus
  CDS (1)..(1965): b means g or c or t/u
atgttgagagaagcgacagcaatatccaacctcgaaccgccgctgaccgcctcatacgtcgagtcccctctcgatgcggcgatccggcaggccaaggaccgtctgctgagcctgcagcacctggaaggctattgggtgttcgaactcgaagccgactgcaccatcccggccgagtacatcctgatgatgcatttcatggatgaaatcgacgcggcactgcaggccaagatcgccaactatctgcgccaccaccagagcgccgacggcagctatccgctgttccggggcggcgccggcgacatcagctgcaccgtcaaggtctattacgccctcaagctggcgggcgattccatcgacgccccccacatgaagaaagcccgtgagtggattcttgcccagggcggcgccgcccgctccaacgtcttcacgcgcatcatgctcgccatgtttgaacagattccgtggcgcggaatccctttcaccccggtggaaatcatgctgctgccgaagtggtttcccttccatctggacaaggtgtcgtactggtcgcgcacggtgatggtgccgctgttcattctgtgcagtcataaagtgaccgcgcgcaatccatcccggatccatgtccgcgaactgttcacggtcgagccgcagaaggagcgccattatttcgaccacgtcaagacgccgctcggcaaggccatcctcgcgctggagcggttcggacggatgctggaacccctcattcccaaagccgtacgcaagaaggccacccagaaagccttcgactggttcacggcccggctcaatggcgtggatgggctcggcgcgatatttccggccatggtcaatgcctatgaggcgctggatttcctcggcgtccctccagacgacgagcgccgccgactcgctcgcgaatccatcgaccggctgctggtgttccaaggcgacagcgtctactgccagccctgcgtctcgccgatctgggacaccgccctcacgtccctcaccttgcaggaagtggcacgtcataccgcggacctccggctcgacgcggctctcagcaagggcctcaagtggctggcctcgaagcagatcgacaaggacgcgcccggtgactggcgggtcaaccgggccggtctggaaggcggtggctgggcgttccagttcggcaacgactattatcccgacgtggacgacagcgctgtcgtggcccacgcgctgttgggctcggaagatcccagcttcgacgacaacctgcggcgggcggccaactggatcgccggcatgcagtcccgcaacgggggcttcggggccttcgacgccgacaacacgtactattacctcaattccatccccttcgccgaccacggcgccctgctcgacccgccgacggcagacgtgagcgcccgctgcgccatgttcctcgccagatgggtgaaccggcaaccggagctgcgtcccgtcctggagcgcacgatcgattacctgcgccgggaacaggaagccgacggctcctggttcggccgctggggcaccaactacatctacggacctggtgcggtgctgctggcctacgaaggccgccgtgttccgaacgacgaccccagcgtgcggcgcgccgtggcgtggctcaagagcatccagcgcgaggatggcggctggggggaagacaacttcagctatcacgatccgtcgtatcgcggccgcttccacaccagcactgcattccaaaccggattcgccctgatcgcgctgatggcggcgggcgaagbcggctcaccggaagtccaggccggcgtcgattacctgctccgccagcagcggcccgacggattctggaacgatgaatgcttcaccgcaccgggtttcccccgtgtgttctatctgaaatatcacggctacgacaaattcttccccctgtgggcgctggctcgttaccgtaacgaacgctacgccctggcgtga

SEQ ID NO: 98564 - protein, 654 aa, Methylococcus capsulatus
  misc_feature (591)..(591): Xaa can be Gly or Ala or Val
MLREATAISNLEPPLTASYVESPLDAAIRQAKDRLLSLQHLEGYWVFELEADCTIPAEYILMMHFMDEIDAALQAKIANYLRHHQSADGSYPLFRGGAGDISCTVKVYYALKLAGDSIDAPHMKKAREWILAQGGAARSNVFTRIMLAMFEQIPWRGIPFTPVEIMLLPKWFPFHLDKVSYWSRTVMVPLFILCSHKVTARNPSRIHVRELFTVEPQKERHYFDHVKTPLGKAILALERFGRMLEPLIPKAVRKKATQKAFDWFTARLNGVDGLGAIFPAMVNAYEALDFLGVPPDDERRRLARESIDRLLVFQGDSVYCQPCVSPIWDTALTSLTLQEVARHTADLRLDAALSKGLKWLASKQIDKDAPGDWRVNRAGLEGGGWAFQFGNDYYPDVDDSAVVAHALLGSEDPSFDDNLRRAANWIAGMQSRNGGFGAFDADNTYYYLNSIPFADHGALLDPPTADVSARCAMFLARWVNRQPELRPVLERTIDYLRREQEADGSWFGRWGTNYIYGPGAVLLAYEGRRVPNDDPSVRRAVAWLKSIQREDGGWGEDNFSYHDPSYRGRFHTSTAFQTGFALIALMAAGEXGSPEVQAGVDYLLRQQRPDGFWNDECFTAPGFPRVFYLKYHGYDKFFPLWALARYRNERYALA

SEQ ID NO: 98565 - DNA, 2229 bp, Arabidopsis thaliana (mouse-ear cress)
  CDS (1)..(2229)
atgtggaggttaaagttatcggaaggagacgaagagagcgtgaatcaacatgttggaagacagttttgggaatatgataaccaatttggaacctctgaagagagacatcacattaaccatcttcgtagcaactttactctcaatcggttttcttctaagcatagttctgatcttctctaccgttttcagtgttggaaagagaaaggaaaaggaatggagagacttccacaagtgaaagtaaaagagggggaagaaagattgataaatgaagaagtggtgaatgttacattaagaagaagtttgagattctactcaatacttcaatcacaagatggtttttggcctggtgattatggtggccctttgtttctcttgcctgctctggtgatcggcttatatgtgacggaagttttggatggaactttaactgcgcaacatcaaatcgagattcgtcgttatctctataaccatcagaacaaggatggaggatggggactacacgtagaagggaatagcaccatgttttgtacagtgctctcatacgtagcactgagactaatgggggaagaattagacggtggagatggagccatggaatcagctagaagttggattcaccaccacggtggtgccacttttattccctcctggggcaagttctggctctccgttcttggagcttatgagtggagtgggaacaatcctttacctccagagctatggctccttccatatagtcttccttttcatccgggccgaatgtggtgccattgtaggatggtttatcttccaatgtcatatctatatggaagaagatttgtttgtcgtactaatggaactattttatcgcttcgacgagagctctacactattccttatcaccatatcgattgggacaccgcccgtaatcaatgtgccaaggaggacttgtactatccacatccaaagattcaagacgtcctttggagttgtctgaataaatttggagagcctcttcttgaaagatggccattgaataacctcagaaaccatgctcttcagacagtaatgcaacacattcactatgaagaccaaaacagccactatatttgtatcggtcctgtcaacaaagtcttgaatatgctttgttgttgggtcgagtcctcgaattccgaggcatttaaatctcacctctcgcggattaaagactatttgtgggtggctgaggatggaatgaaaatgcagggatacaacggatctcagctgtgggacgtgactttagcggtccaagcaatcttggcgacgaatttggttgatgactatggtttgatgcttaagaaagcccataactacatcaagaacactcaaataaggaaagacacaagtggagatccggggttgtggtaccgacacccgtgcaagggaggatggggtttctccactggagacaatccatggcctgtctctgattgtactgctgaagccttgaaggcggcgttgctattgtcacaaatgccggttaatttagttggagaacccatgcctgaagagcatttagttgatgctaacaagaatgggggatttgcgtcatatgagctaactagatcatatcccgagctagaggttatcaacccatcagagacttttggggatatcatcatagattatcaatacgtagaatgcacgtcagctgccatccaaggtctcgtgttattcacaacgttaaattcgagctacaagaggaaggagatagtaggaagcatcaacaaagcagttgagtttattgaaaaaacacaacttcctgatggttcatggtatggctcgtggggagtgtgtttcacctatgcaacatggtttggtattaaaggcatgttggcttcaggcaaaacatatgagagcagtctttgtattagaaaagcttgtggtttcttgctctccaaacaactttgttgtggtggatggggagagagctacctttcttgccaaaacaaagtatacaccaatcttcctgggaataaatcgcatattgtgaacacatcatgggcactcttggctctcattgaagcgggacaagctagtagagatccgatgccattgcatcgcggggcaaaatcgctgatcaactcgcagatggaagatggagattacccacaacaagtgagtaaaatgttttatattcatagacaggttttgttttcactaacctcattgattatatttgcttcttactttttgttcaggagatactag

SEQ ID NO: 98566 - protein, 742 aa, Arabidopsis thaliana (mouse-ear cress)
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDANKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQVSKMFYIHRQVLFSLTSLIIFASYFLFRRY

SEQ ID NO: 98567 - DNA, 2449 bp, synthetic construct
  CDS (1)..(2292)
atgtggaagttgaagataggagagggaaatggagaagatccttacttgttcagcagcaacaacttcgtcggacgtcaaacatgggagtttgatcccaaagccggcacacctgaggaacgagccgccgtcgaagatgctcgccggaactatttagacaaccgtccccgtgttaaaggttgcagtgatctcttgtggcgaatgcaatttttgaaagaggcgaaattcgagcaagtgatcccgccggtgaaaatcgacgacggcgaaggcataacttacaaaaacgcgacggatgcgttacggagagcagtttctttctactcggctttgcagtcctccgatggccactggccggcggaaatcaccggaactctcttcttccttcctccattggtattttgtttctatatcacaggacacctcgagaagatatttgatgcagaacatcgcaaagagatgcttcggcatatctattgccaccaaaacgaagacggtggatggggtttacatattgagggaaagagcgttatgttctgcaccgtactgaattacatatgcttgcgtatgctcggagaaggtcccaatggagggcgcaataacgcctgcaaacgggccaggcaatggattcttgaccatggtggtgtgacttatattccttcttggggaaaaatttggctctcgatactcggaatctatgattggtctggaaccaacccaatgcctcccgagatttggttgctgccttctttctttccaatacacttaggaaaaactttgtgttatacccggatggtttatatgcccatgtcttatctatatgggaaacgatttgttggtcctcttacacctcttattatgctattgcgcaaagaactgcacttgcaaccttatgaggaaatcaattggaacaaagcgcgccgtctatgtgcaaaagaagacatgatttatcctcatcctctggttcaagatttgttatgggacactcttcacaattttgtggagcctatccttacaaattggccgttaaaaaaacttgtacgggaaaaggctcttcgagtggcaatggaacacatacattatgaggacgaaaatagccattatattaccatcggatgtgttgagaaggttctgtgcatgcttgcttgctggatcgagaatcctaatggagatcactttaagaaacatctcgctagaattccggacttcatgtgggttgctgaagacggactgaaaatgcagagctttggaagtcaactctgggacacagtttttgcgattcaagctttacttgcttgtgacctttctgacgaaactgatgatgtactcaggaaaggacacagtttcatcaaaaaatcccaggttagagaaaacccttcaggtgactttaagagcatgtatcgccatatttccaaaggagcctggactctgtccgatcgagatcatggatggcaagtctcagattgtacagctgaagctttgaagtgttgcatgctgctctccatgatgccagctgaggtcgttggccagaaaatagatcctgaacaatcatatgattctgttaatctcttgctatcgttgcagggtgaaaaaggaggtttgactgcatgggagcctgtccgtccacaagaatggctggaattgctcaatcccacagatttctttacttgtgttatggctgaacgcgagtatgtagaatgtacctcagctgttatacaagctttggtactgttcaaacgactttatccggatcacaggacaaaagagatcatcaagtcgattgagaaaggggtgcaattcattgaaagcaaacaaacgcctgatggttcatggcatggaaactggggtatctgtttcatctacgctacttggtttgctctgagcggcctagcagccgctggtaaaacttacaaaagttgcctggctgtgcgcaaaggtgtagatttcctgcttgcgatacaggaagaagatggaggttggggcgaaagccatctgtcatgccctgggcagaggtacataccattagaaggggacagatcaaacctagtgcaaaccgcatggggtatgatgggtttgattcatgccggacaggccgagagagatcctacacctcttcaccgtgctgcgaaacttgtcatcagttcacaacttgaaaatggggactttccgcgacaggaaatattaggagtgttcatgaaaacatgcatgctacactatgctacgtacagaaacatcttcccactatgggcactcgcggaatatcggaaagctgccttcgcaactcatcaagatctttagctctttcttaatagtcaatctttaaaagagatttggctcttctttaataatattatacacaattctgtagatatgaaagacaaaataatattattaggagacttgatgttcttaatctgagagactggggttgagatttgcgttaagcaaaatgtca

SEQ ID NO: 98568 - protein, 763 aa, synthetic construct
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQSYDSVNLLLSLQGEKGGLTAWEPVRPQEWLELLNPTDFFTCVMAEREYVECTSAVIQALVLFKRLYPDHRTKEIIKSIEKGVQFIESKQTPDGSWHGNWGICFIYATWFALSGLAAAGKTYKSCLAVRKGVDFLLAIQEEDGGWGESHLSCPGQRYIPLEGDRSNLVQTAWGMMGLIHAGQAERDPTPLHRAAKLVISSQLENGDFPRQEILGVFMKTCMLHYATYRNIFPLWALAEYRKAAFATHQDL

SEQ ID NO: 98569 - DNA, 2486 bp, Arabidopsis thaliana
  CDS (112)..(2385)
tttcttctttatgtctaatctcatcggacgaaggtatttggcacaccgacacttctctaacttgcagtcgatcaatttttttatttttattcagggtcatcgtacgtcgtcatgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaatttctaagagagaagaaattcgaacaaggcataccacaactaaaagctactaacatagaagaaataacgtatgaaacaacgacaaatgcattacgaagaggcgttcgttacttcacggctttgcaagcctccgacggccattggccgggagaaatcaccggtccgcttttcttccttcctcctctcatattttgtttgtacattaccggacatctggaggaagtattcgatgctgaacatcgcaaagagatgctaagacatatctattgtcaccagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgcggtggagtgatctttattccttcttgggggaaattttggctctcgatacttggagtctatgattggtctggaactaatccgacgccaccagaactcttgatgctgccttcttttcttccaatacatccagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggtactgtgcatgctagcttgttgggttgaaaatccgaatggagattatttcaagaagcatctggctagaattccagattatatgtgggtcgctgaagatggaatgaaaatgcagagctttggatgtcaactgtgggatactggatttgctattcaagctttgcttgcaagtaatctccctgatgaaactgatgatgcactaaagagaggacataattacataaaggcatctcaggttagagaaaacccttcaggtgattttaggagcatgtaccgccacatttggaaaggagcatggacattttctgatcgagatcatggatggcaagtttcagattgtacagctgaagctttaaagtgttgcctgctgctttccatgatgtcagctgatatcgtcggccagaaaatagatgatgaacaattatatgactctgttaacctcttgctgtctttacagagcggaaatggaggtgtcaatgcgtgggagccatcccgtgcatataaatggttggaactgctcaatcctacagaattcatggctaataccatggtcgagcgggagtttgtggaatgcacctcatctgttatacaagcacttgatctatttagaaaattgtatccagatcacaggaagaaagagatcaacaggtccatcgaaaaagctgtgcaatttatacaagacaatcaaacaccagacggttcatggtacggaaattggggtgtttgcttcatttacgctacttggtttgctcttggaggcctagcagcagctggtgaaacttacaacgattgtttagctatgcgcaatggtgtccactttttgctcacgacacaaagagatgatggaggttggggtgaaagctatttatcatgctccgaacagagatatataccatcagaaggagaaagatcaaaccttgtgcaaacatcatgggctatgatggctctaattcatacgggacaggctgagagagatttgattcctcttcatcgtgctgccaaacttatcatcaattcacaacttgaaaacggcgattttcctcaacaggaaatagtaggagcgttcatgaatacatgcatgctacactatgctacatacagaaacaccttcccattatgggcactcgcagaataccgaaaagttgtgtttatcgttaattaatcatttacttatttatgtaatttttttctttttaaatgagatgaatgtttttccagcgacggaatacaccgaatattaaaagatgaacacaaaaatatttg

SEQ ID NO: 98570 - protein, 757 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHIWKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNTCMLHYATYRNTFPLWALAEYRKVVFIVN

SEQ ID NO: 98571 - DNA, 1965 bp, Rhodopseudomonas palustris
  CDS (1)..(1965)
atggattccggaactttcaatccgggtggagagcgcggcaacacgctcgacgcctcgatcgacgcggcgcgcgccgcgctgctgggttatcgtcgtgacgacggccattgggtgttcgaactcgaggccgactgcaccattccggccgagtacgtgctgctccggcactatcttggtgaaccgatcgacgccgcgctggaagccaagatcgccgtttatctgcgccggacccagggcgcacatggcggctggccgctggtgtatgacggcgaattcgacatgagcgccaccgtgaagggctatttcgcgctcaagatgatcggcgacagcatcgacgcgccgcatatggccaaggcgcgcgaggcgatcctgtcgcgcggcggcgcggtccacgccaacgtgttcacgcgattcctgctggcgatgttcggcatcctgacctggcgcgccgttccggtgctgccggtcgagatcatgctgctgccgatgtggtcgccgttccatctcaacaagatctcgtattgggcgcgcaccacgatcgtgccgctgatggtgctggcggcgctgaagccgcgcgcggtcaaccggctcggcgtcgggctcgacgagctgttcctgcaggacccgaaatcgatcgggatgcccgccaggggcccgcatcagaatcgcggcctgttcgcgctgttcggtgcgatcgacgcggtgctgcgggtgatcgaaccactgatcccgaagaagctgcggaaacacgcgatcgaccgcgccgtcgccttcgtcgaggagcggctgaacggcgaggacggtctcggcgcgatctatccgccgatggccaacaccgtgatgatgtacaaggtgctcggctatcccgaggaccatccgccgcgggcgatcacccggcgcggcatcgatctgctgctggtgatcggcgaggaggaggcctattgccagccctgcgtctcgccgatctgggacacttcgctgacctgccacgcgctgctcgaggcgggcggcgccgaggccgcgcagccggtgcgcgagggcttggactggctgctgccgaagcaggtgctcgacctcaagggcgactgggcggtgaaggcccccaatgtccgccccggcggctgggcgttccagtacaacaacgcccactatcccgatctcgacgacaccgcggttgtggtgatggcgctcgaccgcgcccgccgcgatcagccgagcgcggcctacgacaatgccatcgcccgcggccgcgaatggatcgaggggatgcagagcgacgacggcggctgggctgccttcgatgtgaacaacaccgaatattatttgaacaacatcccgttctcggaccatggcgcgatgctcgatccgccgaccgaggacgtaaccgcgcgttgcgtttcgatgttggcgcaactcggcgagaccgagcagaccagcaaggcggtggcgcggggcgttgcctatctgcgcaagacccagcttccggatggctcgtggtacggccgatggggcatgaactacatctatggcacctgggcggtgctgtgcgcgctgaacgccgccggcgtcgatcatcaggacccggcgatccgcaaggcggtcgcctggctggcgtcgattcagaacgccgatggcggctggggcgaggacggggtcagctaccggttggactaccggggctacgaaactgcgccgtccacggcgtcgcaaacggcatgggccttgctttcgatcatggctgccggggaagtcgatcatccggcggtagcgcgcgggattgagtacctaaaaggcacacagaccgaaaaaggactgtgggacgagcagcgccacaccgctacaggctttccgcgcgtgttttatctgcggtatcatggctactcaaagttctttccgctctggggcctggcgcggtatcgaaatttgagagccacgaacagcaaggtcgtaggggtcggaatgtga

SEQ ID NO: 98572 - protein, 654 aa, Rhodopseudomonas palustris
MDSGTFNPGGERGNTLDASIDAARAALLGYRRDDGHWVFELEADCTIPAEYVLLRHYLGEPIDAALEAKIAVYLRRTQGAHGGWPLVYDGEFDMSATVKGYFALKMIGDSIDAPHMAKAREAILSRGGAVHANVFTRFLLAMFGILTWRAVPVLPVEIMLLPMWSPFHLNKISYWARTTIVPLMVLAALKPRAVNRLGVGLDELFLQDPKSIGMPARGPHQNRGLFALFGAIDAVLRVIEPLIPKKLRKHAIDRAVAFVEERLNGEDGLGAIYPPMANTVMMYKVLGYPEDHPPRAITRRGIDLLLVIGEEEAYCQPCVSPIWDTSLTCHALLEAGGAEAAQPVREGLDWLLPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGAMLDPPTEDVTARCVSMLAQLGETEQTSKAVARGVAYLRKTQLPDGSWYGRWGMNYIYGTWAVLCALNAAGVDHQDPAIRKAVAWLASIQNADGGWGEDGVSYRLDYRGYETAPSTASQTAWALLSIMAAGEVDHPAVARGIEYLKGTQTEKGLWDEQRHTATGFPRVFYLRYHGYSKFFPLWGLARYRNLRATNSKVVGVGM

SEQ ID NO: 98573 - DNA, 2559 bp, Panax ginseng
  CDS (85)..(2361)
aagacttctctaattctctacctttcacatgcacactcatcttcctctcccctcgttcaaactctttcttcaaattgagtggaaatgtggaagcttaaaattgcagagggaggaaatccatggcttcgaactctgaacgatcacgtcggccggcaaatttgggagttcgatcccaacattggatcgcctgaagagcttgcggaggtcgagaaagttcgtgaaaattttcgcaatcatcgattcgagaaaaagcacagtgccgatctcctcatgcgcattcagtttgcaaatgagaatccaggcagtgtagtcttaccccaagtcaaagtaaatgatggtgaagatatttcggaggataaagtaacagttacattaaaaagagctatgagtttctattcaactcttcaggcacatgatggacattggccaggagattatggtggtcctatgtttctaatgcctggtttggttattacgctatcgataactggggtgctgaatgtagttttgtccaaagaacataaacgtgagatctgccgttatctttacaatcatcagaacagagatggtgggtggggtttacacattgaaggtccaagtactatgtttggtactgtcttgaactatgttactttgaggttgcttggtgaaggtgctaatgatggccaaggggcaatggaaaaagggcgtcaatggattctggatcatggtagtgccactgcaataacatcatgggggaaaatgtggctttcagttcttggtgtatttgaatggtctggaaataatcccctgccccctgagacgtggctgcttccatatattcttccaatccacccaggaaggatgtggtgccaccgtcggatggtttatctgcctatgtcatacttatatgggaagagatttgttggtccaatcacaccgactgtactttctttgagaaaggaggtcttcagtgtcccttatcatgaaatagattggaatcaagctcgtaacctttgtgcgaaggaagatctgtactatccacaccctctcatacaggatatactttgggcatcactggacaaggtctgggaacctattttcatgcattggcctgcgaagaagttgagagagaagtctcttcgcactgtgatggaacacatacattatgaagacgagaatactcgttatatatgtatagggcctgtaaacaaggtgttaaatatgctatgctgttgggttgaagatccgaactccgaggctttcaagttacatctcccaagactccatgattttttgtggcttgctgaggatggtatgaaaatgcaggggtataatggaagtcaattgtgggacactgcttttgccgttcaagcaattatttcgacaaaccttgctgaagaatacggtccaactcttagaaaagcacatacgttcatgaaaaactcgcaggtgctagatgattgccccggggatcttgatgcctggtatcgccatgtttcaaaaggtgcatggccgttctcaactgcagatcacggatggcccatttcagactgtactgccgaaggattcaaggctgtgcttcaattatcaaaattgccatcagaacttgttggtgaaccattagatgccaagcggctgtatgatgctgtcaacgttattctttctttacagaatagtgatggtggctatgcaacatatgaactaacgagatcctatagctggttggagttagtcaaccctgctgagacgttcggtgacattgttattgactacccttatgtagaatgtacatcagctgcaattcaagctttgacagctttcaagaaattatttcctgggcatcgtcgagaagaaatacagcattctattgaaaaagctgctctgttcattgaaaagatacaatcatcagatggctcatggtacggctcttggggagtctgcttcacctatggcacatggtttggtataaaaggtttagtaactgctgggaggaccttctctagttgcgctagcattcgcaaggcttgtgattttctattgtccaaacaagttgcttctggtggttggggagagagttacctttcctgtcaaaacaaggtgtacacaaatcttgagggtaaccgttctcatgttgtcaatactggatgggctatgctggctctcatcgatgctggacaggccgagagagacgcaacaccattgcaccgtgcagccaaattattaattaattctcaaatggaaaatggtgatttcccacaggaggagatcatgggggtcttcgacaagaattgcatgatcacttatgctgcatacagaaacattttccctatttgggctttgggagaatatcgatgtcgagtactccaggggccatcatgaaaatttattttatccaccctttattatgtttttctatattaatgtgttatgctattttgtttcatctttgacaacccaagtagatgagtaggaaaaaagtgattagctcaatggatgaatcttcctttgattattatctttgagtattatgattagttattttgttacaaaaaaaaaaaaaatcgatcgactcgagtc

SEQ ID NO: 98574 - protein, 758 aa, Panax ginseng
MWKLKIAEGGNPWLRTLNDHVGRQIWEFDPNIGSPEELAEVEKVRENFRNHRFEKKHSADLLMRIQFANENPGSVVLPQVKVNDGEDISEDKVTVTLKRAMSFYSTLQAHDGHWPGDYGGPMFLMPGLVITLSITGVLNVVLSKEHKREICRYLYNHQNRDGGWGLHIEGPSTMFGTVLNYVTLRLLGEGANDGQGAMEKGRQWILDHGSATAITSWGKMWLSVLGVFEWSGNNPLPPETWLLPYILPIHPGRMWCHRRMVYLPMSYLYGKRFVGPITPTVLSLRKEVFSVPYHEIDWNQARNLCAKEDLYYPHPLIQDILWASLDKVWEPIFMHWPAKKLREKSLRTVMEHIHYEDENTRYICIGPVNKVLNMLCCWVEDPNSEAFKLHLPRLHDFLWLAEDGMKMQGYNGSQLWDTAFAVQAIISTNLAEEYGPTLRKAHTFMKNSQVLDDCPGDLDAWYRHVSKGAWPFSTADHGWPISDCTAEGFKAVLQLSKLPSELVGEPLDAKRLYDAVNVILSLQNSDGGYATYELTRSYSWLELVNPAETFGDIVIDYPYVECTSAAIQALTAFKKLFPGHRREEIQHSIEKAALFIEKIQSSDGSWYGSWGVCFTYGTWFGIKGLVTAGRTFSSCASIRKACDFLLSKQVASGGWGESYLSCQNKVYTNLEGNRSHVVNTGWAMLALIDAGQAERDATPLHRAAKLLINSQMENGDFPQEEIMGVFDKNCMITYAAYRNIFPIWALGEYRCRVLQGPS

SEQ ID NO: 98575 - DNA, 2589 bp, Panax ginseng
  CDS (111)..(2402)
aaaagatgacatttataacaatctagtggtgtatttacataactgtataaagtcaccggcagaggcagttcagcggcggcaggcggtggtggtggaaataataaaaaatcatgtggaagcttaagatagcggaagggaataagaatgacccgtatttgtacagtaccaataattttgtagggcggcaaacgtgggagttcgacccggattatgtggctagtcccggagagctagaggaggtggagcaagttcgacgtcagttttgggataaccggtatcaggtcaagcctagtggtgatctcctctggcgtatgcagttcctaagagagaagaatttcagacaaacaatcccccaagtgaaggtaggagatgacgaggcagttacttatgaggccgctaccaccacactccgaagggccgtccactttttttcagctttgcaggccagcgacggtcattggcctgcagagaattccggacctctctttttccttccgcccttggtgatgtgtgtatacattacagggcatcttgatacagtgtttcctgcagaacatcgaaaagaaattcttcgctacatatactgtcatcagaatgaagatggcgggtggggactccatattgaggggcatagcaccatgttctgcacaactcttagctacatttgtatgcgtatacttggagaagggcccgatggtggtgtaaacaatgcatgtgccagaggccgaaaatggatccttgaccatggcagtgtaaccgctataccttcatggggcaagacttggctttcgatacttggtgtatatgaatggataggaagcaacccaatgcccccagaattctggattctcccttctttccttcctatgcacccagctaaaatgtggtgttattgccggatggtttacatgccaatgtcatatttatatgggaagaggtttgttggtccaatcactcctcttatcttacaattaagagaagaactttatggtcaaccctacaatgaaatcaattggagaaaaacacgtcgtgtgtgtgccaaggaggacatctactatcctcatcctttaatacaagacctgctctgggatagtctctatgtattaactgaaccacttttaactcgttggccatttaacaagttgagagagaaagctctgcagacaaccatgaaacacattcactatgaagatgagaacagtcgatatattaccattggatgtgtggaaaaggttttgtgtatgcttgtttgttgggttgaggatccaaatggagattatttcaggaaacaccttgcaaggatcccagattatatatgggttgctgaagatggaatgaagatgcagagttttggtagtcaggaatgggatacaggtttcagcattcaagcattgttggatagtgatctaactcatgaaattggacctactctaatgaaaggacacgacttcatcaaaaagtcccaggtcaaggataatccttctggtgactttaaaagcatgtatcgtcacatttcgaaaggatcgtggactttttcagatcaagatcacggatggcaagtttctgattgcactgcagaaggactaaagtgttgccttattttctcaacgatgccagaggaaatagttggcaagaaaataaaaccagaaagactgtatgattctgttaatgtgttgctttctctacagagaaaaaatggtggcttatcagcatgggagcctgcaggagctcaggaatggttggagttgctcaatcctacagaattctttgcagacattgtcatcgagcacgagtatgtagagtgcacttcatcggcaatccaagctctggttctgtttaaaaagttatatcctggacaccgaaagaaggagatagataattttattacgaatgctgtccgttaccttgaagacacacaaatgcctgatggttcatggtatggaaactggggtgtgtgctttacttatggtagctggtttgctcttggggggctagcggcagctggaaagacatactacaattgtgcagctgttcgtaaagctgttgaatttcttctcaaatcacagatggatgatggcggttggggagaaagctacctttcttgtccgaaaaaggtatatgtaccattagaaggaaaccgctcaaatttggtacatacaggatgggccttgatgggactcattcattctgagcaggctgagagagacccaacacctcttcaccgtgcagccaagttattgatcaattctcagatggaagatggtgattttccccaacaggaaataagtggagtttttatgaagaattgcatgttgcactatgcagcttaccggaatatatacccattgtgggctctagcagagtatcggaggcgggtcccattaccgtccctaggcacctaattagagctatatccaactctaggtgattcagtgctaaataaataatttcaataaaaataaaagtttagttggtctgttgcagagccagaggcccctaaccctaaatgatatcaattcatcgaatcttgtttacagtatatagctaaattataatcacacggtactgttgggtgtgactattgttgcc

SEQ ID NO: 98576 - protein, 763 aa, Panax ginseng
MWKLKIAEGNKNDPYLYSTNNFVGRQTWEFDPDYVASPGELEEVEQVRRQFWDNRYQVKPSGDLLWRMQFLREKNFRQTIPQVKVGDDEAVTYEAATTTLRRAVHFFSALQASDGHWPAENSGPLFFLPPLVMCVYITGHLDTVFPAEHRKEILRYIYCHQNEDGGWGLHIEGHSTMFCTTLSYICMRILGEGPDGGVNNACARGRKWILDHGSVTAIPSWGKTWLSILGVYEWIGSNPMPPEFWILPSFLPMHPAKMWCYCRMVYMPMSYLYGKRFVGPITPLILQLREELYGQPYNEINWRKTRRVCAKEDIYYPHPLIQDLLWDSLYVLTEPLLTRWPFNKLREKALQTTMKHIHYEDENSRYITIGCVEKVLCMLVCWVEDPNGDYFRKHLARIPDYIWVAEDGMKMQSFGSQEWDTGFSIQALLDSDLTHEIGPTLMKGHDFIKKSQVKDNPSGDFKSMYRHISKGSWTFSDQDHGWQVSDCTAEGLKCCLIFSTMPEEIVGKKIKPERLYDSVNVLLSLQRKNGGLSAWEPAGAQEWLELLNPTEFFADIVIEHEYVECTSSAIQALVLFKKLYPGHRKKEIDNFITNAVRYLEDTQMPDGSWYGNWGVCFTYGSWFALGGLAAAGKTYYNCAAVRKAVEFLLKSQMDDGGWGESYLSCPKKVYVPLEGNRSNLVHTGWALMGLIHSEQAERDPTPLHRAAKLLINSQMEDGDFPQQEISGVFMKNCMLHYAAYRNIYPLWALAEYRRRVPLPSLGT

SEQ ID NO: 98577 - DNA, 2684 bp, Panax ginseng
  CDS (131)..(2473)
attagctagctgaagaagaattacacataccaagacattctaccagtgcttgtgcttcaacctcagctttccattcatatatataattaattaaggttgatcaaaggtaggtaggtagaagaggggtagcatgtggaagcttatattatctcaaggggatccagggttgaaaagtgtgaataatcatattggcagacagttttgggagtttgatccaaatcttggtacacccgaagaacgagctcacattgacaaacttcgccaacagtttcataacaatcgatttcgagttaaacatagttctgatcttctaatgagatatcaatttgaaagagagaaatccaggaagttaggtgatgatgatgaggtgaaatcaggaagtgaaggagaaataactactagtagtagtggtgtggaaggagtgaaaatggcacttagaagggccttgaaattctactcaactattcaggctgatgatggccactggcccggtgactatggtggcccattgtttcttcttcctggcttggttattgggttgtatgtcatgggagtgatggatacaattttggccaaggaacatcaaagggagatgtgtcgttatatatacaaccaccagaatgtggacggagggtggggattgcatatagaagggtgcagtactatgctgtgtactgctctcaattacatcacactcagattattgatacgaggagatgaggaggaggaaattagagatgaagctgctaatggaggcagcctggagaaagctagaagatggattattgatcatggcggagctacctacattccctcctggggaaaattctggctctcgatactgggagtatatgagtggagcggcaacaaccctctaccaccagagatgtggcttcttccttattttcttccacttcacccaggacgtatgtggaaccattgtcggatggtgtacctgcccatgtcatacctatacgggaggaggtttgtgggaccaatcaattccactgttctatcactaagaagagagctctatacacacccctatcatcaaattaactgggatttggctagaaatcaatgtgctcaggaagatctgtactatccacatccattaatacaagacatgctgtggagttgtttgcataaaggtgtagaacgactaatcatgcaatggcccctgtctaagataaggcagagggctctaactactgcaatgcaacatatccattacgaggatgaaaacaccagctatatatgccttggacccgttaataaggtactaaacatggtctgttgttgggtggaggacccaaattcaatggcaaatatattgcacctctccaggataaaagattatctgtgggtggctgaagatggcatgaaaatgaagggatataacggatcacagctgtgggatgttggttttgctgttcaagcaatactctcaactggcctggttgatgaatacggctcaatgcttaaaaaagcgcatgatttcattaaaatctcacaggttagagaggatagtccgggaaatctcagttcatggaatcgtcacatttccaagggcggatggcccttctctacaccagataatggttggcctgtatcagattgcactgcagaaggtttgaaggctgcactcttgctatcaaatatgccttttgacattgttggagaagcaatatcaccagttcacttatatgatgctgttaactggattctatccctacagaattgcaccggaggttttgcatcatatgagctcacaagatcttatgcctggttagagctactcaatccagctgaaacttttggagatatcgttatagattatcagtatgtagaatgcacttcagcagcgattcaaggccttaaatctttcatgagattatatccaggatataggaggaaggaaattgaagcatgtattgcaaaagcaactaactttattgagagcatacaactgcctgatggctcatggtatggctcttggggaatctgctacacctatgggacatggtttggaattaaggggttggtggctgctgggaggactaaccgaaattgctatagcatcagaagagcttgtgatttcttattatccaaacaacttggttctggtggatggggagagagctatctttcatgccaaaataaggtatatacgagtattgaaggaaacatttcgcatgtagcaaatactggatgggctatgctagccctaatagaagctgggcaggctcagagagatccctccccactccatcgtgctgcaaaggtgttgatgaattcccaaatgaaaaatggcgtctttccacaacaggaaattgtaggagtgttcaacaagaactgcatgataagttattctgcctacagaaacatatttcctatttgggctcttggagaatatctcaatcgcgtattacaaccttcccggaacatcttgaaaaccttaaatgtagtataaattaatatctatgccagtgccattgccattgccattgccattgcctccagttataaaacgaaataaatgcatacattctttatgataatatgagtagggtatgctgctatgtaaatagggtcatggaagatttccaatatacatatgtaattgtatcatgttgcactcatgaaaattgaagacttattcaatcagatcattgcttgacatc

SEQ ID NO: 98578 - protein, 780 aa, Panax ginseng
MWKLILSQGDPGLKSVNNHIGRQFWEFDPNLGTPEERAHIDKLRQQFHNNRFRVKHSSDLLMRYQFEREKSRKLGDDDEVKSGSEGEITTSSSGVEGVKMALRRALKFYSTIQADDGHWPGDYGGPLFLLPGLVIGLYVMGVMDTILAKEHQREMCRYIYNHQNVDGGWGLHIEGCSTMLCTALNYITLRLLIRGDEEEEIRDEAANGGSLEKARRWIIDHGGATYIPSWGKFWLSILGVYEWSGNNPLPPEMWLLPYFLPLHPGRMWNHCRMVYLPMSYLYGRRFVGPINSTVLSLRRELYTHPYHQINWDLARNQCAQEDLYYPHPLIQDMLWSCLHKGVERLIMQWPLSKIRQRALTTAMQHIHYEDENTSYICLGPVNKVLNMVCCWVEDPNSMANILHLSRIKDYLWVAEDGMKMKGYNGSQLWDVGFAVQAILSTGLVDEYGSMLKKAHDFIKISQVREDSPGNLSSWNRHISKGGWPFSTPDNGWPVSDCTAEGLKAALLLSNMPFDIVGEAISPVHLYDAVNWILSLQNCTGGFASYELTRSYAWLELLNPAETFGDIVIDYQYVECTSAAIQGLKSFMRLYPGYRRKEIEACIAKATNFIESIQLPDGSWYGSWGICYTYGTWFGIKGLVAAGRTNRNCYSIRRACDFLLSKQLGSGGWGESYLSCQNKVYTSIEGNISHVANTGWAMLALIEAGQAQRDPSPLHRAAKVLMNSQMKNGVFPQQEIVGVFNKNCMISYSAYRNIFPIWALGEYLNRVLQPSRNILKTLNVV

SEQ ID NO: 98579 - DNA, 2729 bp, Panax ginseng
  CDS (73)..(2358)
attaccagtaacagaagaactacaattttttgtacctcaaaaaaaaaaaaaaattcaaatttttgtttgaagatgtggaggctaatgacagccaagggaggcaacgatccgtatttgtacagtacaaataacttcatagggcggcagacatgggagtttgatcctgactatggaaccccggcggagagggctgaggttgaggaggctcgtctccatttctggaataaccggtatcaggttaagcccagcagcgatgtcctctggcgaatgcagtttctaaaagagaagaatttcaaacaaattattccccaagtgaaggtggaggatggtgaagaaattacctatgaagcagccacaaccacattgagaagagctgtccactacttttccgcattgcaggctgatgatgggcactggcctgccgaaaatgctggcccgttatttttccttccacccttggtcatgtgtctgtatattacagggcatcttaatactgtattccctgcagagcatcgcatagaaattctacgctacatttactgtcatcagaacgatgatggtggctggggattacatatcgagggccacagcaccatgttttgtacagctcttagctacatctgcatgcgtatacttggagaaggacgcgatggtggtgaaaacaatgcctgtgccagagcaagaaaatggatccttgatcatggtagtgtgacagcaataccctcctggggcaagacatggctttcgattcttggcttattcgattggtcaggaagcaacccaatgcccccagagttttggatccttcctcctttccttcctatgcatccagcaaaaatgtggtgctattgccggatggtttacatgcctatgtcatatttgtatgggaagaggtttgtggggccgatcactcctctcattttacaactgagagaagaactttacgcccaagcctatgatgaaattaactggaggaaagtgcgacataactgtgcaaaggaagacctctactatccccatcctttgatacaagatttgatgtgggatagcctctacatatttacggagcctttcttgactcgttggccttttaacaagttgagagagaaagctcttcaaaccactatgaaacatatccattatgaagatgagaacagtagatacatcactataggatgtgtggaaaaggttttgtgtatgcttgcttgttgggttgaggatccaaatggtgattacttcaagcagcacctcgctaggatcccagattatatatgggttgctgaagatggaatgaaaatgcagagttttggcagtcaagagtgggatactggttttgccatacaagcattgttggcgagtgatctcattgatgaaattcgtcctacccttatgaaagggcatgacttcataaaaaagtcccaggtcaaggagaacccttctggcgacttcaaaagcatgcatcgccacatttctaaaggatcctggaccttttcagatcaagatcatggatggcaagtttcggattgtactgcagaagctttgaagtgttgcctactcttttcaaggatgccaacagaaattgttggtgataaaatggaagacaaccaattgtttgatgctgtcaatatgctgctatccctacagagcaaaaatggcggcctagctgcatgggagcctgcaggatcatcagaatggttggagctgctcaatcctacagaattctttgaagacattgtcattgaacatgagtatgtcgaatgcacttcatcagcaattcaggctatggttatgtttaagaagttataccctgggcataggaagaaagagattgaagtttcaatcacaaatgctgtacagtaccttgaagacatacaaatgcctgatggttcatggtacggaaactggggtgtgtgcttcacatatggtacttggtttgctatgggaggtctaaccgcggctggaaagacatacaacaactgccaaactcttcataaagcagtggattttctaataaaatcgcaacgcagtgatggtggttggggagaaagctatctttcttgcccaaacaaggaatatacacctttagaaggaaataggtcaaatttggttcacacttcatgggccatgatgggtctgattcattctaggcaggctgaaagagacccaacacctcttcatcgtgcagccaagttgttgatcaattcccaaatggaaagtggtgattttccccaacaggaaatcactggagttttcatgaagaactgcatgttacactatgcagcgtctagaaacatatatccgttgtgggctttagcagaatatcgaaaaaatgttcgattaccatctaaaagcgtctgaacacttactacagtggtgaaagtgcagcactcatggtttgacggcctgccaatactcaaatgaaatgggaaaagaatagaaaataaaaataattacccataaacctttatttcttgtccttaccacgatcaagttctatacttgacaaaggtttctgcaaaaaacagagggagatgctcgtgagaagttaagaacaagtcaagtttgtgtccgttatttttaacatatcattttccattttttttacaatagttgtaaatcataaattcagttgctgccaacttctttctacattatatgtatcagttgttcataagataatgtaaaaatttatggaggaataaattatatgtagggcacttatttactct

SEQ ID NO: 98580 - protein, 761 aa, Panax ginseng
MWRLMTAKGGNDPYLYSTNNFIGRQTWEFDPDYGTPAERAEVEEARLHFWNNRYQVKPSSDVLWRMQFLKEKNFKQIIPQVKVEDGEEITYEAATTTLRRAVHYFSALQADDGHWPAENAGPLFFLPPLVMCLYITGHLNTVFPAEHRIEILRYIYCHQNDDGGWGLHIEGHSTMFCTALSYICMRILGEGRDGGENNACARARKWILDHGSVTAIPSWGKTWLSILGLFDWSGSNPMPPEFWILPPFLPMHPAKMWCYCRMVYMPMSYLYGKRFVGPITPLILQLREELYAQAYDEINWRKVRHNCAKEDLYYPHPLIQDLMWDSLYIFTEPFLTRWPFNKLREKALQTTMKHIHYEDENSRYITIGCVEKVLCMLACWVEDPNGDYFKQHLARIPDYIWVAEDGMKMQSFGSQEWDTGFAIQALLASDLIDEIRPTLMKGHDFIKKSQVKENPSGDFKSMHRHISKGSWTFSDQDHGWQVSDCTAEALKCCLLFSRMPTEIVGDKMEDNQLFDAVNMLLSLQSKNGGLAAWEPAGSSEWLELLNPTEFFEDIVIEHEYVECTSSAIQAMVMFKKLYPGHRKKEIEVSITNAVQYLEDIQMPDGSWYGNWGVCFTYGTWFAMGGLTAAGKTYNNCQTLHKAVDFLIKSQRSDGGWGESYLSCPNKEYTPLEGNRSNLVHTSWAMMGLIHSRQAERDPTPLHRAAKLLINSQMESGDFPQQEITGVFMKNCMLHYAASRNIYPLWALAEYRKNVRLPSKSV

SEQ ID NO: 98581 - DNA, 2851 bp, Rattus norvegicus
  CDS (42)..(2243)
ggtaaagggctggccggccggtggtccagagctgtgctgtcatgaccgagggcacgtgtctgcggcgtcgtgggggaccctataaaactgagcccgccaccgatctcacccgctggcggctccataatgagttgggtcggcagagatggacttattatcaagcggaggaggaccctggtcgagaacagacggggctagaggcccactctttgggactggacacaacaagttatttcaagaacttacctaaagctcaaacagcccatgagggggccctgaacggagtaaccttttatgccaagctgcaggctgaggatggacactgggctggtgattatggtggtccactcttcctcttgccaggtctcctgattacgtgtcacatagcacacatccccctgccggctggatacagagaggaaatggtacggtacttgcgctcagtgcagcttcccaatggcggctggggcttgcacattgaggacaagtccacggtgtttgggactgccctgagctatgtgtctctcagaatcctgggtattggacctgatgatcctgaccttgtgcgtgctcggaacattcttcacaaaaaaggtggtgcagtggccatcccttcctgggggaagttctggctggctgtcctgaatgtttacagctgggaaggaatcaataccctcttccctgagatgtggctgcttcctgaatggtttcctgcacatccctccactctgtggtgtcactgccggcaggtctatctgcccatgagctactgctacgccactcggctaagtgcctcagaggacccactggttcagagcctccgccaggaactctatgtggaggattatgccagcatcgattggccagcacagaagaacaacgtgtgccccgatgacatgtacacgccacacagctggctgctgcacgtggtatatggactcctcaacctgtatgaacgtttccacagtaccagcctgcggaagtgggccatccagttgctgtatgaacatgtcgcagctgatgatcggttcacgaaatgcatcagcattggcccgatctcaaaaactgtcaacatgcttattcgttggtcagtggacggaccatcctcccctgccttccaggagcacgtctcgaggatcaaagattatctttggctgggccttgacggcatgaaaatgcagggcaccaatggatcacagacctgggacacttcatttgctgtccaagccctgctggaggcaggtgcacaccgaagacctgagtttttgccctgcctgcagaaggctcacgagttcctgcggctttcccaggtcccagacaacaatcctgactaccagaagtattatcgccatatgcacaagggtggtttccccttcagcacactggactgtggctggatcgttgctgactgcacggccgaggctttgaaggctgtgctgctcctgcaggagcggtgtccctcaatcaccgagcatgtcccccgagagcgactctacgatgctgtggctgtgttgttgagcatgaggaattccgatggagggtttgctacctatgagactaagcgtggcgggtatttgctggagctgctgaacccctcagaggtctttggagacatcatgattgactacacgtatgtagagtgtacctccgcagtgatgcaggccctgaggcacttccgcgagtacttcccagaccacagggctacagagatcagggagaccctcaatcaaggcctggacttctgccgaaagaagcagagagcggatggctcgtgggagggctcctggggggtttgcttcacctatggcacctggtttggcttggaagcattcgcttgcatgggacatatctaccaaaataggactgcttgtgcagaagtagctcaggcctgccacttcctcctgtcgcggcagatggcggatgggggctggggggaggactttgagtcctgtgagcagcggcggtacgtgcagagtgccgggtcccaggtccatagtacgtgctgggccctgctgggtttgatggctgtcaggcatcccgacatctctgctcaggagagaggaatcagatgtctgctagggaaacagctccccaacggagactggcctcaggagaacatctctggggtcttcaacaagtcctgtgccatcagctacacaaattacagaaacatcttccccatctgggccctgggccgcttctccagcctgtatcctgacaatacccttgctggccacatttgagcatgtgtgcgcctgtgcggcacctggccagcgtcagcactgtacaggcccaggcagcccggtttctcagctgggtgataagcgtcctcctagcccactttggcatggttctctatttctgtagacatgaggctggggatagggtcagagtcggtgtctagacactgggcagcatgcgctcggttctgacgctagcttcagtgaggaagggaagaagttgagcttgagatccagagaggcacagtgtactccgaggctcctgggtgtcctccttgagggaacaagactgtagagctttcatgatcagtgacttccctgtgagggagcagctggcttcttcacttcctcccttgttgactgtggagtgggccccgtggtgcaggcatgctcagagaaaggctcaatggaggaggcaggccccttgctcattgtgtcctgagcagtgtctgttgtcccaggcacttacccatgactgcatcactgcacgaaataccagttttccagaaaggaagtacaaactcgctctgtactaaaaatgctactaaaagtcgtttgaatgatcaccaactcccttaataaacagacccctgatggcccagtagtaaaca

SEQ ID NO: 98582 - protein, 733 aa, Rattus norvegicus
MTEGTCLRRRGGPYKTEPATDLTRWRLHNELGRQRWTYYQAEEDPGREQTGLEAHSLGLDTTSYFKNLPKAQTAHEGALNGVTFYAKLQAEDGHWAGDYGGPLFLLPGLLITCHIAHIPLPAGYREEMVRYLRSVQLPNGGWGLHIEDKSTVFGTALSYVSLRILGIGPDDPDLVRARNILHKKGGAVAIPSWGKFWLAVLNVYSWEGINTLFPEMWLLPEWFPAHPSTLWCHCRQVYLPMSYCYATRLSASEDPLVQSLRQELYVEDYASIDWPAQKNNVCPDDMYTPHSWLLHVVYGLLNLYERFHSTSLRKWAIQLLYEHVAADDRFTKCISIGPISKTVNMLIRWSVDGPSSPAFQEHVSRIKDYLWLGLDGMKMQGTNGSQTWDTSFAVQALLEAGAHRRPEFLPCLQKAHEFLRLSQVPDNNPDYQKYYRHMHKGGFPFSTLDCGWIVADCTAEALKAVLLLQERCPSITEHVPRERLYDAVAVLLSMRNSDGGFATYETKRGGYLLELLNPSEVFGDIMIDYTYVECTSAVMQALRHFREYFPDHRATEIRETLNQGLDFCRKKQRADGSWEGSWGVCFTYGTWFGLEAFACMGHIYQNRTACAEVAQACHFLLSRQMADGGWGEDFESCEQRRYVQSAGSQVHSTCWALLGLMAVRHPDISAQERGIRCLLGKQLPNGDWPQENISGVFNKSCAISYTNYRNIFPIWALGRFSSLYPDNTLAGHI

SEQ ID NO: 98583 - DNA, 2409 bp, Cucurbita pepo
  CDS (26)..(2305)
aaaaccctccttgctacacacccacatgtggaccctcaaattctccaaaggctgggagaccagcgacaacgctcatttagggcgccagttttgggagttcgacccaaatctccagccctctcttgaagaacaagctcgagttcataatgtctgcaatgatttctatacccaccgctttcaagccaagcacagctctgatctcttaatgagacttcagttgaagaaggcgaatgggagtgaggtgaagctgccaactcaagtgaagcttagaagtgaagaggaaatgagtgaagaagcagtggaaaccacgttgagaagggctatcagattctactcaactatgcagacacaagatggcttctggcctggtgactatgctggccctttgtttcttcttcctggcctggtgattgggttaagcgtaacgaaggctctagataccgtcttgtcgcgccaccatcaacaagagatgcgtcgctacctttacaatcaccaaaatgaagatggagggtggggattgcatatagaagggaacagcacaatgctctgtacagctctatcctacgtgagcttgagattattgggagaggaaatggacggttgcgatggagccttgcgtcaagcaagaagatggattcttgatcgaggtggggccacctcaatcccctcttggggaaaactctggctttccgtccttggagtatacgagtgggaaggaaacaatccacttccaccagagatatggctcttgccttattttcttccattacatccaggacgaatgtggtgtcatagtcgaatggtatatttaccaatgtcatacttgtatggaaagagatttgtgggtccaattagccccataatcacgagcctcaggcaagagctttacacgagtccttatcacatgattgattggaatctttctcgaagcctctgtgctaaggaagatttgtacacgccacattcgaagatacaagacatgttatgggattcaattcacaagcttggtgaaccattattgaagaaatggccactctcaaagctaaggcaaaaggctcttgactttgtgataaaacacatccactatgaagatgaaaacactcactatctttgccttggacctgttagcaaggtggtaaacatggtgtgttgttgggatgaggatccaaactcagaagcctttacaagacacatttcaagaatcaaagactacctctggctagctgaggacggaatgaaaatgcagggatatcacgggtctcaattatgggacgtagcatttgccattcaagccatagttgcaacggatctagtcgaggaatacggttcggtgcttaagaaagcgcacgatttcgtcaaaaactcacaagtgaggagaaatgggtttggagatgatgatccaagtgattggtaccgccacaactcaaagggtggctggcccttctcaactccggacaatgcttggcctgtctctgactgcacttctgaagctttaaaggtagccattatgatgtcacaaatgccaccaacaatggtgggtgagccaatggatattcgtaaattatacgatgcggttgatctgatcctttcacttcagaattccaatggaggatttgcttcatatgaactcacaagatcccatccatggttggagacgttgaatccagctgaaatattcggagatgtgatgatcgactatcaatatgtggagtgcagttcagcagccatagaaaggctcaaagcattcatgaagctccatccaagctaccgcaagaaagagattcaagcttgcatggccaaagcagcagatttcatagaaaccattcagcagcctgatggatcctggtatggctcatgggggatttgctatacatatgggacatggtttggcatcaaagggttagttgcttgtggaagaacctatgagaatagtaaaaccctaaggaaggctactcatttccttctttctaaacaactcaaatccggcggttggggcgagagctacctctccgctcataacaaggtatacactgatctcaaaaatggcaaatcacacatagtcaacacttcttgggccctattggctctcattaaagccggccaggctcaaagagacccatctccgctgcatcaagcagcaacggttctgattaattcgcaactcgacaatggagatttccctcaacaggaaattattggagtattcaacaagagttgtacgatcagttactcggcctatagaaacatatttcctatatgggctcttggagagtatcagttaaaggttctgaaacgtcaagaatagccatacctaaatatttctattgcaagtgtttttattataatataaagaaataaaaattgtaaatattttataagcacaaacattaatataaaaaaaaaaaaaaa

SEQ ID NO: 98584 - protein, 759 aa, Cucurbita pepo
MWTLKFSKGWETSDNAHLGRQFWEFDPNLQPSLEEQARVHNVCNDFYTHRFQAKHSSDLLMRLQLKKANGSEVKLPTQVKLRSEEEMSEEAVETTLRRAIRFYSTMQTQDGFWPGDYAGPLFLLPGLVIGLSVTKALDTVLSRHHQQEMRRYLYNHQNEDGGWGLHIEGNSTMLCTALSYVSLRLLGEEMDGCDGALRQARRWILDRGGATSIPSWGKLWLSVLGVYEWEGNNPLPPEIWLLPYFLPLHPGRMWCHSRMVYLPMSYLYGKRFVGPISPIITSLRQELYTSPYHMIDWNLSRSLCAKEDLYTPHSKIQDMLWDSIHKLGEPLLKKWPLSKLRQKALDFVIKHIHYEDENTHYLCLGPVSKVVNMVCCWDEDPNSEAFTRHISRIKDYLWLAEDGMKMQGYHGSQLWDVAFAIQAIVATDLVEEYGSVLKKAHDFVKNSQVRRNGFGDDDPSDWYRHNSKGGWPFSTPDNAWPVSDCTSEALKVAIMMSQMPPTMVGEPMDIRKLYDAVDLILSLQNSNGGFASYELTRSHPWLETLNPAEIFGDVMIDYQYVECSSAAIERLKAFMKLHPSYRKKEIQACMAKAADFIETIQQPDGSWYGSWGICYTYGTWFGIKGLVACGRTYENSKTLRKATHFLLSKQLKSGGWGESYLSAHNKVYTDLKNGKSHIVNTSWALLALIKAGQAQRDPSPLHQAATVLINSQLDNGDFPQQEIIGVFNKSCTISYSAYRNIFPIWALGEYQLKVLKRQE

SEQ ID NO: 98585 - DNA, 2444 bp, Cucurbita pepo
  CDS (21)..(2315)
gaggaagaaaattagataatatgtggaggctgaaggtgggagcagagagcgttggggaggaggatgagaaatgggtgaagagcgtaagcaatcacttgggccgccaagtttgggagttctgtgccgacgccgccgccgacactcctcaccagttactacaaattcagaatgctcgcaaccacttccatcacaatcgtttccaccggaagcagtcttccgatctctttctggctattcaatatgaaaaggaaatagcaaagggcgcaaaaggtggagcggtgaaagtgaaagaaggggaggaggtggggaaagaggcggtgaagagtacgttagaaagggcactcggtttctactcggccgtgcagacaagagatgggaattgggcctcggatcttggagggcccttgtttttacttccgggtctcgtgattgcccttcatgtcacaggcgtcttgaattcagttttgtccaagcaccaccgcgtagagatgtgcagatatctttacaatcaccagaatgaagatggagggtggggtctacatattgagggcacaagcaccatgtttggttcggcactgaattacgttgcactaaggctgcttggagaagacgccgatggcggagacggtggcgcaatgacaaaagcacgtgcttggatcttggagcgcggcggcgccactgcgatcacttcgtggggaaaattgtggctgtccgtacttggagtgtacgaatggagtggcaacaaccctcttccgcctgagttttggcttctcccttacagcctaccatttcatccaggaagaatgtggtgccattgtcgaatggtttatcttccaatgtcttacttatatgggaagagatttgttgggccaatcactcccaaagttctttctctaaggcaagagctctacacaattccttatcatgaaatagactggaataaatcccgcaatacatgtgcaaaggaggatctgtactatccacatcccaagatgcaagacattctatggggatccatctaccatgtatatgagccattgttcactcgttggcctgggaaacgcctgagggaaaaggctttacaagctgcaatgaaacatattcactatgaagatgaaaatagtcgatatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggctacaatggcagccagttgtgggacactgctttctccatccaagccatcgtagccaccaaacttgtagacagctatgccccaactttaagaaaagcacatgactttgttaaggattctcagatccaggaggactgtcctggggatcctaatgtttggttccgtcatattcataaaggtgcttggccactttcgacacgagatcatggatggctcatctccgactgtacagctgagggattgaaggcttctttgatgttatccaaacttccatccacaatggttggggagccattagaaaagaatcgcctttgtgatgctgttaatgttctcctttctttgcaaaatgataatggtggatttgcatcatacgagttgacgagatcatacccttggttggagttgatcaacccagctgaaacattcggagacattgtcattgactatccgtatgtggagtgcaccgcagcaacaatggaagcactgacgttatttaagaagctacatccaggccataggaccaaagagattgacacagctattggcaaggcagccaacttccttgagaaaatgcagagggcggatggctcttggtacgggtgttggggggtttgttttacgtatgcgggttggtttggcataaagggattggtggctgcaggaagaacatataatagctgccttgccattcgcaaggcttgtgagtttctgctatctaaagagctgcccggcggtggatggggggagagttacctttcatgtcagaataaggtgtacaccaatcttgaggggaacaagccacacttggttaacactgcctgggttttaatggctctcattgaagctggccagggtgagagagacccagcaccattgcaccgtgcagcaaggttgctaatgaattcccaattggagaatggcgatttcgtgcaacaggagatcatgggagtgttcaataagaactgcatgatcacatatgctgcataccgaaacatcttccccatttgggcgcttggagagtattgccatcgggttcttactgaatgatgtgcactgcttcaacattatgatgtataatataatgtatcacatcctttcttcatcttattatcatcgccatcatctatatataataagcaaaccattgttttgccaacgaaaaaaaaaaaaaaaaaa

SEQ ID NO: 98586 - protein, 764 aa, Cucurbita pepo
MWRLKVGAESVGEEDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTRDGNWASDLGGPLFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPLSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 98587 - DNA, 2556 bp, Cucurbita pepo
  CDS (123)..(2423)
gaaacggcatcgaagttgagggagatacaacactgggagtgagtggcttggtgaagcactgaatggattcttcttcataaatagaattcaacaaccaaaattcttttgcaaaccaaaccagaatgtggcagctcaagattggggcagatacagtgccttccgatccttccaatgccggcggatggctttcaactctcaacaaccacgtcggccgccaagtttggcattttcatcccgaactcggctccccggaggatcttcagcaaatacaacaggctcgtcagcacttctccgatcacagattcgagaagaagcatagtgctgatctcctcatgcgaatgcagtttgcgaaggagaattcgtcctttgtgaatctaccgcaagtcaaagttaaagataaagaagacgtgacagaggaagcagtaacgcgcactctaagaagggctatcaatttttattcaacaatccaggcagatgacggtcattggcctggtgattatggcggcccaatgtttctaattcctggtttggtcattactctttccatwactggcgccttgaatgcggtcttatctacagaacaccagcgtgagatttgcagatatctgtacaatcatcagaataaagatgggggttggggtttacatattgagggcccaagcacaatgttcggatctgtgttgaattatgttactttgagattgcttggtgaagaagctgaagatgggcagggtgctgtggacaaagcacggaaatggatcttggaccatggtggtgcagctgcgattacttcttgggggaaaatgtggctttcagtacttggagtatatgaatgggctggaaataatccacttcctccagagctatggctcttgccttatcttctcccttgtcatccaggaaggatgtggtgtcactgtcgaatggtatacttgcctatgtgttatctgtatggcaagagatttgttggtcctataacgcctataattagatctttaaggaaggaactttatcttgttccttatcatgaagttgattggaataaggctcgaaatcaatgtgcaaaggaagatctatattacccacatccgctggttcaggatattctgtgggctacgctgcaccatgtctatgagcctctttttatgcattggcctgcaaaaagattgagggagaaggctttgcagagtgtaatgcagcatatccactatgaagatgaaaatactcggtatatatgcatagggcctgtcaacaaggtgttaaacatgctttgctgttgggcggaagatccacattcagaggcattcaaattgcatattcctagaatctatgactatctgtggattgctgaagatggcatgaaaatgcagggttataatggaagtcaattatgggatactgcatttgctgttcaagccatcatttcaactgagctcgctgaagaatatgagacaactttaagaaaggcgcacaagtatataaaagactcccaggtcttagaagattgtcctggagatttacaaagttggtaccgtcatatttcaaaaggtgcatggccattttcaactgcggatcacggatggcccatctctgactgcactgctgaaggtttgaaggctgttcttttattgtcaaaacttccttcagaaatagtagggaagtcaattgatgaacaacagctatacaacgcagtaaatgtcatcctgtccttacagaatactgatggtggctttgcaacttatgagttgaccaggtcatatcggtggctggagctaatgaaccctgctgaaacttttggcgatattgtcattgactacccatatgtcgagtgttcctcagcagcgattcaagcacttgcagcattcaagaaattatatccaggtcatagaagggatgaaattgataattgtattgctgaagctgcggacttcattgaaagtatacaagcaactgatggatcttggtatggatcttggggagtctgcttcacctatggtggttggttcgggataagggggctggtcgctgctggaaggagatacaataactgttctagccttcgtaaagcttgtgatttcctgttgtccaaagagcttgctgccggtggctggggagaaagttacctttcctgccagaataaggtgtacacaaatattaaagatgacaggccacatattgtcaatactggttgggctatgttatccctcatcgatgctgggcagtctgagagagatccaacaccattacaccgtgcagcaagggtattaattaattctcagatggaagacggagattttcctcaagaggagatcatgggagtctttaacaagaactgcatgattagctattcagcataccgtaacattttccctatatgggcccttggggaataccgtagccgggtactgaaaccccttaaatagtatgtattgctaccattgtgtcagtcattcataacagcatttacagcttgtttcagattcctatggtttcttcaactcttctaaattcaatcagatgaaccaatgtttctttattaaaaaaaaaaaaaaaaaa

SEQ ID NO: 98588 - protein, 766 aa, Cucurbita pepo
MWQLKIGADTVPSDPSNAGGWLSTLNNHVGRQVWHFHPELGSPEDLQQIQQARQHFSDHRFEKKHSADLLMRMQFAKENSSFVNLPQVKVKDKEDVTEEAVTRTLRRAINFYSTIQADDGHWPGDYGGPMFLIPGLVITLSITGALNAVLSTEHQREICRYLYNHQNKDGGWGLHIEGPSTMFGSVLNYVTLRLLGEEAEDGQGAVDKARKWILDHGGAAAITSWGKMWLSVLGVYEWAGNNPLPPELWLLPYLLPCHPGRMWCHCRMVYLPMCYLYGKRFVGPITPIIRSLRKELYLVPYHEVDWNKARNQCAKEDLYYPHPLVQDILWATLHHVYEPLFMHWPAKRLREKALQSVMQHIHYEDENTRYICIGPVNKVLNMLCCWAEDPHSEAFKLHIPRIYDYLWIAEDGMKMQGYNGSQLWDTAFAVQAIISTELAEEYETTLRKAHKYIKDSQVLEDCPGDLQSWYRHISKGAWPFSTADHGWPISDCTAEGLKAVLLLSKLPSEIVGKSIDEQQLYNAVNVILSLQNTDGGFATYELTRSYRWLELMNPAETFGDIVIDYPYVECSSAAIQALAAFKKLYPGHRRDEIDNCIAEAADFIESIQATDGSWYGSWGVCFTYGGWFGIRGLVAAGRRYNNCSSLRKACDFLLSKELAAGGWGESYLSCQNKVYTNIKDDRPHIVNTGWAMLSLIDAGQSERDPTPLHRAARVLINSQMEDGDFPQEEIMGVFNKNCMISYSAYRNIFPIWALGEYRSRVLKPLK

SEQ ID NO: 98589 - DNA, 2190 bp, Debaryomyces hansenii CBS767
  CDS (1)..(2190)
atgtactattctgaagaattgggagtcgagcaaacagatccccatcgttggagacttgtgactgatgaattgggcagagaaacatggcactacttgagtattgaagaaagtgaaaaaaatccccaatcggactatgttaagtatttactagagctagatgacttcccagcgcctgaggagtcggatattaacacgccatttgagtctgcaaagaaaggagctgattttcttgagttattacaggaaccaagcggaatgttcccgtgtcagtaccgtgggcccatgttcatgagcattgggtacatagctgcaaactatttcaccaagaacgagattcctaagccctataggacggaaatgataagatatcttgtgaatacgtcgcatcctgttgatgggggttggggtttgcattcgatagacaaatctacgtgtttcggaacctccatgaactatgtggcattgagattgcttggattgccggccaatcatcctgtgtgtgtgaaagcccgtaagacgttacatagactcggaggagctttaggtaatcctcattggggtaaagcgtggttatcgatcttgagcctttacgaatgggaaggtgttaatccagcaccaccagaaatgtggctcttaccatacaatgtcccaattcatcctggcagatggtgggttcataccagagctatttatttacctcttggctacgtttcttcatacaaagtgaaatgtgacctagatcctttgttgcaggagattagaaatgagatctatttgccaaaacagttgccctatgagaaaatcgacttccagactcacagaaataatgtttgtggagttgacttgtattacccccataccactgtattagactgtcttaactggggtatggtaaagtacgagaaatacatcaggcccaaatggctccttaaaaagtcgaacgatagggtctacgaactaattaaaaaagaatgtgcaaatactgattatctatgcattgctcccgtgagttttgcttttaatatgatcataaccttccttgaagagggacctaagtcatacgcgtttgaacgattcaaatatagaatgaacgatacgttgtttcatgggcctcaaggtatgactattatgggtactaacggtgtccaagtttgggatgtggcctttatggttcaatatttcttcatggctggattatcagaattcccgaaataccaagaaatgatccgtaagggttacaagtttttggtcagatcacagttcactgaggattgtgtcgatggaagtttccgagataaacgtaaaggtggctggccatttagtactaaaacgcaaggctatactgtgagtgattgttctgctgaagctttaaaggccataattatggtaaagaatcatccggcatttactgatatcaaggacgatatcgaagatgaaaacctttataatgcagttgatgttatattgaatattcaaaatgttaatgattttgaatttggttcgttttcttcttatgagactataagagctacgccactattagagaacttgaatcctgctgaagtttttaataagattatggttgaatatccttatgtggaatgcacggattcgtcggtcttaggtttgacttactttgctagattctatccaaattacaaacctgatcaaattaagtttgcaattgaaaatgcaataaactatataataaaggcccaggctaaggatggttcgtggtatggttcttggggtatatgctatacatacgcctctatgtttgcccttgaagcattaaattccgttggatacagttacgttaattccgatactgtaagaaaagggtgtgacttcttagtatcgaaacaattggctgatggtgggtggtctgaatctatgaaatcgtgtgaaaccggtacgtatgtcaatacagagcaatcattagttgttcaaacttcgtgggccttgataggattaatattagcagactacccaaataaagaagctattgaaagaggtcttgcattattaatgagtagacaaaagcggactggtgaatggaaatttgaagacatgaacggtgttttcaatcatagttgtgctattgaatatgattcatataaatttttattccctatcaaagcattgggattatataaaagtaaatatggtgacacacatttgaatatttag

SEQ ID NO: 98590 - protein, 729 aa, Debaryomyces hansenii CBS767
MYYSEELGVEQTDPHRWRLVTDELGRETWHYLSIEESEKNPQSDYVKYLLELDDFPAPEESDINTPFESAKKGADFLELLQEPSGMFPCQYRGPMFMSIGYIAANYFTKNEIPKPYRTEMIRYLVNTSHPVDGGWGLHSIDKSTCFGTSMNYVALRLLGLPANHPVCVKARKTLHRLGGALGNPHWGKAWLSILSLYEWEGVNPAPPEMWLLPYNVPIHPGRWWVHTRAIYLPLGYVSSYKVKCDLDPLLQEIRNEIYLPKQLPYEKIDFQTHRNNVCGVDLYYPHTTVLDCLNWGMVKYEKYIRPKWLLKKSNDRVYELIKKECANTDYLCIAPVSFAFNMIITFLEEGPKSYAFERFKYRMNDTLFHGPQGMTIMGTNGVQVWDVAFMVQYFFMAGLSEFPKYQEMIRKGYKFLVRSQFTEDCVDGSFRDKRKGGWPFSTKTQGYTVSDCSAEALKAIIMVKNHPAFTDIKDDIEDENLYNAVDVILNIQNVNDFEFGSFSSYETIRATPLLENLNPAEVFNKIMVEYPYVECTDSSVLGLTYFARFYPNYKPDQIKFAIENAINYIIKAQAKDGSWYGSWGICYTYASMFALEALNSVGYSYVNSDTVRKGCDFLVSKQLADGGWSESMKSCETGTYVNTEQSLVVQTSWALIGLILADYPNKEAIERGLALLMSRQKRTGEWKFEDMNGVFNHSCAIEYDSYKFLFPIKALGLYKSKYGDTHLNI

SEQ ID NO: 98591 - DNA, 2229 bp, Yarrowia lipolytica CLIB99
  CDS (1)..(2229)
atgggaatccacgaaagtgtgtcgaaacagtttgcgaaaaacggacattccaagtaccgcagcgaccgatacggcttacctaagacggatctgcgacgatggacgttccacgcgtccgatctgggggcgcaatggtggaagtatgacgataccacaccgctggaagagctggaaaagagggctaccgactacgtcaaatactcgctggagctgccgggatacgcgcccgtgactctggactccaagcccgtgaaaaatgcctacgaagcggctctcaaaaactggcatctgtttgcgtcgctgcaagaccccgactccggcgcgtggcagagcgaatacgacggaccgcagttcatgagcatcggctatgtgacggcgtgctactttggcggcaacgagatccccacgccggtcaaaaccgaaatgatcagatacattgtcaacacagcccacccagttgacggaggctggggccttcacaaagaagacaagagcacctgcttcggtaccagcatcaactacgtggtcctgcgactactgggcctgtcacgggaccatccggtctgcgtcaaggcgcgcaaaacgctgctcaccaagtttggcggcgccatcaacaacccccattggggcaagacctggctgtcgattctcaatctctacaaatgggagggtgtgaatccggcccctggcgagctctggctgttgccctactttgttcctgttcatccgggccgatggtgggtccatacccggtggatctaccttgccatgggctatctggaggctgcggaggcccaatgcgaactcactccgttgctggaggagctccgagacgaaatctacaaaaagccctactcggagattgatttctccaaacattgcaactccatctccggagtcgacctctactatccccacaccggccttttgaagtttggcaacgcgcttctccgacgataccgcaagttcagaccgcagtggatcaaagaaaaggtcaaggaggaaatttacaacttgtgccttcgagaggtttccaacacacgacacttgtgtctcgctcccgtcaacaatgccatgacctccattgtcatgtatctccatgaggggcccgattcggcgaattacaaaaagattgcggcccgatggcccgaatttctgtctctgaatccgtcgggaatgtttatgaacggcaccaacggtctccaggtctgggatactgcgtttgccgtgcaatacgcgtgtgtttgtggctttgccgaacttccccagtaccagaagacgatccgagcggcgtttgattttctcgatcggtcccagatcaacgagccgacggaggaaaattcctatcgagacgaccgcgtcggaggatggccctttagtaccaagacccaggggtatccggtctccgactgtactgccgaggctctcaaggccatcatcatggtccagaatacgcctggatacgaggatctgaagaaacaagtgtctgacaagcggaaacacactgccatcgatctacttttgggaatgcagaacgtgggctcgtttgaaccgggctctttcgcctcctatgagcctatccgggcgtcgtccatgctggagaagatcaatccggccgaggtgtttggaaacatcatggtggagtatccgtacgtggaatgcactgattctgttgttctgggtctctcctactttcgaaagtaccacgattaccgcaacgaagacgtggaccgagccatctctgctgccattggatacattattcgagagcagcagcctgacggcggcttctttggctcctggggcgtgtgctactgctacgctcacatgtttgccatggaggctctggagacgcagaatctcaactataacaactgttccacggttcaaaaggcgtgcgactttctggcgggctaccaggaagcagatggaggctgggccgaggactttaagtcgtgcgagacccagatgtacgtgcgcggaccccattcgctggtcgtgcctactgccatggccctgttgagtttgatgagtggtcggtatccccaggaggacaagattcatgctgcggcccggtttctcatgagcaagcagatgagcaacggtgagtggctcaaggaggagatggagggggtgtttaaccatacttgtgccattgagtatcccaactaccggttttattttgtcatgaaggctttggggttgtatttcaagggatattgccagtga

SEQ ID NO: 98592 - protein, 742 aa, Yarrowia lipolytica CLIB99
MGIHESVSKQFAKNGHSKYRSDRYGLPKTDLRRWTFHASDLGAQWWKYDDTTPLEELEKRATDYVKYSLELPGYAPVTLDSKPVKNAYEAALKNWHLFASLQDPDSGAWQSEYDGPQFMSIGYVTACYFGGNEIPTPVKTEMIRYIVNTAHPVDGGWGLHKEDKSTCFGTSINYVVLRLLGLSRDHPVCVKARKTLLTKFGGAINNPHWGKTWLSILNLYKWEGVNPAPGELWLLPYFVPVHPGRWWVHTRWIYLAMGYLEAAEAQCELTPLLEELRDEIYKKPYSEIDFSKHCNSISGVDLYYPHTGLLKFGNALLRRYRKFRPQWIKEKVKEEIYNLCLREVSNTRHLCLAPVNNAMTSIVMYLHEGPDSANYKKIAARWPEFLSLNPSGMFMNGTNGLQVWDTAFAVQYACVCGFAELPQYQKTIRAAFDFLDRSQINEPTEENSYRDDRVGGWPFSTKTQGYPVSDCTAEALKAIIMVQNTPGYEDLKKQVSDKRKHTAIDLLLGMQNVGSFEPGSFASYEPIRASSMLEKINPAEVFGNIMVEYPYVECTDSVVLGLSYFRKYHDYRNEDVDRAISAAIGYIIREQQPDGGFFGSWGVCYCYAHMFAMEALETQNLNYNNCSTVQKACDFLAGYQEADGGWAEDFKSCETQMYVRGPHSLVVPTAMALLSLMSGRYPQEDKIHAAARFLMSKQMSNGEWLKEEMEGVFNHTCAIEYPNYRFYFVMKALGLYFKGYCQ

SEQ ID NO: 98593 - DNA, 2196 bp, Kluyveromyces lactis NRRL Y
  CDS (1)..(2196)
atgccagaactttattctgaaactattggattgcccaggacggatccaaaacgttggaggctcatcacagatgacttgggaagacaaacatgggaatatttaagtgagaatgatagcaagaaagttccgcaatcaacttttgcacgatggctattgaaatgtgaagattttccagaaccgcacccagagattaatagcaagacatcaggttttactgcttggaacgctgcacataacggtgcaaaattctttgaacttttgcaggaccctgattctggaacattcccatgccagtataagggtccaatgttcatgacaattgggtatgttgtgacgatgtatattgccaagattgaaatacctgagcatgagaaagctgaaatgattaggtacgttgccaactatgcacacccagtcgatgggggatggggtttgcatcatgtcgataagtcaactgttttgggtactgtactaaattatgtcatgatgagattgttaggtttacccaaggatcacgaagtttgtgttagagcaagggacactttactcaggttaggaggtgccattgcgtctcctcattgggccaagatatggttgtcaatcttaaatttgtataaatgggagggtgtcaacccagccccaccagaattatggatgttgccatacggattaaatattcatccagcaagatggtgggttcatacaagaggtatttatcttccggtgagttatttgtcaagtacccaatatagctgtgaacttgatcccttgttggaagaaattagaacggagatttacacccaaccgttcgagacaattgatttcaagaaacacagaaataccgtgtgcggtgttgatctatactatccacacacaaaagttttagacactatgaattacttcatatctaagtacgaaagatacgttagaccaaattggttgttgaaaaaatccactaatagagtatatgaacttgtcaagaaagaaattgcaaatacggattatctatgtattgcaccagttaataatgccttttgtgcaattgtgacattgattgaagaagggaaggattcggaagaatttggtagattcctttatagattcaaggacgtgttattccatggacctcagggcctaaccgttatggggaccaacggtgtccaagtttgggattgtgcattttacattcagtatatgtttatggcaggtttggctgaattgcccgaattccatgaaaccattgttagatcgtttaagttcttatgtcgctctcaatttactgaggattgtgttgaagggagtttcagagataaaaggttgggtgcttggccattttccacaaaaacccaaggatacaccgtttcagattgtacagcggaggcaatcaaagctatcataatggttcttaattccgacaaatatagagatgtctggggtgtatatgataccgaaaagttgaaaaacggcatagatgtccttttgggattgcaaaacttgtcatcatttgaatacggatccttcgctacatatgagaagatcaaagcgcccttactaatggaaaaattgaatccagcagaagtgtttggaaatatcatggttgaattcccatatgtggaatgtacagattcctcggtcctcggcttgacgtacttccgtcgctatttcaattatcggaaaaaggatatcgatcatgctattgattcagctattgcatatattaaaaagagtcagcagcctaatggttcttggtacggctgttggggtatttgttacacgtatgctggaatgttcgccttagaagcgctaaacacgattggagaaacgtatgagaatagcgaagttgttcgtaaagggtgtgacttctttgttactaaacagcttcctgatggtggttggtctgagaaaatgaaatctagtgaacttcacacatatgtatcggacaaagaatcttacgttgtacagactgcatgggtgctcattgggttgatattagcaaaattccctgacaaatcagttatcgatagggcaattaaccttttaaagcaaagacaacaaccgtcaggtgaatggaaatatgaagctgtggaaggtgttttcaatcattcatgtgccattgaatatccaagttacagatttttgttcccaataaaagctctcggtctatatgtaaaagaatacggccacagtgcaatttaa

SEQ ID NO: 98594 - protein, 731 aa, Kluyveromyces lactis NRRL Y
MPELYSETIGLPRTDPKRWRLITDDLGRQTWEYLSENDSKKVPQSTFARWLLKCEDFPEPHPEINSKTSGFTAWNAAHNGAKFFELLQDPDSGTFPCQYKGPMFMTIGYVVTMYIAKIEIPEHEKAEMIRYVANYAHPVDGGWGLHHVDKSTVLGTVLNYVMMRLLGLPKDHEVCVRARDTLLRLGGAIASPHWAKIWLSILNLYKWEGVNPAPPELWMLPYGLNIHPARWWVHTRGIYLPVSYLSSTQYSCELDPLLEEIRTEIYTQPFETIDFKKHRNTVCGVDLYYPHTKVLDTMNYFISKYERYVRPNWLLKKSTNRVYELVKKEIANTDYLCIAPVNNAFCAIVTLIEEGKDSEEFGRFLYRFKDVLFHGPQGLTVMGTNGVQVWDCAFYIQYMFMAGLAELPEFHETIVRSFKFLCRSQFTEDCVEGSFRDKRLGAWPFSTKTQGYTVSDCTAEAIKAIIMVLNSDKYRDVWGVYDTEKLKNGIDVLLGLQNLSSFEYGSFATYEKIKAPLLMEKLNPAEVFGNIMVEFPYVECTDSSVLGLTYFRRYFNYRKKDIDHAIDSAIAYIKKSQQPNGSWYGCWGICYTYAGMFALEALNTIGETYENSEVVRKGCDFFVTKQLPDGGWSEKMKSSELHTYVSDKESYVVQTAWVLIGLILAKFPDKSVIDRAINLLKQRQQPSGEWKYEAVEGVFNHSCAIEYPSYRFLFPIKALGLYVKEYGHSAI

SEQ ID NO: 98595 - DNA, 2202 bp, Candida glabrata CBS138
  CDS (1)..(2202)
atgactcagttttattctgataccgtcggtatacctagaactgatccgaaaagatggaggttaagaactactgaattgggtagagaagcttgggagtatattgaacaagacaaggttgatgcagacccgcaatccacatttgttcaatggttattacaagatgaggaattcccgacaccttcaccaagaaaagaaggtgatgacttaagctctgagcaagcttgttattatggagcatccttctataagcttcttcaggatcaaaagtcaggtattttcccatgccaatataaggggcctatgttcatgacaattgggtatgttgctgtcaattacattgctggcgttaaattaccagagcatgagagaatcgagctaattaggtacattgttaacactgcgcatcctgttgatggtggatggggtcttcactcagttgacaagtctactgtatttggtacagtcttgaactatgtctgtctaaggttgttgggactgccaaaggatcatatagtttgtgtgagagccagacatactctgcatagacttggaggagctactggtgcaccacactggggtaagatatggctaagcattttgaacttatataaatgggagggtgttaatccagctccccctgaaacttggctattaccttactcattgccaattcatcccggtagatggtgggtacacacaagagctgtttatttaccggtaagttacctttcattgattaagtactcatgtcctttaactgaccttctttcagagattaggcaggagatctatacaaagtcatttgataaaataaacttttctcaacacaggaatactgtgtgtggtgtggatttgtactatccacatagcaaaattctggacactgcaaatgatgtcattgtattttatgagaagtatttacgtcctagacttgtatcgatggcatccaagaaggtagtttacaatttgatcaagaaagagatacaaaatacagattctctatgtattgcaccagttaatcaagcattttgtgcattagtgacttatttagaagaagggaaagattcaaaggcttttgaacgatttcagtatagattcaaagatggcttattccatggcccacaaggtatgacagtaatgggtaccaatggtgtgcaaacttgggactgtgcttttatgatacaatatttctttgttgctggcttggctgagaaaccggaatttagagaaatgataataaatgcctataagtttttgtgtagatcacagttcgatacagaatgtgttgaaggaagttttagagacaaaagagttggtgcctgggggttctctaccaagacccaaggctatactgtgtctgactgtactgcggaagcaataaaggcaataattatggtgagaaactctcctgtattttcctctgtacatgatgagataactgatgaaaggctctgtaaaggtattgatgtgttattaagtctacaaaatattggtaagtttgaatacggttcatttgcgacttacgaaaagatcaaggctccgctttcgatggagaaattaaatcctgcagaagtattcgggaacattatggtcgagtacccatatgtcgagtgcacagactcgagcgttttgggtttgacgtatttccacaaatattatgattataggaaggacgagatatctcacagaatcaggattgccattgactacattaaacaggcacaacaagatgatggtgggtggtacggctgctggggtatttgcttcacatatgccggtatgtttgccatggaggcactgcactctgtaggagaaacctatgataattccttgacagtgagaaagggctgtgacttccttttgagcaaacagatgcctgatggtggttggggtgaatccatgaagtccagtgagctacatgactatgttgacagtccaaagtcattggtggtgcaaacggcatgggctttgatcgccctgttgttggctaagtgtccaaatgaagacgccattgagaggggtatcaacctgctaaagtccaggcagcaaccatcaggtgaatggaagttcgagagcgcggaaggtgtgttcaaccactcttgcgctatcgagtatccaagctataggttcctcttcccaataaaagctctgggactgtacaatggcagaaactacaccaactcatctcaaaatacacaataa

SEQ ID NO: 98596 - protein, 733 aa, Candida glabrata CBS138
MTQFYSDTVGIPRTDPKRWRLRTTELGREAWEYIEQDKVDADPQSTFVQWLLQDEEFPTPSPRKEGDDLSSEQACYYGASFYKLLQDQKSGIFPCQYKGPMFMTIGYVAVNYIAGVKLPEHERIELIRYIVNTAHPVDGGWGLHSVDKSTVFGTVLNYVCLRLLGLPKDHIVCVRARHTLHRLGGATGAPHWGKIWLSILNLYKWEGVNPAPPETWLLPYSLPIHPGRWWVHTRAVYLPVSYLSLIKYSCPLTDLLSEIRQEIYTKSFDKINFSQHRNTVCGVDLYYPHSKILDTANDVIVFYEKYLRPRLVSMASKKVVYNLIKKEIQNTDSLCIAPVNQAFCALVTYLEEGKDSKAFERFQYRFKDGLFHGPQGMTVMGTNGVQTWDCAFMIQYFFVAGLAEKPEFREMIINAYKFLCRSQFDTECVEGSFRDKRVGAWGFSTKTQGYTVSDCTAEAIKAIIMVRNSPVFSSVHDEITDERLCKGIDVLLSLQNIGKFEYGSFATYEKIKAPLSMEKLNPAEVFGNIMVEYPYVECTDSSVLGLTYFHKYYDYRKDEISHRIRIAIDYIKQAQQDDGGWYGCWGICFTYAGMFAMEALHSVGETYDNSLTVRKGCDFLLSKQMPDGGWGESMKSSELHDYVDSPKSLVVQTAWALIALLLAKCPNEDAIERGINLLKSRQQPSGEWKFESAEGVFNHSCAIEYPSYRFLFPIKALGLYNGRNYTNSSQNTQ

SEQ ID NO: 98597 - DNA, 1854 bp, Bacillus thuringiensis
  CDS (1)..(1854)
atgttattatacgaaaaagcgcatgaagaaatagtgagaagagcaacagcacttcaaacaatgcaatggcaagatggtacgtggcgattttgttttgaaggagctccattaacagattgccatatgatttttttattaaaattattaggtagagataaagagatagaaccgttcgtagaaagagtagcatcactccaaacaaatgaaggaacatggaaattgtatgaagatgaagtaggaggtaatttatcagctacaattcaatcttatgccgccttacttgcatcgaaaaaatatacaaaagaagatgcgaatatgaaacgagcggaaaattttattcaggaacgcggtggcgtggcgcgtgctcattttatgacgaagtttttattagcaattcatggagaatatgaatatccttcactctttcatttaccaacaccaatcatgtttctacagaatgattccccctttagtatatttgaattaagtagctcagcacgtattcatttaattccgatgatgctatgtttaaataaaagatttcgagtagggaaaaagttattaccaaatttaaatcacattgcgggcggaggcggagaatggtttcgggaggatcggtctccagtttttcaaacgttattaagtgatgtaaaacaaattatatcgtatccactttcgttacatcataaaggatatgaggaaatagaacgttttatgaaagagcgtattgatgaaaatggaacgttatatagttacgcaactgcctcgttttatatgatttatgctttacttgcgttagggcattctcttcaatcatcaatgattcaaaaggctatagctgggataacatcttatatatggaagatggaaagagggaatcatttgcaaaactctccttcaaccgtgtgggatacagctttattaagctatgcgttacaagaggctcaagtttcaaaggataataagatgattcaaaatgcaacagcgtatttattaaaaaaacagcatacaaaaaaagctgattggagcgtacatgctccggcgcttactcctggcggttggggtttttcggatgtgaatacgacaattccagatatagatgatacaacagctgtgctaagggcattggcacgaagtagaggaaacaaaaatatagataatgcttggaagaaagggggcaattggattaaaggattacaaaacaatgatggtggctggggagcatttgaaaaaggtgtgacgagcaaattattagcaaaattaccaatcgaaaacgcaagtgatatgattacagatccttctacgccagatattacggggagagtgttagagtttttcgggacatatgcacaaaacgaattgcctgagaaacagatacaaagggcaataaattggttaatgaatgtacaagaggaaaatggatcatggtatgggaaatgggggatttgttatatatatggtacgtgggctgttatgactggtttacggtcactcggaattccgtctagcaatccttcattgaaacgagcagcttcatggcttgaacatatacagcatgaagatggtggttggggagaatcatgccacagtagtgtggagaaaaggttcgttactttaccatttagtacaccatcccaaactgcatgggcgttagatgctctcatttcttactatgatacagaaacgccagctattcgaaaaggtgtttcatatttgctttcgaatccttatgtgaatgaaagatatcctactggaacaggtttaccaggtgcgttttatattaggtatcatagctatgcccatatatatccactacttactttagcacattatttaaaaaaatatagaaaataa

SEQ ID NO: 98598 - protein, 617 aa, Bacillus thuringiensis
MLLYEKAHEEIVRRATALQTMQWQDGTWRFCFEGAPLTDCHMIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLKRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYLKKYRK

SEQ ID NO: 98599 - DNA, 2274 bp, Avena prostrata
  CDS (1)..(2274)
atgtggaggctaacaataggtgagggtggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaaaacaaccctcttccggccaatattccgacagcagctaagcttgaaaagagtacagaggtcactcacgagaccatctacgaatcattgatgcgagctttacatcaatattcctctatacaagcagacgatgggcattggcctggtgattacagtgggattctcttcattatgcctatcattatattctctttatatgttactagatcactggacacctttttatctccggaacatcgtcatgagatatgtcgctatatttacaatcaacagaatgaagatggtggttggggaaaaatggtccttggcccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgattttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaaataacctcatggagcatatccattacgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcatgagttcatgaagaactcacaggttcttttcaaccacccaaatcatgaaagctattatcgccacagatcaaaaggctcatggaccctttcaagtgtagataatggttggtctgtatctgattgtaccgcggaagctgttaaggcattgctactattatcaaagatatccgcagaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagccaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaaggcagctaatgaatatgcagctagaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 98600 - protein, 757 aa, Avena prostrata
MWRLTIGEGGGPWLKSNNGFLGRQVWEYDADAGTPEERAEVERVRAEFTKNRFQRKESQDLLLRLQYAKNNPLPANIPTAAKLEKSTEVTHETIYESLMRALHQYSSIQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALNNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 98601 - DNA, 2274 bp, Avena clauda
  CDS (1)..(2274)
atgtggaggctaacaataggtgagggagccggtgatccctggctcaagtccaacaacggcttcctcggccgccaagtgtggcactacgacgccgatgccggcacgcccgaagagcgtgccgaggttgagagggtgcgtgcggagttcacaaagaacaggttcaacaggaaggagtcacaggaccttcttctacgcttgcagtacgcaaaagccaaccctcttccggcgaatgttccgacagcaaagcttgataagagtacagaggtcactcacgagactatacacgcttcgttgatgcgagctttacatcagtattccgctctacaagcagacgatggccactggcctggtgattacagtgggattctcttcattatgcctatcattatattctcattacatgttactagatcactggacacctttttatctccagaacatcgtcatgagatatgtcgctacatttacaatcaacagaacgaagatggtggttgggggaaaatggttcttggcccaagtactatgtttggatcatgtatgacttatgcaaccttaatgcttcttggtgagaagcgagacggtgaacatgaggatgcattgacaaaagggcgttcctggattttatctcatggaactgcaactgcaataccacagtgggggaaaatatggttgtcgataattggcgtttacgattggtccggaaacaatcctattatacctgaattgtggttggttccacattttcttccgattcacccaggtcgattttggtgttttacccggttgatatacatgtcaatggcatatctttatggaaagaaatttgttgggcctattactccaacaatattagctctgcgacaagacctctatagtataccttacagcaacgttaattgggacaaggcgcgtgattattgtgcaaaggaggaccttcattatccacgctcacgggcacaagatcttataactggatgcctgacaaaaattgtggagccagttttgaattggtggccagcaaacaagctaagagatagagctttaagtaacctaatggagcatatccattatgatgacgaatcaacaaaatacgtgggcatttgccctattaacaaggcattgaacatgatttgttgttgggtagaaaacccaaattcagctgaattcaaacaacatcttccacgattccatgactatttgtggatgtcagaggatggaatgaaggcacaggtatatgatggatgtcatagttgggaactagcgttcattattcatgcctattattccacggatcttgctagcgagtttattccgactataaaaaaggctcacgagttcatgaagaactcacaggttcttttcaaccacccaaatcatgaaagttattatcgccacagatcaaaaggctcatggacactttcaagtgtagataatggttggtctgtttctgattgtactgcggaagctgttaaggcattgctactattatcaaaaatatcgcctgacctcattggagatccaataaaacaagataggttgtatgatgccattgattgcatcctatctttcatgaatacagatggcacattttctacctacgaatgcaaacggacatttggttggttagaggttctcaacccttctgagagttttcggaacattgtcgtggactatccatctgttgaatgcacatcatctgtgcttgatgcttttgtactattcaaggagacacatccacgatatcgtagagcggagatagataaatgcattaaagaagctgttctatttattgagaaaagtcaaaataaggatggttcatggtatggctcatggggtatttgttttgcatatggatgcatgtttgcagtaagagcgttagttgctacgggaaaaacctacgataattgtgcttctatcaggaaatcatgcaaatttatcttatcaaagcaacaaaccacaggtggatggggtgaagactatctttctagtgacaatggggaatatattgatagcggtaggcctaatgctgtgaccacctcatgggcaatgttgtctttaatttatgctggacaggttgaacgtgacccggtaccactatataatgctgcaaggcagctaatgaatatgcaactagaaacaggcgacttcccccagcaggaacacatgggttgcttcaactcctccttgaacttcaactacgcaaattaccgcaatctatacccgattatggctcttggggaacttcgtcgtcggcttcttccgattaagagctga

SEQ ID NO: 98602 - protein, 757 aa, Avena clauda
MWRLTIGEGAGDPWLKSNNGFLGRQVWHYDADAGTPEERAEVERVRAEFTKNRFNRKESQDLLLRLQYAKANPLPANVPTAKLDKSTEVTHETIHASLMRALHQYSALQADDGHWPGDYSGILFIMPIIIFSLHVTRSLDTFLSPEHRHEICRYIYNQQNEDGGWGKMVLGPSTMFGSCMTYATLMLLGEKRDGEHEDALTKGRSWILSHGTATAIPQWGKIWLSIIGVYDWSGNNPIIPELWLVPHFLPIHPGRFWCFTRLIYMSMAYLYGKKFVGPITPTILALRQDLYSIPYSNVNWDKARDYCAKEDLHYPRSRAQDLITGCLTKIVEPVLNWWPANKLRDRALSNLMEHIHYDDESTKYVGICPINKALNMICCWVENPNSAEFKQHLPRFHDYLWMSEDGMKAQVYDGCHSWELAFIIHAYYSTDLASEFIPTIKKAHEFMKNSQVLFNHPNHESYYRHRSKGSWTLSSVDNGWSVSDCTAEAVKALLLLSKISPDLIGDPIKQDRLYDAIDCILSFMNTDGTFSTYECKRTFGWLEVLNPSESFRNIVVDYPSVECTSSVLDAFVLFKETHPRYRRAEIDKCIKEAVLFIEKSQNKDGSWYGSWGICFAYGCMFAVRALVATGKTYDNCASIRKSCKFILSKQQTTGGWGEDYLSSDNGEYIDSGRPNAVTTSWAMLSLIYAGQVERDPVPLYNAARQLMNMQLETGDFPQQEHMGCFNSSLNFNYANYRNLYPIMALGELRRRLLPIKS

SEQ ID NO: 98603 - DNA, 2280 bp, Avena longiglumis
  CDS (1)..(2280)
atgtggcggctgaagatcgcggagggcgggggcgacccgtggctgcgcaccaagaacgcgcacgtcggccgccaggtctgggagttcgaccccgaggccggcgacccggagaccctcgccgccgtcgaagccgcgcgacgggacttcgccgcgggacgccaccggctcaagcacagctccgaccgcctcatgcgcatccagtttgagaaagaaaatccacttaagttggatcttcctgctatcaagctggaggagaatgaagatgtcactgaggaagctgtgtcgacctctctgaaaagggcgatcagcagattttctactctccaggcacacgatgggcactggcctggggattatggtggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggtgtatttgattggtctggtaacaatccactgccaccagaaatatggatgttgccataccgcctgccaattcatccaggtcgaatgtggtgtcactgccgcatggtgtatctacccatgtgctatgtttatggaaagaggttttttgggaaaatcacaccacttatattggaactaagaaacgaactctacaagaccccctacagcaagattgattgggacagtgctcgcaatctttgtgctaaggaagatctgtactatccacatccattgatacaggatatactatgggccacactccataaatttgtcgaaccagttatgatgcattggcctgggaacaaattgagggagaaagctttgaaccatgtcatgcagcatgttcattatgaagatgagaacacccgctacatttgtattggtcctgtgaacaaggtactaaatatgcttacttgttggattgaagatccaaattcggaagcattcaagctccatattccaagagtccatgattacttgtgggttgctgaagatggcatgaagatgcagggttataatggcagccagctctgggacacagctttcgcagtccaagctattacggctactggcctcattgatgagtttgctcccactcttaagcttgcacacaacttcattaagaactcccaggttcttgatgactgccctggagatctgagttattggtaccgtcacatatctaaaggtgcatggcctttttctactgctgatcatggttggcctatatcagattgcactgcagaaggactaaaggccgcattattgctatcgaagatttctccagaaattgtgggcgaaccagtggaagttaacagactttatgatgctgtcaattgtctgatgtcttggatgaataataatggtggttttgcaacttatgaactcacaaggtcttatgcctggctagagcttatcaaccctgctgagacctttggggacattgtcattgattacccgtacgtagaatgtacgtcagctgcaattcaggccctgacatcatttaaaaagctctatcctgggcaccgcaggaaagatgtagataactgtatcaacaaagctgctaatttcatagagagtattcaaagaagtgatggttcatggtatggctcttgggctgtttgtttcacctacggcacatggtttggagtgaaggcattagttgctgctggtaggacgttcaagagtagtcctgcaatcaggaaggcatgtgaatttctgatgtcaaaagagcttcctttcggtggctggggagaaagttatttgtcatgtcaagatcaggtttacaccaatcttgaaggcaagcatgctcatgcagtcaacactggctgggccatgctgaccctaattgacgcaggacaggccgagagagatccaacacctctgcatcgggcagcgaaggttttgatcaacttacaatctgaggatggggaatttcctcaacaagagatcatgggagtcttcaacaagaactgcatgatcagttactcccagtacagggacatcttccctgtgtgggcactcggagagtaccgttgccgagtcttggctgcgggcaagtag

SEQ ID NO: 98604 - protein, 759 aa, Avena longiglumis
MWRLKIAEGGGDPWLRTKNAHVGRQVWEFDPEAGDPETLAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFFGKITPLILELRNELYKTPYSKIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGESYLSCQDQVYTNLEGKHAHAVNTGWAMLTLIDAGQAERDPTPLHRAAKVLINLQSEDGEFPQQEIMGVFNKNCMISYSQYRDIFPVWALGEYRCRVLAAGK

SEQ ID NO: 98605 - DNA, 2280 bp, Avena clauda
  CDS (1)..(2280)
atgtggcggctgaagatcgcggagggcgggggcgacccgtggctgcgcacgaagaacgcgcacgtcggccgccaggtctgggagttcgaccccgaggccggcgacccggaggccctcgccgccgtcgaggccgcgcgccgggagttcgccgcggggcgccaccgcctcaagcacagcgccgaccgcctcatgcgcatccagtttgagaaagaaaatccacttaagttggaccttcctgctatcaagctggaggagaatgaagatgtcactgaggaagctgtgtcgacctctttgaaaagggcgatcagcagattttctactctccaggcacatgatgggcactggcctggggattatggtggtcctatgttccttatgccaggattgcttataacactgtatgtgactggatcactgaacactgtcttatcaccagaacatcagaaggagatccgccgatatctctataatcatcagaatgaagatggaggctggggattgcacattgagggtccaagcaccatgtttggctcggccttgacctatgtttccctgagattgcttggagagggaccagagagtggagatggtgctatggcaaaaggtcgaaattggattttagaccacgggggagcaacttatataacatcatggggaaagttttggctcgcggtacttggtgtatttgattggtctggtaacaacccactgccaccagaagtatggatgttgtcataccgcctgccaattcatccaggtcgaatgtggtgtcactgccgaatggtgtatctacccatgtgctatgtttatggaaagaggtttgtcggcaagatcacaccacttatattggaactaagaaatgaactctacaaaaccccctacagcaagattgattgggacaatgctcgcaatctttgtgctaaggaagatctgtactatccacatccattgatacaggatatattatgggccacactccataaatttgtcgaaccagttatgatacattggcctgggaacaaattgagggagaaagctttgaactatgttatgcagcatgttcattatgaagatgagaacactcgatacatttgtattggtcctgtgaacaaggtactaaatatgcttacttgttggattgaagatccaaattcagaagcattcaagctccatattccaagaatccatgattacttgtgggttgctgaagatggcatgaagatgcagggttataatggcagccagctctgggacacagctttcgcagtccaagctattgcggctactggcctcattgatgagtttgctcccactcttaagctagcacacaacttcattaagaactcccaggttcttgatgactgccccggagatctgagttactggtaccgtcacatatctaaaggtgcatggcctttttctactgctgatcatggttggcctatatcagattgcactgcagaaggactaaaggctgcattattgctatcgaagatttctccagaaattgtgggcgaaccagtggaagttaacagactttatgatgctgtcaattgtctgatgtcttggatgaacaataatggtggttttgcaacatacgaactcacaaggtcttatgcctggctggagcttatcaaccctgctgagacctttggagacattgtcattgattacccgtatgtggaatgtacttcagcagcaattcaggccctgacatcatttaaaaagctctatcctgggcaccgcaggaaagatgtagataactgtatcaacaaagctgctaattacatagagagtattcaaagaagtgatggttcatggtatggctcttgggctgtttgtttcacctacgccacatggtttggagtgaaggcattagttgctgctggtaggccgttcaagagtagtcctgcaatcaggaaggcatgtgaatttctgatgtcaaaagagcttcctttcggtggctggggagaaagttatttgtcatgtcgagatcaggtttacactaatcttgaaggcaagcatgctcacgcagtcaacactggctgggccatgctgaccctaattgacgcaggacaggctgagagagatccagcacctctgcatcgagcagcgaaggttttgatcaacttacaatctgaggatggggaatttcctcaacaagagatcatgggagtcttcaacaaaaactgcatgatcagttactcccagtacagggacatcttccctgtgtgggcactcggagagtaccgttgccgagtcttggctgcgggcaagtag

SEQ ID NO: 98606 - protein, 759 aa, Avena clauda
MWRLKIAEGGGDPWLRTKNAHVGRQVWEFDPEAGDPEALAAVEAARREFAAGRHRLKHSADRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMAKGRNWILDHGGATYITSWGKFWLAVLGVFDWSGNNPLPPEVWMLSYRLPIHPGRMWCHCRMVYLPMCYVYGKRFVGKITPLILELRNELYKTPYSKIDWDNARNLCAKEDLYYPHPLIQDILWATLHKFVEPVMIHWPGNKLREKALNYVMQHVHYEDENTRYICIGPVNKVLNMLTCWIEDPNSEAFKLHIPRIHDYLWVAEDGMKMQGYNGSQLWDTAFAVQAIAATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANYIESIQRSDGSWYGSWAVCFTYATWFGVKALVAAGRPFKSSPAIRKACEFLMSKELPFGGWGESYLSCRDQVYTNLEGKHAHAVNTGWAMLTLIDAGQAERDPAPLHRAAKVLINLQSEDGEFPQQEIMGVFNKNCMISYSQYRDIFPVWALGEYRCRVLAAGK

SEQ ID NO: 98607 - DNA, 2547 bp, Centella asiatica
  CDS (32)..(2305)
ggcaattctctctctaaattattgactgaaaatgtggaagctcaaagtcgctgaaggaggaaatccatggcttcggactgtcaacaatcacgtcggccggcaaatttgggagttcgatccaaaacttggatctcccgaagagcttgcggagatcgagaaagctcgcgagaattttcacaatcatcgattcgagaaacagcacagttccgatctactgatgcggctacagttcgccaatgagaatccacgccatgaagtcttaccccaagttaaagtaaaagatatcggagatatttcggaggataaagtaacaattacgttaaaaagagctttgagtttttattcaactcttcaagccaatgatggacattgggcaggagattatggtggtcctatgtttttaatgcctggtttggttatcactctatcaattactgaggcactgaatgctatcttgtccaaagaacacaaacgtgagatatgccgctatctttacaatcatcagaatagagatggtgggtggggtttacacattgaaggtccaagcactatgtttggtagtgtcttgaactatgttactctgagattgcttggtgaaggaactaaggatgggcaaggagcaatggagaaagggcgtcagtggattctggatcatggtggtgccactgcaattacatcatggggaagaatgtggctttcagttcttggtgtatttgaatggtctggaaataatcccctcccccctgagatatggttatttccatataatcttccattccacccaggaaggatgtggtgccactgtcggatggtttatcttcctatgtcatacttatatgggaagaggtttgttggtccaatcacaccgactgtcctttctttgagaaaggagctcttcactgtcccttatcatgaaatagattggaatcaagcacgcaacctatgtgcaaaggaagatctgtactatccacaccctcttgtgcaggatatactttgggcatcaattgataaggttttggaacctattttaatgcgttggcctggaaaaaagttgagagagaaagctcttcgcaccgtgatggaacacatacattatgaagatgaaaatactcgctatatatgcatagggcctgtaaacaaggtgttaaatatgctatgctgttgggctgaggatccaaactctgaggctttcaagctgcatcttccaagactctatgattttttatggcttgctgaggatggcatgaaaatgcaggggtacaatggaagtcaattatgggacactgcttttgctgttcaagcaatcatatcaactagtttgactgaatattgtggcccaactctcagaaaagcacatacattcatgaaagactcacaggtgctagatgattgtcctggtgatcttgatttttggtatcgtcatatatcaaaaggtgcatggcctttctccactgctgatcatggatggcccatttcagattgtacagccgaaggatttaaggctgtgcttctgttatcaaaattcccagcagaacttgttggtgaaccattagatgccaagcgactgtatgatgctgtcaacgttattctttctttacagaatagtgatggtggctatgcaacatatgaactcacaagatcctatcgctggctagagttaatcaaccctgccgagacgttcggggacattgttattgactatccttatgcagaatgtacatcagctgcaattcaagcgttatcagctttcaaaaaattatatcctgggcaccgtcgggaagagatacagtgttctattgaaaaagctgcagacttcatagagaagatacaagcttcagatggctcatggtatggctcttggggagtttgcttcacctatggtacatggtttggtgtaaaagggttgatatctgctgggagaaccttctctaattgctcaagcattcgcaaggcttgttattttctactgtccaaacaacttgcttctggtggttggggagagagttacctctcctgtcagaacaaggtgtatacaaatcttgagggagaacgttctcatgttgtaaatactggatgggctatgctggctctcattgaggctgggcaggcagagagagatgcaacaccattgcaccatgcagctaaattattgattaattctcaaatggaaaatggagatttccctcaggaggagatcatgggggtcttcaacaagaattgtatgatcacttatgctgcgtacagaaacattttccctatttgggctttgggggactaccggtgtcgtgtacttctggcgccatgagattatctaagcattttgagtataaattttcagtgtttgttacatagttgttctgtgtggcatcttgtacgtcatatttgccacacgctcgggctacagtagagtaatatagacgtgattagttcacagatgaaaccttagacgttaccatatgtttgtaaatccggccagaacttgttcgcagcactttacgtgcatgcatcatagtgccttataagagttcctgtaaaaaaaaaaaaaaa

SEQ ID NO: 98608 - protein, 757 aa, Centella asiatica
MWKLKVAEGGNPWLRTVNNHVGRQIWEFDPKLGSPEELAEIEKARENFHNHRFEKQHSSDLLMRLQFANENPRHEVLPQVKVKDIGDISEDKVTITLKRALSFYSTLQANDGHWAGDYGGPMFLMPGLVITLSITEALNAILSKEHKREICRYLYNHQNRDGGWGLHIEGPSTMFGSVLNYVTLRLLGEGTKDGQGAMEKGRQWILDHGGATAITSWGRMWLSVLGVFEWSGNNPLPPEIWLFPYNLPFHPGRMWCHCRMVYLPMSYLYGKRFVGPITPTVLSLRKELFTVPYHEIDWNQARNLCAKEDLYYPHPLVQDILWASIDKVLEPILMRWPGKKLREKALRTVMEHIHYEDENTRYICIGPVNKVLNMLCCWAEDPNSEAFKLHLPRLYDFLWLAEDGMKMQGYNGSQLWDTAFAVQAIISTSLTEYCGPTLRKAHTFMKDSQVLDDCPGDLDFWYRHISKGAWPFSTADHGWPISDCTAEGFKAVLLLSKFPAELVGEPLDAKRLYDAVNVILSLQNSDGGYATYELTRSYRWLELINPAETFGDIVIDYPYAECTSAAIQALSAFKKLYPGHRREEIQCSIEKAADFIEKIQASDGSWYGSWGVCFTYGTWFGVKGLISAGRTFSNCSSIRKACYFLLSKQLASGGWGESYLSCQNKVYTNLEGERSHVVNTGWAMLALIEAGQAERDATPLHHAAKLLINSQMENGDFPQEEIMGVFNKNCMITYAAYRNIFPIWALGDYRCRVLLAP

SEQ ID NO: 98609 - DNA, 2562 bp, Centella asiatica
  CDS (77)..(2359)
aaagaagattttattttatttttttcagcaaaaaaaagttgaaaaaataagaaattgatagatcgagctaggggagatgtggaagctgaagatagcagagggtaatggagcatacttgtacagcaccaacaactttgtggggagacagatatgggagtatgatcctgatgctggaactcctgaagagcgactagaggtcgagaaacttcgagaaacttacaaatataatctcatcaacaatgggattcacccttgtggtgatatgctcatgaggttgcagctgataaaggagagtgggctggatcttttgagcataccgccggtgagacttggagaacaagaagaagtgaattatcaagtagtgacgacggctgttaagaaagctctgcggttaaaccgcgcaatccaagctcacgacggtcactggccagctgaaaatgctggacctatgttttttacaccacccctcatcatagcgctatacatcagcggagcaattgacactcatctaacaatacaacacaagaaggagatgattcgttttatttacctccaccaaaacaaagatggaggatggggattctatatagagggacatagcacgatgatagggtcagcacttagctacgtggcgttacgtttgctgggagaagggcctgatgacggcgatggtgcagtggagagagcaagaaaatggatccttgaccatggtggtgctgcttctataccctcctggggtaagacttatcttgcggttcttggggtatacgagtgggaagggtgtaaccccctgcccccagaattttggcttttccctgaagctttaccttatcatccagcaaaaatgtggtgttactgtcgcacaacatacatgccgatgtcgtatttgtatgggaagaaatatcatggtccaattacggatcttgttatatctttaagaaaagaaatacaccccattccttatgagaagataaattggaacaaacagcgccataactgtaacaaggaggatctttactaccctcatagctttatacaggatttgctatgggatggtcttcactattttactgaacctatcattaaaatgtggcccttcaataagttgcgaaagaaagggatgaaaagagccattgaacttatgcgctacggaggttatgagagcagattcattaccattggatgtgtatccaagagtctagatatgatgtgttggtgggcagagaacccgaatggtccagaattcaaacatcacttagctagagtacctgattacttgtggcttgcagaggatggaatgaagatgcagagttttggtagtcaattatgggactgtgttcttgctactcaagctgtcatgtctactggtatggttgatgaatatggggattgtcttaagaaagcacatttctatattaaagaatcacagtgcaagaaaaatccgtcaggagattatgcaagtatgtgccggtattttacaaaaggatcatggacattttctgatcaagatcagggttgggttgtctctgattgcacagctgaagcgctgaagtgtctattagcactttctcaaatgccagaggaaattgcaggggaaaaggcagatgttgagcgattatatgatgccgtaaacgtcctcctctacttgcaaagccctataagtgggggttttgccatttgggagccaccagttccaagaccatacttgcaggtgttgaatccttcggagatttttgccgacatcgttgtcgaaaaagagcatacggagtgcacagcatcaataatagcagctctggtagcattcaaacgtttgcatccgggtcatcggtcgaaagaaataagtgttgccatcgcaaaagctgtacattttcttgaaggaaaacaattggaagatggttcatggtatggctactggggaatatgctttttgtatggcacattttttgcgttagctgggttagcttctgtgggacagacttatgaaaacagtgaaaccgttcgtaaagctgttaagtttttcctttctacacaaaatgaagaaggtggttggggagaaagtcttgaatcatgtccgagcgagatattcacaccattagaaggaaacagaacaaatttagtacaaacatcatgggcaatgcttggtctcatgtttggtggacaggccacgagagatccaactccattgcatagagcagcaaagttattgattaatgcacaattgaataacggagatttccctcagcaggaaacaactggagtgtacatgaagaattgtatgttgcattatgccgagtatagaaatgtatttccgttatgggcacttggagagtaccgcaaacgcttgtggctctccaattgaagtactttggttccaaaacatatatcgatccatttataaatgcatatatatggggtgtatgtttaagagtctcaagttattgtaatctttatatatatttattaattaattgtaatgtcaaagagaacatttgaaaacatttgtagttgcttaattgatgcatatgtcattgcaatttacttttaaaaaaaaaaaaaaaaaaa

SEQ ID NO: 98610 - protein, 760 aa, Centella asiatica
MWKLKIAEGNGAYLYSTNNFVGRQIWEYDPDAGTPEERLEVEKLRETYKYNLINNGIHPCGDMLMRLQLIKESGLDLLSIPPVRLGEQEEVNYQVVTTAVKKALRLNRAIQAHDGHWPAENAGPMFFTPPLIIALYISGAIDTHLTIQHKKEMIRFIYLHQNKDGGWGFYIEGHSTMIGSALSYVALRLLGEGPDDGDGAVERARKWILDHGGAASIPSWGKTYLAVLGVYEWEGCNPLPPEFWLFPEALPYHPAKMWCYCRTTYMPMSYLYGKKYHGPITDLVISLRKEIHPIPYEKINWNKQRHNCNKEDLYYPHSFIQDLLWDGLHYFTEPIIKMWPFNKLRKKGMKRAIELMRYGGYESRFITIGCVSKSLDMMCWWAENPNGPEFKHHLARVPDYLWLAEDGMKMQSFGSQLWDCVLATQAVMSTGMVDEYGDCLKKAHFYIKESQCKKNPSGDYASMCRYFTKGSWTFSDQDQGWVVSDCTAEALKCLLALSQMPEEIAGEKADVERLYDAVNVLLYLQSPISGGFAIWEPPVPRPYLQVLNPSEIFADIVVEKEHTECTASIIAALVAFKRLHPGHRSKEISVAIAKAVHFLEGKQLEDGSWYGYWGICFLYGTFFALAGLASVGQTYENSETVRKAVKFFLSTQNEEGGWGESLESCPSEIFTPLEGNRTNLVQTSWAMLGLMFGGQATRDPTPLHRAAKLLINAQLNNGDFPQQETTGVYMKNCMLHYAEYRNVFPLWALGEYRKRLWLSN

SEQ ID NO: 98611 - DNA, 1854 bp, Bacillus cereus
  CDS (1)..(1854)
atgttattatatgaaaaagcgcatgaagaaatagcgagaagagcaactgcacttcaaacgatgcaacggcaagatggtacgtggcgattttgttttgaaggagctccattaacagattgccatatgatttttttattaaaattattaggtagagataaagagatagaaccgtttgtaaaaaggttagcatcacttcaaacaaatgaaggaacgtggaaattgtatgaagatgaagtgggaggtaatttatcagctaccattcaatcttatgcggccttgctagcatcgaaaaaatatacaaaagaagatgcgaatatgaagcgagcggaaaattttattaaggaacgcggaggcgtggcgcgtgctcattttatgacgaagtttttattagcaattcatggagaatatgaatatccttcactctttcatttaccaacaccaatcatgtttctacagaatgattcccccctcagtatatttgaattgagtagctcagcacgtatccatttaattccgatgatggtgtgtttaaataaaagatttcgagtagggaaaaagttattgccaaatttaaatcacattgcgggcgggggcggagaatggtttcgggaggatcggtctccgttgtttcaaacgttattaagtgatgtaaaacaaattatctcgtatccactctcgttacatcataaaggatatgaggaagtcgaacgtttcatgaaagagcgtattgatgaaaatggaacgttatatagttacgcaactgcctcgttttatatgatttatgctttacttgcgttagggcattctcttcaatcatcactgattcaaaaggctatagctgggataacatcttatatatggaagatggaaagagggagtcacttgcaaaactctccttcgaccgtatgggatacagctttactcagctatgcgttacaagaggcccacgttccgaaagatcacaagatgattcaacagacaataacatatttattgaaaaaacagcatacaaaaaaagctgattggagcgtacatgctctcgcacttactccaggtggttggggtttttcggatgtaaatacgacaattccagatgtcgatgatacaacagctgtgctaagagcgttggcaaggagtagaggaaacgaaaatatagataatgcttggaagaaaggggtcaattggattaaaggattacaaaataatgatggtggctggggagcgtttgaaaaaggtgtgacgagcaaattattagcgaatttaccaatcgaaaatgcaagtgatatgattacggatccttccacaccagatattacaggaagagtgttagagcttttcgggacatatacgcaaaatgaattacctaagaaacaaaaacaaagtgcgataaattggttaatgaatgtacaagagagaaatggatcctggtatgggaaatgggggatttgttatatatatggtacgtgggctgttatgactggtttacggtcactcggaattccatctaacaatccatcattgaaacgagcagctttatggcttgaacatatacagcatgaagatggtggatggggagaatcatgccaaagtagtgtggagaaaagattcgttactttaccatttagtacaccatctcaaacagcatgggcgttagatgctctcatttcttactatgataaagaaacaccaactattcgaaaaggcgtttcatatttgcttgcgaatccttatgtgaatgaaaaatatcctactggaacaggtttacctggtgggttttatattcgttatcatagctatgcccaaatttatccgctacttactttggcacattatacaaaaaaatatcaaaaataa

SEQ ID NO: 98612 - protein, 617 aa, Bacillus cereus
MLLYEKAHEEIARRATALQTMQRQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSLIQKAIAGITSYIWKMERGSHLQNSPSTVWDTALLSYALQEAHVPKDHKMIQQTITYLLKKQHTKKADWSVHALALTPGGWGFSDVNTTIPDVDDTTAVLRALARSRGNENIDNAWKKGVNWIKGLQNNDGGWGAFEKGVTSKLLANLPIENASDMITDPSTPDITGRVLELFGTYTQNELPKKQKQSAINWLMNVQERNGSWYGKWGICYIYGTWAVMTGLRSLGIPSNNPSLKRAALWLEHIQHEDGGWGESCQSSVEKRFVTLPFSTPSQTAWALDALISYYDKETPTIRKGVSYLLANPYVNEKYPTGTGLPGGFYIRYHSYAQIYPLLTLAHYTKKYQK

SEQ ID NO: 98613 - DNA, 2193 bp, Geobacter sulfurreducens
  CDS (1)..(2193)
atggcaaagggtatactcaacaagtttgccgtgatagccggcaccaagaaggccggacctccggccggggaagaacgcaccgtcatcgcacccataaaagagatatcgggaaaggccgtccactgcagtcaggctgtcaaaaaggcggaggagtatctcctggcgctccagaacccggaggggtactgggttttcgagctagaagcggacgtcacgataccgtctgagtacatcatgcttcagcggttcctcggcagggagatttccccggaactggggaagcggctggagaactatctcctggaccggcaactgcccgacggcggctggcccctctacgccgaggacggattcgccaacatcagcgccacggtcaaggcgtatctcgccctcaaggtgctggggcattcaccccaggcaccccacatgatacgcgcgcgcctcatggtcctcagcctcggcggcgcggccagatgcaatgtgttcacgcgcatcctgctggccctgttcggtcagattccctggcataccccgccggcaatgcccgtggaaatcgtgcttctcccccagtggtttttcttccatttgagcaaagtctcctactggtcgagaaccgtcattgtccctctgctgctgctctacgccaaacagcccgtgtgtcggctgcggcccgaggaggggatccccgaactgttcagcacgccgcccgataaactgcgtcacctggatggctttcaaccggggtactggcggaaaaacgccttcatcatctttgaccgcctgctcaagcgcttcaaccgattcattccttccgccctgcaccggaaagccattgccgaagcagaacagtggaccaggtcccacatgcagggcagcggcgggatcggcgccattttcccggccatggcctatgcggtcatggccctccgcgtactcggctgcggagaaggggaccctgactatattcgcggactgcaggccatcgacgacctgctccagcaccggactccgcaggaagcagaccccccccgcacagacggtacgtgcattgacagcggcatgtcggcggcttttgccctcaccccctctgcccacgcggcagcggacggtacagggagcagcagcatctgccagccgtgcaattctccgatctgggacacctgcctgagcctttcggcgctcatggaagcgggcatgcccgcgagccaccccgcggcgacgcaggctgttgaatggctcttgtcacagcagatcctctcgcccggcgactggtcgctgaaggtgcccgacctggaggggggcggatgggcgttccagttcgagaacaccctctaccccgacctggacgacacctcgaaggtcatcatgtcgcttctacgggccggcgcgctggagaatgagcgctatcgcgaccggatcgcccgcggcgtgaactgggtgctcgggatgcagagcagtgacggcgggtgggccgcctttgacatcgacaacaactaccactacctgaacgacatcccgttcgccgaccatggggcgctcctcgacccgagcacatctgacctgacgggacgctgcatcgagcttctctccatggtcggtttcgacaggacgtttccgcccatcgcgcgggggatcgggttcctgcgctcggaacaggaagaaaacggcgcctggttcggccgctggggggtgaactacatctacggtacctggtcggtgctgtcaggcctcaggcaggccggtgaagatatgcagcagccctatatccgcaaggcggtgggatggctggcgtcatgccagaaccacgacggtggatggggagaaacctgctattcctatgacgatccttcgctggccggcaagggggcaagcaccccgtcccagacggcctggagcctcctggggctcatggccgcgggagaagtcaacagcttggccgttcggcggggtgtacgctacctgctcgaccaccagaaccaatggggaacctgggaggaaaaacattttaccggaaccggtttcccgagggtcttttacctgcgctaccacgggtaccgccacttctttcccctgtgggcgctcggcgtctattcacggctcagctcaggacaaaaggcctgtcaggacgagcgtcgccatgcatcccccggcgacctccatctgccttggctggagaggatcaagaaacgataa

SEQ ID NO: 98614 - protein, 730 aa, Geobacter sulfurreducens
MAKGILNKFAVIAGTKKAGPPAGEERTVIAPIKEISGKAVHCSQAVKKAEEYLLALQNPEGYWVFELEADVTIPSEYIMLQRFLGREISPELGKRLENYLLDRQLPDGGWPLYAEDGFANISATVKAYLALKVLGHSPQAPHMIRARLMVLSLGGAARCNVFTRILLALFGQIPWHTPPAMPVEIVLLPQWFFFHLSKVSYWSRTVIVPLLLLYAKQPVCRLRPEEGIPELFSTPPDKLRHLDGFQPGYWRKNAFIIFDRLLKRFNRFIPSALHRKAIAEAEQWTRSHMQGSGGIGAIFPAMAYAVMALRVLGCGEGDPDYIRGLQAIDDLLQHRTPQEADPPRTDGTCIDSGMSAAFALTPSAHAAADGTGSSSICQPCNSPIWDTCLSLSALMEAGMPASHPAATQAVEWLLSQQILSPGDWSLKVPDLEGGGWAFQFENTLYPDLDDTSKVIMSLLRAGALENERYRDRIARGVNWVLGMQSSDGGWAAFDIDNNYHYLNDIPFADHGALLDPSTSDLTGRCIELLSMVGFDRTFPPIARGIGFLRSEQEENGAWFGRWGVNYIYGTWSVLSGLRQAGEDMQQPYIRKAVGWLASCQNHDGGWGETCYSYDDPSLAGKGASTPSQTAWSLLGLMAAGEVNSLAVRRGVRYLLDHQNQWGTWEEKHFTGTGFPRVFYLRYHGYRHFFPLWALGVYSRLSSGQKACQDERRHASPGDLHLPWLERIKKR

SEQ ID NO: 98615 - DNA, 2040 bp, Geobacter sulfurreducens
  CDS (1)..(2040)
atgaaaatctcaaaaaatcccatttcgcacgcactcacttcgttcaatgatgcggcacgggaaacagctgacaatagtgccgcacgcaagtcggggaaaatccaccacctccccgccaccatttggaaaaaaaaggaatcgacggtatcgagccctctcgatatagctatcgagcggacccaggaattctttttccgcgagcagctccccgccggctactggtgggccgagctggaatccaacgctactataaccgccgaatacatcatgctgttccacttcatggggctggttaaccgtgaaaaagagcggaagatggccaattaccttctccgccagcagactacggagggctactggaccatctggcacggcggtcccggcgacctttccaccacaatcgaggcctatttcgccctgaagctcgccggctacccggccgatcatccgtccatgagcaaggcccgggcgttcatcctagagcacggcggcatcctcaaggcgcgggtcttcaccaagatattccttgccctgttcggggagttctcctggctgggggttccctccatgcccatcgagatgatgctgctccccgccggcttcaccttcaacatgtacgagttttccagctggtcacgggcaacgatcatccccctctccatcgtcatggcggagcggccggtgcgcaagctgcccccctgggcccgggtgcaggagctttacgtgcgccccccgcggcccacggactataccttcaccaaggaagacggtatcctcacctggaagaacatcttcatcggcatcgaccacgtactgaaggtgtacgaggcgagccccatccggccgggcaggaagaaagccatggccatcgccgagaagtgggtgctcgagcaccaggagcccaccggcgactgggggggcatccagcccgccatgctcaactcggtgctggcgctccacgtactcggttacgccaacgaccatccggccgtggccaaggggctgcaggccctggccaacttctgcatcgagggtgaggacgaactggtcctccagtcctgcgtctcgccggtatgggatacggccctgggcctcatggccatggtcgactcgggagtccccaccgatcacccttccctctccaaggcggcccaatggcttctggaccgtgaagtccgcaggccgggcgactggaagatcaagtgtcccgatctggagcccggcggctgggccttcgagttcatgaacgactggtatcccgatgtggacgactcgggtatcgtcatgatggccatcaaaaacgtgaaggttaaggaccagcgggccaaagaggacaccatcacccgcggcatcgcctggtgcctgggcatgcagagcaagaacggcggctggggggcctttgacaaggacaacaccaagcacatcctcaacaagatccccttcgccgacctggaggccctcatcgacccccccacggcggatctgaccggccgcatgctggagctcatggggacctacggttatcccaaggaccacccagcggcggtcagggcgctgaagttcatccgtgagacccaggaacccgacggtccctggtggggacggtggggggtaaattacatctacggcacttggtcggtcatgtccggacttgccgcctttggcgaagacatgagccagccttggatccgcaaggccgtggactggctcgtggagcaccagaacgaagacggcggctggggcgagtgttgcgagtcgtacgccgatccccggctggccggcgtcgggcccagcacggcgtctcagacaggatgggcccttctcacgctccttgccgccggcgaggtggcaagctcgtccgtggtgcggggagtccagtatctcctcgacacccagaagcccgacgggacctgggacgaggacgccttcaccggcacgggcttcccgaaatttttcatgatcaagtaccacatctaccggaactgcttccctctcatggcgctgggacgctaccggacgcttgcgggcaaagggctctga

SEQ ID NO: 98616 - protein, 679 aa, Geobacter sulfurreducens
MKISKNPISHALTSFNDAARETADNSAARKSGKIHHLPATIWKKKESTVSSPLDIAIERTQEFFFREQLPAGYWWAELESNATITAEYIMLFHFMGLVNREKERKMANYLLRQQTTEGYWTIWHGGPGDLSTTIEAYFALKLAGYPADHPSMSKARAFILEHGGILKARVFTKIFLALFGEFSWLGVPSMPIEMMLLPAGFTFNMYEFSSWSRATIIPLSIVMAERPVRKLPPWARVQELYVRPPRPTDYTFTKEDGILTWKNIFIGIDHVLKVYEASPIRPGRKKAMAIAEKWVLEHQEPTGDWGGIQPAMLNSVLALHVLGYANDHPAVAKGLQALANFCIEGEDELVLQSCVSPVWDTALGLMAMVDSGVPTDHPSLSKAAQWLLDREVRRPGDWKIKCPDLEPGGWAFEFMNDWYPDVDDSGIVMMAIKNVKVKDQRAKEDTITRGIAWCLGMQSKNGGWGAFDKDNTKHILNKIPFADLEALIDPPTADLTGRMLELMGTYGYPKDHPAAVRALKFIRETQEPDGPWWGRWGVNYIYGTWSVMSGLAAFGEDMSQPWIRKAVDWLVEHQNEDGGWGECCESYADPRLAGVGPSTASQTGWALLTLLAAGEVASSSVVRGVQYLLDTQKPDGTWDEDAFTGTGFPKFFMIKYHIYRNCFPLMALGRYRTLAGKGL

SEQ ID NO: 98617 - DNA, 2190 bp, Ashbya gossypii
  CDS (1)..(2190)
atgctatactcagatgaactaggattgccaactaccgactcgaggcgttggaggcttttctgcgatgaggtgggtgcggagcggtgggagtacatggatgagcaagagacaagcaaggttccgcaaacgacgtgtgtgcagtggttgctgaatgtcccgagctttccgacacctgaaccagaggtgagcagtaaagaccagggatttactgcggcaaatgcggcgtacaacggggcgcggtttctgggcctgctgcaggacgaggcttcgggcacgttcccctgctcgtacaggggcccgatgttcatgactatcgggtatgtggtggcgatgcatgtgggcggggtggtaatccctgagcctcagcggcgggagctagtgcgctacgtggtgaacacggcacaccctgtcgacggcgggtggggattgcattcggaggacaagtcgactgtgatgggcaccgcgctgaactacgttctgctgcggctcttagggatggagcgcgaacacatcgtgatgcagcgggcgcggaagaccctgctgcgcatggggggtgctattggctcgccgtactggggtaaagtgtggctttccgtgctcaatttatacaagtgggagggcgtgaacccagcgccaccagagctatggctgctgccgtaccagtttccttatcacccggctcgctggtgggtacatacgcgtgctatctttttgccgatgagctacctggcaggggtccgctaccagtgtgctctgacgccattactggaggagatcaggtccgagatatttacgaggccattcgaagagattgactttgctgccaacaggaacaatgtgtgcggtattgacctctactacccgcatacgaccgtacttaacacgctcaacaaatgcattgtggggtatgaaaagtacttgcgccccaactggctactaaaatactctcttaacagaatatatgagctgattaagatggaaatccagaatactgactacctctgtattgcaccggttaataatgctctgaatgccattgtaacgtgtatcgaagagggccctgactcagcggagttcggtcgctttcttgacagatttaaggaggtcctgtttctcggtcctcaaggcatgctggtaatgggaactaacggtgttcaagtgtgggattgtgccttctatatacagtcaatgtttgccgccaacttgcaagacaagcccgagttttatgaaaacatcgttagggcgtaccgctttctctgtcgttcacagatcactgatgattgtgttcccggcagctacagggatcctcgtattggtgcttggcccttttctactaaaacccaaggttacgcagtttcagattgtacggctgaggcggccaagtctgtcttgcttgtgcggaattctccagttttcaaggaggtgcgggacgagatatcgagcgagaagctgcaaaaggccattgatgcgcttttgggtttgcaaaatcttggatcattcaagtatggctcattcgcttcttatgagaagatcagagcgccattatcgattgagagtttgaattctgcggaggtgtttgctaatataatggttgagcatccgtatgttgaatgtaccgattcatccgtactaggcttatcgttctatcgcaaataccacgattatcgccaagatgaggtcgaccacgccatcaagatcgctgtcaagtttataaagagtgcccaagagaaggatggttcgtggtatggatgctggggtatttgctatacatatgctggaatgtttgcgcttgaagcgcttcataacgccggcgaaagctacgcggactcggaagtagtaaagaaggggtgtgagtttctggtaagcaagcagttgcccgatggcggttggagtgagacaatgaaatcttcagaactgcacacgtacgtcagtgacaagaggtcatacgttgttcaaactgcatgggctttgattggtttgctgctagccgattatccggatagaaaagtgattgaccgtggcattcaactgcttaaggaaagacaattgccctctggtgaatggaagtatgagagtattgagggtgttttcaatcattcatgtgccattgagtacccaagttaccgatttgtgtttccaataaaggccctaggaatctatagcaaaaaatacgccaaagacgctttgtag

SEQ ID NO: 98618 - protein, 729 aa, Ashbya gossypii
MLYSDELGLPTTDSRRWRLFCDEVGAERWEYMDEQETSKVPQTTCVQWLLNVPSFPTPEPEVSSKDQGFTAANAAYNGARFLGLLQDEASGTFPCSYRGPMFMTIGYVVAMHVGGVVIPEPQRRELVRYVVNTAHPVDGGWGLHSEDKSTVMGTALNYVLLRLLGMEREHIVMQRARKTLLRMGGAIGSPYWGKVWLSVLNLYKWEGVNPAPPELWLLPYQFPYHPARWWVHTRAIFLPMSYLAGVRYQCALTPLLEEIRSEIFTRPFEEIDFAANRNNVCGIDLYYPHTTVLNTLNKCIVGYEKYLRPNWLLKYSLNRIYELIKMEIQNTDYLCIAPVNNALNAIVTCIEEGPDSAEFGRFLDRFKEVLFLGPQGMLVMGTNGVQVWDCAFYIQSMFAANLQDKPEFYENIVRAYRFLCRSQITDDCVPGSYRDPRIGAWPFSTKTQGYAVSDCTAEAAKSVLLVRNSPVFKEVRDEISSEKLQKAIDALLGLQNLGSFKYGSFASYEKIRAPLSIESLNSAEVFANIMVEHPYVECTDSSVLGLSFYRKYHDYRQDEVDHAIKIAVKFIKSAQEKDGSWYGCWGICYTYAGMFALEALHNAGESYADSEVVKKGCEFLVSKQLPDGGWSETMKSSELHTYVSDKRSYVVQTAWALIGLLLADYPDRKVIDRGIQLLKERQLPSGEWKYESIEGVFNHSCAIEYPSYRFVFPIKALGIYSKKYAKDAL

SEQ ID NO: 98619 - DNA, 2562 bp, Panax ginseng
  CDS (48)..(2357)
ggccattacggccggggaccacataccaacaagtagtagacttaagaatgtggaagctgaaggttgctcaaggaaatgatccatatttgtatagcactaacaactttgttggcagacaatattgggagtttcagcccgatgctggtactccagaagagagggaagaggttgaaaaagcacgcaaggattatgtaaacaataagaagctacatggaattcatccatgcagtgatatgctgatgcgcaggcagcttattaaagaaagtggaatcgatctcctaagcataccgccgttgagattagatgaaaacgaacaagtgaactacgatgcagttacaaccgctgtgaagaaagctcttcgattgaaccgggcaattcaagcacacgatggtcactggccagctgaaaatgcaggctctttactttatacacctccccttatcattgccctatatatcagcggaacgattgacactattctgacaaaacaacacaagaaggaactgattcgcttcgtttacaaccatcaaaatgaggatggtggatggggatcctatattgaggggcacagcacgatgattgggtcagtacttagctacgtgatgttacgtttgctaggagaaggattagctgaatctgatgatggaaatggtgcagttgagagaggccggaagtggatacttgatcatggaggtgcagccggcataccctcttggggaaagacttatctagcggtgcttggagtatatgagtgggaagggtgcaacccgctgcccccagaattctggcttttcccttcaagttttccttttcatccagcaaaaatgtggatctactgccggtgcacttacatgccaatgtcgtatttgtatgggaagagatatcatggaccaataaccgatcttgttttatctttgaggcaagaaatttacaacattccttatgagcagataaagtggaatcaacagcgccatatctgttgcaaggaggatctctactaccctcatacccttgtacaagacctggtttgggatggtcttcactactttagtgaaccattcctcaaacgttggcccttcaacaaactgcgaaaaagaggtctaaaaagagttgttgaactaatgcgctatggtgccaccgagaccagattcataaccacaggaaatggggaaaaagctttacaaataatgagttggtgggcagaagatcccaatggtgatgagtttaaacatcaccttgctagaattcctgatttcttatggattgctgaggatggaatgacagtacagagttttggtagtcaactatgggactgtattcttgctactcaagcaattatcgccaccaatatggttgaagaatacggagattctcttaagaaggtgcatttcttcatcaaagaatcgcagataaaagaaaatccaagaggagacttcctaaaaatgtgtcgacagtttaccaaaggtgcgtggactttctctgatcaagatcatggttgcgttgtctcggactgcacagctgaagcactaaagtgcctactgttactttcacaaatgccacaggatattgtcggagaaaaacctgaggttgagcgattatatgaggctgtgaatgttcttctctatttgcagagtcgtgtaagtggtggtttcgcagtttgggagcctccagttccaaaaccatatttggagatgttgaatccttcagaaatttttgcagacattgttgttgagagagagcacattgaatgcactgcatctgtaatcaaaggtctgatggcatttaaatgcttgcatcctgggcatcgtcagaaagagatagaggattctgtggcgaaagccatccgttatcttgaaagaaaccaaatgcctgatggttcatggtatggcttttggggaatttgtttcctctatgggacattttttaccctatctgggtttgcttctgctgggaggacttatgacaacagtgaagcagttcgtaagggtgttaaatttttcctttcaacacaaaatgaagaaggtggttggggggagagtcttgaatcatgcccaagcgaaaaatttacaccactcaagggaaacagaacaaatctagtacaaacatcatgggctatgctaggtcttatgtttggtggacaggccgagagagatccgacacctctgcatagagcagcaaagttgttgatcaatgcgcaaatggataatggagatttccctcaacaggaaattactggagtatactgtaaaaatagtatgttacattatgcggagtacagaaatatatttcctctttgggcactcggagaatatcggaaacgtgtttggttgcctaagcaccagcagctcaaaatttaagttacattcttatgattcttcaaaatgttttgataggatgaattaatgcgctaaattccacactagtatcgtctccaaataaattagaaaaattaaggagcttctagcttccagcttctggcttcagttgtgttgtgtactgtattaatttggacggccttttaagctctcaaataaataataaatcggaaataggtgttgtttg

SEQ ID NO: 98620 - protein, 769 aa, Panax ginseng
MWKLKVAQGNDPYLYSTNNFVGRQYWEFQPDAGTPEEREEVEKARKDYVNNKKLHGIHPCSDMLMRRQLIKESGIDLLSIPPLRLDENEQVNYDAVTTAVKKALRLNRAIQAHDGHWPAENAGSLLYTPPLIIALYISGTIDTILTKQHKKELIRFVYNHQNEDGGWGSYIEGHSTMIGSVLSYVMLRLLGEGLAESDDGNGAVERGRKWILDHGGAAGIPSWGKTYLAVLGVYEWEGCNPLPPEFWLFPSSFPFHPAKMWIYCRCTYMPMSYLYGKRYHGPITDLVLSLRQEIYNIPYEQIKWNQQRHICCKEDLYYPHTLVQDLVWDGLHYFSEPFLKRWPFNKLRKRGLKRVVELMRYGATETRFITTGNGEKALQIMSWWAEDPNGDEFKHHLARIPDFLWIAEDGMTVQSFGSQLWDCILATQAIIATNMVEEYGDSLKKVHFFIKESQIKENPRGDFLKMCRQFTKGAWTFSDQDHGCVVSDCTAEALKCLLLLSQMPQDIVGEKPEVERLYEAVNVLLYLQSRVSGGFAVWEPPVPKPYLEMLNPSEIFADIVVEREHIECTASVIKGLMAFKCLHPGHRQKEIEDSVAKAIRYLERNQMPDGSWYGFWGICFLYGTFFTLSGFASAGRTYDNSEAVRKGVKFFLSTQNEEGGWGESLESCPSEKFTPLKGNRTNLVQTSWAMLGLMFGGQAERDPTPLHRAAKLLINAQMDNGDFPQQEITGVYCKNSMLHYAEYRNIFPLWALGEYRKRVWLPKHQQLKI

SEQ ID NO: 98621 - DNA, 1899 bp, Bacillus subtilis
  CDS (1)..(1899)
atgggcacacttcaggagaaagtgaggcgttttcaaaagaaaaccattaccgagttaagagacaggcaaaatgctgatggttcatggacattttgctttgaaggaccaatcatgacaaattccttttttattttgctccttacctcactagatgaaggcgaaaatgaaaaagaactgatatcatcccttgcagccggcattcatgcaaaacagcagccagacggcacatttatcaactatcccgatgaaacgcgcggaaatctaacggctaccgtccaaggatatgtcgggatgctggcttcaggatgttttcacagaactgagccgcacatgaagaaagctgaacaatttatcatctcacatggcggtttgagacatgttcattttatgacaaaatggatgcttgccgcgaacgggctttatccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcaccatctcgatccgcacatgacaaaaaatcctttcacttggcttcggtctgatgctttcgaagaaagagatctcacgtctattttgttacattggaaacgcgtttttcatgcaccatttgcttttcagcagctgggcctacagacagctaaaacgtatatgctggaccggattgaaaaagatggaacattatacagctatgcgagcgcaaccatatatatggtttacagccttctgtcacttggtgtgtcacgctattctcctattatcaggagggcgattaccggcattaaatcactggtgactaaatgcaacgggattccttatctggaaaactctacttcaactgtttgggatacagctttaataagctatgcccttcaaaaaaatggtgtgaccgaaacggatggctctgttacaaaagcagccgactttttgctagaacgccagcataccaaaatagcagattggtctgtcaaaaatccaaattcagttcctggcggctgggggttttcaaacattaatacaaataaccctgactgtgacgacactacagccgttttaaaggcgattccccgcaatcattctcctgcagcatgggagcggggggtatcttggcttttatcgatgcaaaacaatgacggcggattttctgctttcgaaaaaaatgtgaaccatccactgatccgccttctgccgcttgaatccgccgaggacgctgcagttgacccttcaaccgccgacctcaccggacgtgtactgcactttttaggcgagaaagttggcttcacagaaaaacatcaacatattcaacgcgcagtgaagtggcttttcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacatccgtctgttgtgaaaggcatgcaataccttaccgacagcagttcgcatagcgccgatagcctcgcgtatccagcagggatcggattgccgaagcaattttatattcgctatcacagttatccatatgtattctctttgctggctgtcgggaagtatttagattctattgaaaaggagacagcaaatgaaacgtga

SEQ ID NO: 98622 - protein, 632 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGVDRKHPGIQKALRWLKSIQNDDGSWGESCKSAEIKTYVPLHRGTIVQTAWALDALLTYENSEHPSVVKGMQYLTDSSSHSADSLAYPAGIGLPKQFYIRYHSYPYVFSLLAVGKYLDSIEKETANET

SEQ ID NO: 98623 - DNA, 2505 bp, Oryza sativa
  CDS (1)..(2505)
atgcacccagttgcatcagactcgcatgaccaggaggcagaggaagccagaacaaggctcatgctcatcatgcacgcagaagccatttctctcatgctttcagctgccaagcttcacccagcacggcttgcgaatagtttctacaatatgtggaagctcaagattgccgagggaggaccatggctaaagagtggaaacagtcatgttggaagagaaacatgggaatttgacccaaattttggaacaagtgaagagcgggaggcggttgaggctgcacggatagagttccagaagaataggttcagaacaagacacacctccgatgttttggctcgcatgcagttagctaaggcgaacaacttcagtattgatctacagaaagaaaaagatggaaaccccataaatattgacacagctacagtatcagatatactgaagaaggcactcagttatttctcagccatacaggcatatgatgggcactggccaggggatttcccaggcccactgtttaccactgcaaccatgatcatagttctatatgtcacagagtcattaactattacactgtcatcggaacatcacaaggagatctgtcgatatctgtacaatcgtcagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcggtgcttggagtttttgactggtcaggtgtaaatcctattcccccagaattatttcttcttccatctttcgttcctatccaaccaggacgattatggagtcacttccgaatggcttttattcccatgtcttatttgtatggaaaaaagtttgtcggtcctataacaagattggttatatcattaagggaagagctacatattcatccctataaaaagattgactggaaggaggcacgcaaattatgtgcaaaggaagatgcctataatccacatatgtggctacaagagtgcctatctgactgcctttatagttttggtgagccgtttcttacacgttggccaatttcctacatgagaaaaagagctctataccaaattgctgagttcttgaagtatgaagatgaaaattctcagtatatctgcattggtgctgcacagaaggcattatccatgttgtgctgttggattgaaaatcccaattcagatgcattcaagcgtcatttggctagagtagctgattttctatgggttggcgaagatggcatgaaagttcgggtctgtgcgggtcaattatgggatgttgctttcgcagtccaagcgatattagcgtgtagcatcgcagaagaatttggaagtacccttaagaaagcacatggtttcataaaaacttcccagattatggacaatccttctggtgacttcagcagaaagtaccgtcacatatctaaaggaggatgggccttccaggttgcagatcaggggtggcaggtttcagattgcacagcagaagctcttaaggctttgctactgctgtcaaagtgtttgtcagatggtgcagattatcaaatggaaacctactgctactttgacgcggtgaatgtattactctcgttacagaacccaaatggtgggtatggagcatgggagctagctcgcacatatccatggatggagtcacaaggcatacttcagagcattaggactatcaaaggtgaaggagagtacgtagagtgtacctcatcagtcatccaagcattggcattgttccgggagaagtaccctgggcatcggaaagatgaaatagatcaatgcatcaggaaagcaacagaattcatcgagaagttacagaatgatgatggatcatggtttggatcatggggtatttgcttcacgtatggaacatggtttgcaatagagggtctgtcagccgtggggcagtgttatgatgacagcacctgcattcggaaagcctgtaagtttctgttatcaaagcaactaacaaatggtggatggggggagagtcatctttcatccagaaccaaggcatacacaaacctagatggggagaaatcacatatagtcaatactgcatgggcaatgttggcactcatgaaagctggacaggtagagagagaccccgctcctctgcacaaagcagcaagacttatcatgagcatgcagctcagtgatggtgactttccacaagaggaaatgatcggaagtttcttgaaaaatggccccttgtgttatatggcttatcgcaatatattcccaatatgggctcttggagagtatcagaaattagtatttcagaactatcagacctctagcatcaagcaaacaaatatagctccatctgctggcaatgctgctctgaagaattcagcaagtacaacagcgccaacttga

SEQ ID NO: 98624 - protein, 834 aa, Oryza sativa
MHPVASDSHDQEAEEARTRLMLIMHAEAISLMLSAAKLHPARLANSFYNMWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNRQNIDGGWGLHAEGESSMLSTALNYTALRLLGENVDDGPDISMHKARKWIHDHGGATMIPILGKVWLSVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQKALSMLCCWIENPNSDAFKRHLARVADFLWVGEDGMKVRVCAGQLWDVAFAVQAILACSIAEEFGSTLKKAHGFIKTSQIMDNPSGDFSRKYRHISKGGWAFQVADQGWQVSDCTAEALKALLLLSKCLSDGADYQMETYCYFDAVNVLLSLQNPNGGYGAWELARTYPWMESQGILQSIRTIKGEGEYVECTSSVIQALALFREKYPGHRKDEIDQCIRKATEFIEKLQNDDGSWFGSWGICFTYGTWFAIEGLSAVGQCYDDSTCIRKACKFLLSKQLTNGGWGESHLSSRTKAYTNLDGEKSHIVNTAWAMLALMKAGQVERDPAPLHKAARLIMSMQLSDGDFPQEEMIGSFLKNGPLCYMAYRNIFPIWALGEYQKLVFQNYQTSSIKQTNIAPSAGNAALKNSASTTAPT

SEQ ID NO: 98625 - DNA, 1914 bp, Gloeobacter violaceus
  CDS (1)..(1914)
atgcaagtccaaccgcgcatcgaaaaaaagcacctagatagtgcgatcgaagcgagccaggcgtacctgttggctcggcagtactccccgggctactggtgggccgaactggagtcgaacgtgtcgatgaccgccgaggtggtcctcctgcacaaaatctggcgcacggacaccggccgtcccctcgccaaggcgaccgcccacctgctcgctgagcagcgcgcccacggcggttgggagctgttctacggcgacggcggcgatctgaacacatcgatcgaggcgtacatggccctgaagctgctgggcctcaccgccgatcaccccgccctggcgcgcgcccgcgcatttatcctcgccaaaggcggcatcagccgcgcgcgcatcttcaccaagatccatctggcgctcatcggctgctacgactggcgcggcgtcccgtcgattccgccctgggtgatgctgctacctgaggcctttccggtcaatatctacgagatgtccagttgggcgcgcggcagcacggtaccgctgctgatcgtcttcgaccgcaagccggtctttgccgtcgagccggccattaccctcgacgagctatttgtcgaaggacgcgcccaggcccgcttcgatctgccccgcagttcgagcgactggtgggcgaatctgtttgtcgatctcgactggggcttcaagctcgccgagagcctgggggcggttcccctgcgcgaagaagggctgaaagccgccgagcgctgggtgctcgagcgccaggaggcgaccggtgattggggtgggatcatcccggcgatgctcaattcgctgctggcgctgcgctgcctcgattacgatccccacgacccggtggtcgagcggggaatggccgcggtcgatcgcttcgccatcgagaccgaaagcacctatcgcctgcagccgtgcgtctcccccgtctgggacacagccctgaccatgcgcgccctggtcgattcgggattgcccccggatcacccggccctcgcggcggccggcacctggctgctgaagaagcagatcctcgactacggcgattgggcggtcaaaaaccggaccggtccgcccggcggctgggctttcgagttcgacaaccgcttctacccggatgtggacgacacggccgtcgtggtgatggccctcgacgccgtgcggctggccgacgagaccgccaagggccaggcgatcgcccgggcggtgtgctgggtggcctcgatgcagtgccggggcgggggctgggcggccttcgatatcgacaacgacgcccactggctcaacagccttccttacgccgatctcaaggcgatgatcgacccgaacaccgccgatgtcaccgcccgcgtcctcgagatgtacggccgctgccgcctgattcccgcggccgccggtgcccagcgcgccctcgattatctgcggcgcacccaggagccggagggctgctggttcggccgctggggggtgaattatctctatggcaccagcggcgtgctctcggccctggccgctttcgccccggccgaacgcacggccatcgagcgcgctgccgcctggctgcggggttgccagaacaccgacggcggttggggggaaacctgcgggagttatgtcgatcgcactttgatgggccagggaccgagcaccgcttcccagactgcctgggcgttgctcggcctcatcgacgcgagccgggtggcccgcttcagcgacagcagcgccctcgaacgcggccttgcctatctggtggaaacccaaaaagcggacggcagctgggacgagccctacttcaccggcaccggttttccggggcatttttacctgaagtatcacctctatcagcagcactttcccctgagtgccctcggccgctaccgccgcctgctcagttaa

SEQ ID NO: 98626 - protein, 637 aa, Gloeobacter violaceus
MQVQPRIEKKHLDSAIEASQAYLLARQYSPGYWWAELESNVSMTAEVVLLHKIWRTDTGRPLAKATAHLLAEQRAHGGWELFYGDGGDLNTSIEAYMALKLLGLTADHPALARARAFILAKGGISRARIFTKIHLALIGCYDWRGVPSIPPWVMLLPEAFPVNIYEMSSWARGSTVPLLIVFDRKPVFAVEPAITLDELFVEGRAQARFDLPRSSSDWWANLFVDLDWGFKLAESLGAVPLREEGLKAAERWVLERQEATGDWGGIIPAMLNSLLALRCLDYDPHDPVVERGMAAVDRFAIETESTYRLQPCVSPVWDTALTMRALVDSGLPPDHPALAAAGTWLLKKQILDYGDWAVKNRTGPPGGWAFEFDNRFYPDVDDTAVVVMALDAVRLADETAKGQAIARAVCWVASMQCRGGGWAAFDIDNDAHWLNSLPYADLKAMIDPNTADVTARVLEMYGRCRLIPAAAGAQRALDYLRRTQEPEGCWFGRWGVNYLYGTSGVLSALAAFAPAERTAIERAAAWLRGCQNTDGGWGETCGSYVDRTLMGQGPSTASQTAWALLGLIDASRVARFSDSSALERGLAYLVETQKADGSWDEPYFTGTGFPGHFYLKYHLYQQHFPLSALGRYRRLLS

SEQ ID NO: 98627 - DNA, 1794 bp, Stigmatella aurantiaca
  CDS (1)..(1794)
atggggcgtgagttcgagcccgcgcagcgcgaagggctcattgtctaccttcgcaaccaccagaatgccgatggaggctgggggctggatgtcgagagccccagccaggtcttcacctcggtgctcaactacgttgccctccggttgctgggggtcgacgcgggtgatgccgggctgcgcagggcgaggcagtggtttctcccccggggagggcctctgagcagtggggcgtgggggaagatcatcctcgcgctgctggggttgtatgaatacaacggcttgcagccgatgcctcccgagctctggctgttgcccgaatcgctgccctttcatccctccaagctctggtgccactgccgcatggtgtacctgcccatgagctggttgtatgggcggagggcccgggcttccgagacgccgctgctcgcggccatccggaacgagattttcgaaggggcctatgaccaggtggactgggtcgccgcgcgcgcgcgcgtgtctccgacggacgtctatacaccgcgtaccctgtggctcaaggtcgccaaccaagcgatgtatggctatgagtggcttgcgggaaagcagctccgggcccgagcgctcgatttcgcgctggagcagatccgcgccgaggacgaggcaacccatttcatttgcattggccccatcaacaaagtgctcaacatggtggtctggcacttcgtcaaccccgaggggcccgaggtgcgcgcgcacttggagcggttgccggactacttcttcgaggcggccgacggcatcaagatgaacggctacaactcgtcggagttgtgggacacgtccttcgccgttcaggcggcggtcgcgacgggggaggtggagcgttgccggccgatgttggcggaagccgctcggttcatcgaagcgaatcaggtgctcgaggacacgcctgagcccgagcgcttcttccggcaccccagcaaggggggctggccgttcagcacccgggaccatggatggcccatcagtgattgcacggcggaggggctcaaggcctcgcttgcgctcgagcccctggggctcaaccgcgtgccccaggcccgtctccaggacgcggtgcagttcatcctctcgatgcagaacaaggacgggggctgggccacctacgagctccagcgtggcccgctggcactcgaggtgctgaacccctcggatgtcctttccaccatcatggtggacgtcagctatgtggagtgcacctcggcctgcgtgcaggcgctggccgcctggcgcaagcaccaccaggttcaggatgcgcgcgtggacctcgccatttcgcggggggcggagttcatccgccgggcccagcgggaggatggctcctggatcggttcctggggcgtctgcttcacatatgggacgtggttcggggtaacgggcctgatcgccgccggggtcagccccggcgacatggtccttcgcagggctgcggctttccttcgctcgcatcagcggtccgatggctcctggagtgaggtcgtcgaaagctgtcggcagggacggtggatcgaaggcacgcatgggcatgccgtcaacacctcgtgggcgctgctgacgcttgcgtccgtgggcgagcagaactccgaggccgttcggcgaggcattcgatggctcagggaccgtcagcaggaggacggccgttggccacccgagcccatcgtcggcatcttcaatcggacatgtgccattcattacgacgcttatctgcggatcttccctgtctgggcgctcgccgtgtgcgacaagcggtag

SEQ ID NO: 98628 - protein, 597 aa, Stigmatella aurantiaca
MGREFEPAQREGLIVYLRNHQNADGGWGLDVESPSQVFTSVLNYVALRLLGVDAGDAGLRRARQWFLPRGGPLSSGAWGKIILALLGLYEYNGLQPMPPELWLLPESLPFHPSKLWCHCRMVYLPMSWLYGRRARASETPLLAAIRNEIFEGAYDQVDWVAARARVSPTDVYTPRTLWLKVANQAMYGYEWLAGKQLRARALDFALEQIRAEDEATHFICIGPINKVLNMVVWHFVNPEGPEVRAHLERLPDYFFEAADGIKMNGYNSSELWDTSFAVQAAVATGEVERCRPMLAEAARFIEANQVLEDTPEPERFFRHPSKGGWPFSTRDHGWPISDCTAEGLKASLALEPLGLNRVPQARLQDAVQFILSMQNKDGGWATYELQRGPLALEVLNPSDVLSTIMVDVSYVECTSACVQALAAWRKHHQVQDARVDLAISRGAEFIRRAQREDGSWIGSWGVCFTYGTWFGVTGLIAAGVSPGDMVLRRAAAFLRSHQRSDGSWSEVVESCRQGRWIEGTHGHAVNTSWALLTLASVGEQNSEAVRRGIRWLRDRQQEDGRWPPEPIVGIFNRTCAIHYDAYLRIFPVWALAVCDKR

SEQ ID NO: 98629 - DNA, 1854 bp, Bacillus cereus
  CDS (1)..(1854)
atgttattatatgaaaaagtgcatgaagaaatagcgagaagaacaactgcacttcaaacaatgcaacggcaagatggtacgtggcggttttgttttgaaggagcgccactaacagattgtcatatgatttttttattaaaattattaggtaaagataaagagatagaaccgtttgtaaaaagattagcatcactccaaacaaatgaaggaacatggaaattgtatgaagatgaagtgggtggtaatttatctgctacaattcaatcttatgctgccttacttgcatcgaaaaaatatacaaaagaagatgtgaatatgaagcgagcggaaatgtttataaatgagcgcggtggggtagcgcgtgctcattttatgacgaagtttttattagcgattcatggagaatatgaatatccttctctctttcatttgccaacaccaattatgtttctgcagaatgattcccctctcagtatttttgaactgagtagctcagcacgtattcatttaattccgatgatgttgtgtttaaataaaagatttcgagtagggaaaaagttattgccaaatttaaatcacattgcaggcgggggcggagaatggtttcgggaggaccggtctccagtttttcaaacgttagtaagtgacgtgaagaaaattataacgtatccactttctttgcatcataaaggatatgaggaagtagaacgttttatgaaagagcgtattgatgaaaatggaacattatatagctacgcaactgcctcgttttatatgatttatgctttacttgcattaggacattctattcaatcaccaattattcaaaaagctataacgggaatcacatcttatatatggaagatggagagagggagccatttgcaaaactctccatcaactgtatgggatacagctttactcagttatgctttgcaagaagctcaagttccgaaagcaagtaaagtgattcacaatgcatcagcatatttactaagaaaacagcaaacgaagaaagtagattggagtgtacatgcaccggatctcttcccgggtggttggggcttttcggatgtgaatacgacgattccagatattgatgatacaactgctgcgttaagagcattggcgcgaagtagagggaacgaaaatgtagacactgcttggaagcgagcggttaattgggttaaaggattgcaaaataatgatggtggttggggggcttttgaaaaaggggtaacgagccgtatattagcaaatttaccaatcgaaaatgcaagtgatatgattacagatccttctacaccagatattacaggaagggtattagaatttttcggaacgtatacgcaaaatgaattgcccgagaaacaaaaacaaagtgcgataaattggttaatgaatgtacaagaggaaaatggatcgtggtatgggaaatggggaatttgttatatatatgggacatgggcagtgttgactggtttacggtcactaggaataccatctagcgatccatcagtgaaacgagcagctttatggcttgaacatatacagcatgaagatggtggctggggagaatcttgccaaagtagtgtggaaaaaagatttgttactttgccatttagtacaccatcccaaacagcatgggcgttagatgccctcatttcttactatgataaagaaacgccagtcattcgaaaaggtatttcatatttgctctccaactcttatataaatgaaaaatatcctactggaacaggtttaccaggtgggttttatattcgttatcatagttatgctcatatatatccattgcttactttggctcattatgcaaaaaaatatagaaaataa

SEQ ID NO: 98630 - protein, 617 aa, Bacillus cereus
MLLYEKVHEEIARRTTALQTMQRQDGTWRFCFEGAPLTDCHMIFLLKLLGKDKEIEPFVKRLASLQTNEGTWKLYEDEVGGNLSATIQSYAALLASKKYTKEDVNMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYALQEAQVPKASKVIHNASAYLLRKQQTKKVDWSVHAPDLFPGGWGFSDVNTTIPDIDDTTAALRALARSRGNENVDTAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 98631 - DNA, 2001 bp, Streptomyces avermitilis
  CDS (1)..(2001)
atgacagcgacgaccgacggaagcaccggggccctgccgccccgcgctgcctcggccagcgaaccacacgacacgatcccgcaggcggccgggagtgtcggaatccaagacgccgccgcgcgcgccacacagcgcgccaccgacttcctgctctcgcggcaggacgccgagggctggtggaagggcgacctcgagacgaacgtcacgatggacgccgaggacctgctgctccgtcagttcctgggaatccaggacgagaagaccacacgagccgccggactgttcatcaggggcgagcagcgtgcggacggcacctgggccactttctacggcggccccggtgacctctccgccaccatcgaggcgtatgtcgccctgcgcctggccggtgacggcccggacgagccgcacatggcgaaggcgtccgcctggatccgcgagcggggcggcatcgcctcggcccgcgtcttcacccggatctggctcgccctgttcggctggtggaagtgggacgacctgcccgaactcccgccggaactcatctacttcccgaagtggatgccgctcaacatctacgacttcggctgctgggcgcggcagaccatcgtgccgctcaccgtcgtctcggcgaagcgtccggtgcggcccgccccgttcccgctcgatgaactgcacgccgacgcgaatgaccccaacccggccaagccccttgccccgatggtgagttgggacggattattccagcggctcgacgtcgctctgcacacgtaccgcaaggtcgcgccgcgcaggctgcgcaaggccgcgatgaacacggccgcgcgctggatcatcgagcggcaggagaacgacggctgctggggtggtatccagccgcccgccgtgtactcggtcatcgccctgtatctgctcggctacgacctcgaacaccccgtgatgcgcgaggggctggcgtcactggaccggttcgccgtgtggcgcgacgacggggcgcggatgatcgaggcctgccagtcgcccgtgtgggacacctgcctcgcgaccatcgcgctcgccgacgcgggcgtgcccgccgaccatccgcagctcgtgcgggcggcggactggatgctcggcgaggagatcgtccggcccggcgactgggcggtgaaacgtccccaactgccgccgggtggctgggcgttcgagttccacaacgacaactaccccgacatcgacgacaccgccgaagtcgtcctcgcgctgcgtcgcgtcaagcaccacgaccccgagcgcctggacaacgcgatccggcgcggggtgcgctggaacctcggcatgcagtccaaggacggcggctggggcgccttcgacgtcgacaacaccagcccgtttcccaaccggctgccgttctgcgacttcggcgaggtcatcgacccgccgtccgccgacgtcaccgcgcacgtcgtggagatgctggcgttcgagggcctgtcgcacgacccgcgcacccgccgcggcatccagtggctgctctccgcgcaggaggccaacggctcctggttcgggcgctggggcgtcaactacgtgtacgggaccgggtcggtggtccccgcgctggtcgccgccggactccccgcctcgcaccccgcgatccgccgtgccgtcacctggctggagaccgtgcagaacgacgacggcggctggggcgaggacctgcgctcctaccccgaggccgccgagtggagcggcaaaggcgcctccaccgcctcccagacggggtgggcgctgctcgcactgctcgcggcgggggagcgcgagtccaaagcggtggagcgcgggatcgaatggctcgcccagacccagcggccggacggctcctgggacgagccgtacttcaccggcaccgggttcccctgggacttctcgatcaactaccacctctaccgccaggtcttcccgctcaccgcgctcggccggtacgtcaacggcgagccgctcgtcgaggtcaaggggggttga

SEQ ID NO: 98632 - protein, 666 aa, Streptomyces avermitilis
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 98633 - DNA, 2001 bp, Nitrosomonas europaea
  CDS (1)..(2001)
atgtccatttcaccgacgttttccggatcttccctgcaaaagtcttcattatcagatcactcgaccatatcagaaccttttacggtcgttgacagggtgaacgggatttctgccgttgcactggatgatgccattacgcgcgctcgctcagctttgctggcgcaacagcgggaagatggtcactggtgtttttcgctggaagcagactgcacgattccggctgaatatatcctgatgatgcatttcatggatgaaatagataccgcactggaacgcagaattgccaatttcttgcgtaatcggcaggtaactgacgggcatggcggctggccgctgtactatggcggtgacttcgacatgagctgcagtgtcaaggtttactatgcgctgaagctggccggggattcaccggaagcagcgcacatggtccgtgcccgtaatgccatactggagcggggaggggctgcgcgctcgaatgtatttacccgcttgctgctggccatgtaccgccagattccatggcgcggtgtgccgtttgttccagctgaaatcatgctgctgccgcgctggtttccttttcatctgagtaaagtggcgtactggtcacggacggtgatggtgccactttccattctgtgtacactgaaagccaaagcagccaatccgcgtaatatccatgtacgtgaactgtttacggtcgacccggaaatggaaaaaaactattttccggtacgcaccccccttaatcacttgctgttgtatctggagcgactgggctcaaaactggaacctctgattccgtcgttcattcggcgcagagccttaaaaaaagccgagcagtggaccatcgaacggctcaatggaagagatggcctgggggcgatttttccggcgatggtcaatgcctatgaggcactgacattgctgggctacgaccatgatcatccattacttcagcaatgccgtctggctttgcgtgaactgctggtaaatgaaggggaagatatcacctggtgccaaccctgtgtgtctcccgtgtgggataccgtactggcttcgctggcgttgcaggaggatgaacgggctgataacgggccggttcgccatgctctcgactggctcgtgcccctgcaggcactcgatcagccaggcgactggcgaaatagccgccctgatctgccgggagggggctgggcattccagtatgccaatccgcattatccggatctggatgatactgctgctgcagcgtgggcgttatgtcaggcggatacagaggattatcgtaccagtattacccgggcagcagactggctggcgggtatgcaatcgagtaatggcggttttgccgcatttgacatagacaatgtgcactattacctgaatgagattccattcgcagatcatggtgcgttactggatccaccttcgagcgacgtgacggcgcgctgtatcggtctgcttgctctgaatggtgaggcaagacaccaggaaaccgtgaagcgcggattgacatttttattcaatgagcaggagccatccggcgcctggttcgggcgctggggtaccaactacgtttatggcacctggtccgtgctggaggcattgaagttagcgcgggtggatcatgatcatcaggcggtaaaacgtgcagtgcaatggttgaagtcggtgcaacgtgccgatgggggatggggagaaaccaacgattcgtatctcgattccgagctggccggacaattggaaaccagtacttcttttcagaccgcatgggcagtgcttgggctgatggcggcaggcgaggtggggagcacagcagtaagaaacgggatcgattatctgatccgtacccagagtgctgccggattatgggaagaaccctggtttaccgctccgggttttccaaaagttttctacctgaaatatcacggctactccaaatactttccgctatgggcgctgaaccggtatcgtgcaatgaatagcaggtctgttgtatga

SEQ ID NO: 98634 - protein, 666 aa, Nitrosomonas europaea
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVV

SEQ ID NO: 98635 - DNA, 2458 bp, Lotus japonicus
  CDS (12)..(2300)
ggcagaagatcatgtggaagctgaaggtagcagatggtggcaagaatccttacatattcagcatcaacaacttcgtgggaaggcagacatgggagtatgatcctgatgcaggtactcctgaggaacgagctcaggttgaagaagctcgtcaggatttctataacaaccgctacaaggtcaagacttgtggcgaccgactttggcggtttcaggttatgagggaaaataacttcaaacaaacaataccgagtgtgaagatagaggatggagagaaggtaacatacgataaagtgacaacaactgtgagaagggccgcacatcacctagcaggattacagaccagtgatggccattggcctgctcaaattgctggtcctctgcttttcacgcctcccttgatcttttgtatgtacataacaggtcatcttgattctgtattcccagaagtgtaccgcaaagagattcttcgttacacatacgttcatcagaatgaagatggagggtggggactacacatagagggtcatagcaccatgttttgtactgtactcaactacatatgcatgcgaatacttggagaaggacctgatggaggtcaagacaatgcttgtgcaagagcaagaaaatggattcatgatcatgggggcgcgacacacatagcttcttgggggaagacatggctttcgatacttggtatatttgattggagcggaaccaatccaatgcctccagaattttggatccttccttcatttcttcctatgcatccagctaaaatgtggtgttattgccgattggtgtacatgcctatgtcttacttgtatgggaagagatttgtgggtccaataacaccactcatcttacagttgagagaagaactctttactcaaccttatgaaaaagttaattggaagaaggcacgtcatcaatgtgcaaaggaagatctttactatcctcatcctttgatacaagacttgatgtgggatagtttatacctattcactgagccattcttgactcgttggcctttcaacaagctgatcagagaaagagcccttcaagtaacaatgaaacatatccattatgaagatcataatagtcgatacattaccattgggtgcgtggaaaaggttttatgcatgcttgcttgttgggtggaagatccgaacggaattgctttcaagagacatcttgccagggtcccggattacttgtggcttgcagaagatggaatgtgcatgcagagttttggtagccaagaatgggatgctggtttcgccgttcaagctctgctttctactaacctaattgacgaactcggtcccgcacttgcaaaaggacatgattttatcaagaattctcaggttaaggacaacccttcaggagattttaagagtatgcatcgccatatttccaaaggagcatggaccttttctgatcaagaccatggatggcaagtttctgattgcactgcagaaggttttaagtgttgtctacttttgtcaatgttgcctccagagattgtaggggaaaagatagagcctgaaaggttattcgatactgtcaatctcctattgtcacttcagagtaaaaagggtggttttgcagtatgggagccagcaggagctcaggagtggctggaactactcaatcccatagaattttttgaggacattgtaattgagcatgaattggttgagtgcactggatcagcaattggagccttagttttgttcaagaatcattatccagagcatagaaagaaagagatcgaggattgcattgctaatgcagttcgttactttgaagatatacaaacagcagatggttcttggtatggaaatgcaggaatttgcttcatttatggtacttggtttgcacttggtggtctagaagcagctggcaaaacttatgccaattgtgctgccattcgcaaaggtgttaaatttctactcacgacacaatcaaaggatggtgggtggggagagagttatctatcatgcccaaaaaagatatatgtacctcttgaaggaaaccgatcaaatgttgtacagacagcatgggctcttatgggtttgattcatgctggccaggcggagagagaccctactccacttcaccgtgctgcaaaattgctcatcaattctcagcttgaagatggtgattggccccaacaggatattactggagtatacgtgaaaaattgcacgctgcattacccaatgtacagaaataattttacaacgatggccctagctgaatatcgtcgacgggttccattaccatccattgcagtttaacttgtaaagatagctgtgtgcacaaaaaggcacagccacatcaatagatcatgcaaataaaataatcaaacaagttctgcagttgaccttgtacaattgtactcttattactatagtatgtatttagtgtcggtttgttgccaaaaaaaaaaaaggcc

SEQ ID NO: 98636 - protein, 762 aa, Lotus japonicus
MWKLKVADGGKNPYIFSINNFVGRQTWEYDPDAGTPEERAQVEEARQDFYNNRYKVKTCGDRLWRFQVMRENNFKQTIPSVKIEDGEKVTYDKVTTTVRRAAHHLAGLQTSDGHWPAQIAGPLLFTPPLIFCMYITGHLDSVFPEVYRKEILRYTYVHQNEDGGWGLHIEGHSTMFCTVLNYICMRILGEGPDGGQDNACARARKWIHDHGGATHIASWGKTWLSILGIFDWSGTNPMPPEFWILPSFLPMHPAKMWCYCRLVYMPMSYLYGKRFVGPITPLILQLREELFTQPYEKVNWKKARHQCAKEDLYYPHPLIQDLMWDSLYLFTEPFLTRWPFNKLIRERALQVTMKHIHYEDHNSRYITIGCVEKVLCMLACWVEDPNGIAFKRHLARVPDYLWLAEDGMCMQSFGSQEWDAGFAVQALLSTNLIDELGPALAKGHDFIKNSQVKDNPSGDFKSMHRHISKGAWTFSDQDHGWQVSDCTAEGFKCCLLLSMLPPEIVGEKIEPERLFDTVNLLLSLQSKKGGFAVWEPAGAQEWLELLNPIEFFEDIVIEHELVECTGSAIGALVLFKNHYPEHRKKEIEDCIANAVRYFEDIQTADGSWYGNAGICFIYGTWFALGGLEAAGKTYANCAAIRKGVKFLLTTQSKDGGWGESYLSCPKKIYVPLEGNRSNVVQTAWALMGLIHAGQAERDPTPLHRAAKLLINSQLEDGDWPQQDITGVYVKNCTLHYPMYRNNFTTMALAEYRRRVPLPSIAV

SEQ ID NO: 98637 - DNA, 2202 bp, Mus musculus
  CDS (1)..(2202)
atgactgagggcacgtgtctgcggcgtcgtgggggaccctataaaactgagcccgccaccgatctcacccgctggcggctccagaatgagttgggtcggcagagatggacttattatcaagcggaggacgaccctggtcgagagcagaccgggctagaggcccactctttgggactggacacaagaagttatttcacggacttaccaaaagcgcaaacagcccatgagggggccctgaatggagtaaccttttatgccaagctgcaggctgaggatggacactgggctggtgattatggtggtccgctcttcctcttgccaggtctcctgattacctgtcacatatcacacatctctctgccagctggatacagagaggagatggtgcggtacctgcggtcagtgcagctccctgatggcggctggggcttgcacatcgaggacaagtccacagtgtttgggactgccctgaactatgtggctctcagaatcctgggtattgggcctgatgatcctgaccttgtgcgcgctcggaacgtccttcacaaaaaaggtggtgcggtggccatcccttcctgggggaagttctggctggctgtcctgaatgtttatagctgggaaggactcaacaccctattccctgagatgtggctgtttcctgaatgggtaccagcgcacccctccactctctggtgtcactgccggcaggtctatctgcccatgagttactgctacgccactcggctaagtgcctcagaggacccactggttcagagcctccgccaggaactctatgtgcaggattacgccagcatcgattggccagcgcagaggaacaacgtgtcccccgatgagatgtacacgccacacagctggctgctgcatgtggtgtatggactcctcaacctgtatgaacgtttccatagcaccagcctgcggaagtgggccgtccagatgctgtatgaacacattgcagctgatgactgtttcactaagtgcatcagcatcggcccgatctcaaagaccatcaacatgcttgttcgttggtcagtggatggaccatcctccccggccttccaggagcacgtttctcggatcaaagattacctttggctgggccttgatggcatgaaaatgcagggcaccaatggatcacagatctgggacacttcatttgctatccaagcactgttagaggcaggtgcacaccacagacctgagtttctgccctgcctgcagaaggctcacgagttcctgcggctttcacaggttccagaaaactgtcctgactatcagaagtactatcgccatatgcgcaagggtggtttctccttcagcacactggactgtggctggatcgttgctgactgcacagccgagggtttgaaggctgtgctgctcctgcagaatcagtgtccgtccatcactgagcatatcccccgagagcggctgtgcgatgctgtggatgtgttactgagcttgaggaatgctgatggcgggttcgctacctatgagaagaagcgtgggggttacttgctggagctgctgaacccctcagaggtctttggagacatcatgattgactacacgtatgtagagtgtacctccgctgtgatgcaggcactgaagcatttccatgaacacttcccagactacagggcagcagaggtcagggagaccctcaatcaaggcctggacttctgccgaaggaagcagagagccgatggctcctgggagggctcctggggtgtttgtttcacctacggcacctggtttggcttggaagcgttcgcttgcatggggcatacctaccaagatggggctgcttgtgcagaagtagctcaggcctgcaacttcctcctgtcccagcagatggcggatggaggctggggagaggactttgaatcatgtgaacagcggcggtatgtgcagagtgctaggtcccaggtccatagcacctgctgggccctgatgggtttgatggctgtcaggcatcccgacatcactgctcaggagagagggatcagatgtctgctagggaagcagttacccaatggagactggcctcaggagaacatctctggggtcttcaacaagtcctgtgccatcagctacacaagttacagaaacatcttccccatctgggccctgggccgcttctccaacctgtatcctgacaataccctcgccggccacatttga

SEQ ID NO: 98638 - protein, 733 aa, Mus musculus
MTEGTCLRRRGGPYKTEPATDLTRWRLQNELGRQRWTYYQAEDDPGREQTGLEAHSLGLDTRSYFTDLPKAQTAHEGALNGVTFYAKLQAEDGHWAGDYGGPLFLLPGLLITCHISHISLPAGYREEMVRYLRSVQLPDGGWGLHIEDKSTVFGTALNYVALRILGIGPDDPDLVRARNVLHKKGGAVAIPSWGKFWLAVLNVYSWEGLNTLFPEMWLFPEWVPAHPSTLWCHCRQVYLPMSYCYATRLSASEDPLVQSLRQELYVQDYASIDWPAQRNNVSPDEMYTPHSWLLHVVYGLLNLYERFHSTSLRKWAVQMLYEHIAADDCFTKCISIGPISKTINMLVRWSVDGPSSPAFQEHVSRIKDYLWLGLDGMKMQGTNGSQIWDTSFAIQALLEAGAHHRPEFLPCLQKAHEFLRLSQVPENCPDYQKYYRHMRKGGFSFSTLDCGWIVADCTAEGLKAVLLLQNQCPSITEHIPRERLCDAVDVLLSLRNADGGFATYEKKRGGYLLELLNPSEVFGDIMIDYTYVECTSAVMQALKHFHEHFPDYRAAEVRETLNQGLDFCRRKQRADGSWEGSWGVCFTYGTWFGLEAFACMGHTYQDGAACAEVAQACNFLLSQQMADGGWGEDFESCEQRRYVQSARSQVHSTCWALMGLMAVRHPDITAQERGIRCLLGKQLPNGDWPQENISGVFNKSCAISYTSYRNIFPIWALGRFSNLYPDNTLAGHI

SEQ ID NO: 98639 - DNA, 1929 bp, Synechococcus elongatus
  CDS (1)..(1929)
atgccaacttcacttgcgacggccattgacccaaagcaactccaacaggcgattcgcgccagccaagactttctcttttcgcagcaatatgccgagggctactggtgggcggaattggagtccaatgtaaccatgaccgcagaggtgatcctgctccacaaaatctggggcaccgaacagcggttacccttggccaaggcggaacagtatttgcgcaaccatcagcgggatcacggcggttgggaactgttttatggcgatggtggtgatctcagcaccagtgttgaagcctacatgggattgcggctcttgggcgttcccgaaaccgatccagccttggtgaaggcacggcaatttatccttgcccgcggtggcattagcaaaacgcgcatctttaccaaactgcaccttgccctcattggttgctatgactggcgggggattccctccctgcccccttggataatgcttctgccagaggggagccccttcacgatttatgaaatgtccagttgggcccgtagcagcacggtgccgctgctaatcgtcatggatcgcaagcctgtttatgggatggacccgcccattaccctcgatgaactctacagcgaagggcgggcaaatgtggtctgggaactgcctcgccaaggcgactggcgtgatgtttttattggcctcgatcgcgtcttcaaactctttgaaacgctgaacattcatcccctcagagaacaggggctcaaggctgccgaggaatgggtgctggagcgtcaagaagccagtggcgactggggcggcattattccggcaatgctcaactccctattggcgttgcgtgcccttgactatgcggttgatgaccccattgtgcagcgggggatggcggcagtggatcgcttcgccattgaaacggaaacggagtaccgcgtgcagccctgtgtctcccccgtttgggataccgccttagtgatgcgagccatggtggattcaggggttgctcccgatcatcccgcccttgtcaaagctggcgaatggctactctccaagcaaatccttgactatggggactggcacatcaaaaacaagaaaggtcggccgggcggatgggcctttgaatttgagaatcgcttctaccccgatgtggatgatacagcggtggtggtgatggcgctccatgctgtgaccctacccaacgaaaacctaaaacggcgagccattgagcgggcagtcgcttggattgcctcaatgcagtgtcggccagggggttgggcggcctttgatgtggacaacgaccaagattggctcaatgggattccctacggggatctcaaggcaatgattgacccgaatactgctgatgttacggcacgagtgctggagatggtgggtcgctgtcagttggcctttgatagggttgccctcgatcgcgcccttgcttacttgcgcaatgagcaggaaccggaaggctgttggtttggccgttggggggtgaactacctctatggtacgagcggggtgctgactgccctctcccttgtggctcctcgctacgatcgctggcgtattcgccgtgctgctgagtggttgatgcagtgtcaaaatgccgatggtggctggggtgaaacctgctggagctaccatgacccttcccttaagggcaaaggggatagcaccgcttcccaaaccgcttgggcgattattggccttttggccgctggcgatgccacgggggactacgccacagaggccattgaaaggggaattgcctatcttcttgagacgcagcgcccagatggcacatggcacgaggattacttcacgggcactggctttccctgccacttttacttgaagtaccactactaccagcagcactttccgctgactgccttgggccgttatgcccgctggcgcaatcttttagccacttag

SEQ ID NO: 98640 - protein, 642 aa, Synechococcus elongatus
MPTSLATAIDPKQLQQAIRASQDFLFSQQYAEGYWWAELESNVTMTAEVILLHKIWGTEQRLPLAKAEQYLRNHQRDHGGWELFYGDGGDLSTSVEAYMGLRLLGVPETDPALVKARQFILARGGISKTRIFTKLHLALIGCYDWRGIPSLPPWIMLLPEGSPFTIYEMSSWARSSTVPLLIVMDRKPVYGMDPPITLDELYSEGRANVVWELPRQGDWRDVFIGLDRVFKLFETLNIHPLREQGLKAAEEWVLERQEASGDWGGIIPAMLNSLLALRALDYAVDDPIVQRGMAAVDRFAIETETEYRVQPCVSPVWDTALVMRAMVDSGVAPDHPALVKAGEWLLSKQILDYGDWHIKNKKGRPGGWAFEFENRFYPDVDDTAVVVMALHAVTLPNENLKRRAIERAVAWIASMQCRPGGWAAFDVDNDQDWLNGIPYGDLKAMIDPNTADVTARVLEMVGRCQLAFDRVALDRALAYLRNEQEPEGCWFGRWGVNYLYGTSGVLTALSLVAPRYDRWRIRRAAEWLMQCQNADGGWGETCWSYHDPSLKGKGDSTASQTAWAIIGLLAAGDATGDYATEAIERGIAYLLETQRPDGTWHEDYFTGTGFPCHFYLKYHYYQQHFPLTALGRYARWRNLLAT

SEQ ID NO: 98641 - DNA, 2729 bp, Medicago truncatula
  CDS (96)..(2384)
gtctttcctcatatcaatcaaattaaggaggtcttgctagcttccatatataactcatcactaaaacttctaataattgaaaaaaagtaattaagatgtggaagctgaagattggagagggaaagaatgagccatacttattcagcacaaataattttgtgggaagacaaacatgggagtatgatccagaagcaggtagtgaagaagaaagagcacaagttgaagaagctcgtaagaatttctatgacaacagattcaaggtcaagccctgtggtgacctcctatggcgttttcaggttctaagagaaaataactttatgcaaacaatagatggagtgaagatagaagatggagaagagataacatatgagaaagcaacgacaacgttgagaaggggcacacaccatctagcagcattgcaaaccagtgatggccattggcctgctcaaattgcaggtcctctatttttcatgcctcccttggttttctgtgtctacattactggacatcttgattccgtcttcccacgagaacatcgcaaagagattcttcgttacatttactgtcaccaaaatgaagatggaggatgggggctacacattgagggtcacagcaccatgttttgtactgcacttaactatatatgtatgcgaattctcggagaaggacctgatggcggtcaagacaatgcttgtgctagagccagaaactggattcgggcacacggtggtgtcacatatataccttcatggggaaaaacttggctttcgatacttggtctctttgattggttgggaagcaacccaatgccccctgagttttggatccttccttcatttcttcctatgcatccagctaaaatgtggtgttattgtcgattggtatacatgcctatgtcttacttgtacgggaagagatttgtgggtccgatcacaccactcatcttacagttgagagaagaactccatactcagccttatgaaaaaattaactggacgaaatcacgtcacctatgtgcaaaggaagatatttactatccccatcctttgatacaagatctgatatgggatagcttatacatatttaccgagccgcttctcactcgctggcctttcaacaagctggtcagaaaaagagcccttgaagttacaatgaagcatatccactacgaggatgagaacagtcgatacctaaccattgggtgtgtggaaaaggtattatgtatgcttgcttgttgggtggaagatccaaatggagatgcttacaagaagcatcttgcaagggtccaagattacttgtggatgtcagaagatggaatgaccatgcagagttttggtagccaagaatgggatgctggttttgccgttcaagctttgcttgccgctaacctaaatgatgaaatcgaacctgcacttgccaaaggacatgatttcattaagaaatctcaggttacagagaacccttctggagattttaagagtatgcatcgtcatatttctaaaggctcatggaccttctccgatcaagaccatggatggcaagtttctgattgcaccgctgaaggtttgaagtgttgtctacttttatcaatgttgcctccagagattgtgggggaaaagatggaaccagaaaggttatatgattcggtcaatgtcttgttgtcgcttcagagtaaaaagggtggtttggcagcatgggagcccgcaggagctcaagagtggttagaactactcaatcccactgagttttttgcggacattgttgttgagcatgaatatgttgagtgcactggatcagcaattcaagctttagttttgttcaagaagctatatccagggcataggaagaaagagatagagaatttcatctccgaggcagttcgattcattgaagatatacaaacagccgatggttcatggtatggaaactggggagtttgcttcacttatggttcttggtttgctcttggtggtttagcagctgctggcaagacttataccaattgcgctgctattcgcaaagctgttaaatttcttctcacaacacagagagaggatggtgggtggggggagagctatctttcaagcccaaaaaagatatatgtacctctcgaaggaagccgatccaatgttgtacatactgcatgggctcttatgggtttaattcatgccggccaggcagagagagaccctactcctctccatcgtgctgcaaaattgctcatcaattcccagttggaagaaggcgattggccccaacaggaaatcacaggagtattcatgaaaaattgtatgttgcattacccaatgtatagagatatttaccccttgtgggctctagccgagtatcgtagacgggttccattgccttccactgcagtttaactggaaaataagctataagctatgagtacaaaaagatgacaaaatcagtaaaataaaaccaaataagttgggcagtcaagcctattttctacatgtgttgattaatttttgttttatgttagcttatggtatgtatagtatagatggatgtgttcttccacgttttcatttctaaaatggatgtctagctccagaaagaatgatcagttcaaacaaccaaaagaaaaaagttggccatgtttgccgtagggatatatagcaacattcaagcataggtagaatatttacataattcattttaataatatattcttatttcctcctataaaaaaaaaaaaaaaaaaa

SEQ ID NO: 98642 - protein, 762 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFISEAVRFIEDIQTADGSWYGNWGVCFTYGSWFALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 98643 - DNA, 2416 bp, Glycine max
  CDS (48)..(2267)
acgccggggaaagaggtttgtttggtgtgagtgaatagggatcagggatgtggaggctgaagatagcagatggaggaaatgatccatacatattcagcacaaacaatttcgttgggaggcagacatgggagtttgatcctgaagcaggcagtccagaggaacgggcccaggttgaagcagctcgtcagcatttctaccacaaccgcttcaaggtcaagccctgcgctgacctcctttggcgttttcaggttctcagagaaaataacttcaaacaaacaattcctcgtgtgactatagaagatggagaggaaatcacataccaaaaagtcacaagcgccgtcagaaggggcgcacaccaccttgcggcactgcagacctctgatggccattggcctgctcaaattgcaggtcctctcttctttcttcctcctttggttttttgtatgtatattacaggaaatcttgaatcagtatttccagaagaacatcgcaaagaaattcttcgttacacatattatcaccagaatgaagacggaggatggggactacacatagagggtcatagcactatgttttgtactgcactgaactatatatgcatgcgaatgcttggagaaggacctaatggaggtcatgacaatgcttgtgctagagcaagaaagtggattcgagatcatggtggtgtaacacatataccttcatggggaaaaacttggctttcgatactcggtgtatttgattggtgcggaagcaacccaatgcccccagagttttggatccttccatcttttcttcctatgcatccgggtccaatcacaccactcatcttacaattaagagaagagttgtttactcaaccttatgaaaaagttaattggaagaaagcgcgtcaccaatgtgcaaaggaagatctttactatccccatcctttgatacaagacctaatatgggatagtttatacatattcactgaaccgctacttactcgttggcctttcaacaagttgattagagaaaaggcccttcaagtaactatgaaacatattcattatgaagatgagactagtcgatacataaccattggttgtgtggaaaaggttttatgtatgcttgcttgttgggtggaagatccaaacggagatgctttcaagaagcatcttgcaagggtcccagattacttatgggtttctgaagatggaatgaccatgcagagttttggtagccaagaatgggatgctggctttgctgttcaagctttgcttgccactaacataattgaagaaattggtcctacgtttgcaaaaggacatgatttcatcaagaagtctcaggtgaaggataatccttttggagattttaaaagtatgcatcgtcatatttctaaagggtcttggacattctctgatcaagaccatggatggcaagtttctgattgcactgcagaaggtttaaagtgttgtctacttctatcaatgttgccaccagagattgtgggagaaaagatggaacctgaaagattatacgattcagtcaatgtcttgttgtcgcttcagagtaaaaaaggtggtttagcagcatgggagcctgcaggagctcaagagtggttagaatactccaatcccacagaattttttgcggacattgtagttgaacatgaatatgttgagtgccctggatctgcaatccaagctttagttttgttcaagaagctatatccaggacttaggaggaaagagatagaaaatttcattaccaatgcagttcgatcccttgaagatacacaaacagctgatggttcatggtatggaaattggggagtttgcttcacttatggctcttggtttgcacttggaggtctagcagctgccggtaagacttacaccaagtgtgctgccattcgcaaagccgttaaatttctacttacaacacaaagagaggacggtggatggggagagagttatctttcaagcccaaaaaagatatatgtacctctagaaggaagccgatcaaatgttgtacatacagcatgggctcttatgggactaattcatgctggacaggcggatagagaccccatgcctcttcaccgtgctgcaaagttgctcattaattctcagttggaagagggtgattggccccaacaggaaatcacgggagtattcatgaaaaattgcatgttgcattatccaatgtacagagatatttatccaatgtgggctctagctgaatatcgaaggcgggttccattgccttccactgaagtttaatttagaatggtttgagcacgaaaaggcaaaggcattttcattaagattgaggcaaataaagcaaataagttgtgtgtaatcaagcttaatcaattttttcatattcctatgtttatttcctacatatattggtagaaaaattatttcag

SEQ ID NO: 98644 - protein, 739 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLEYSNPTEFFADIVVEHEYVECPGSAIQALVLFKKLYPGLRRKEIENFITNAVRSLEDTQTADGSWYGNWGVCFTYGSWFALGGLAAAGKTYTKCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 98645 - DNA, 2487 bp, Costus speciosus
  CDS (80)..(2359)
ctggcgccacctctgtagtctgcactagcatttcttgtcgtctcgatcggtctctcggcaaagcagagatactccggcgatgtggaggctcaaggtcgcggagggctccgggccgtggctgcggagcacaaacaaccacgtcgggcgggaggtgtgggagttcgacccgagcggtggcacgccggaggagatcgcggaggtggagagggcccgggagacgttccgcgaccactgggtcgaacacacgaacagcgctgatctcatcatgcgcttgcagtttgagaaggagaatcccgctgagatgaagtactctgtcattaggattcaagaggcggaaaatatcagtaaagaggctgtagatatctgcttaagaaaggctgtcactcgtatttctactctccaagctcacgacggacactggcctggggattgcggcgccggtccgatgtttcttttgcctggattggtaattagtttgcatataactggagctctaaatacaattctgacgcctgagcaccagaaggagatgcgtcgatatctgtacaaccaccagaacgtggatggtggttggggattgtatagtaacgggccaagcaacatgattggctcagtcttgcattatgttactttgagattgcttggagaaggagcaaacgatggagaaggggcaatggagaaaggtcgcaagtggattttagaccatggcagcgcaactgcaacttcatcgtggggaaagttgtggctttctgtacttggagtatatgaatgggctggtaacaatcctatgccgccagaattttggttgctgccatactgcgttcctcttcatccaggaaaaatgtggtgcctcagccggacggtttacctgcccatgtcatatttgtatgggaagagatttgttggtgcaatcacaccaatcgtcgtatcactaagaaaagagttatacaatgttccatatgaccatatcgattggaacaaggcgcgtaccgactgcgcaaaggaagatcagtactatccgcatccattgatacaagatattatttgggggtcgctacataattttgtagaacctattctaatgcgttggcctggaagcaagttgagagagaaggctctttccactgtcatgcagcacatacattacgaggatgagaatactagatatatttgcgttggtcctgttaacaaggcacttaatatgctttgttgctggatcgatgatccaaattcggaggcattcaagctacaccttccaagggtatatgattatctgtggctggccgaagatggaatgaagatgaaggcctacgatggcttccagttatgggaagctgctttcgctgttcaggcaattgtatcaactaatctttcagaggaatttggccctacactgaagaaagcacatgaattcgttaaaaactcgcagattctggaggactgccctggtgatctaaactattggtaccgccacatctccaaaggtgcatggacattttccactgctgatgagggctggcccgtctcagattgcaccggagaaggacttgaagcggttctcttattatcaatgatttctcccaaaattgttggcgatccactagatgaaaggaggctttatgatgccgtaaatctgctgctttcactaatgaacaaaaatggaggttttgctacttatgaacttacgagatcctatgcctggttggagattatgaatcctgctgacgttttcataaacattgttgttgatcatcaatatgtggaatgtacgtcatcagcgattcaaccattggcattatttaaaaagctttatcctgggcatcggcaagaggagatagacaattgcatcatgaaagcagcccgtttcatagagaggactcagcgagctgatggttcatggtatggaagttggggtgtttgcttcacgtatgctacatggtttggagtaaagggactggtggctgctggaaggacatacgagaacagttgttatatccaaaaggcatgcaactttctattgtcgaaacaagaggcttctggtggctggggagagagcttcctttcatgtcgaaaaaaggtttatatcaatcttgagggtaacaaaactcatgcagtgaacactagctgggccatgctagctctgattgctgctgggcagggggagagagacccaaaaccattgcacagagcagcaaaagctttaataaatatgcaaatggagaatggcgattttccccaacaagagatgatgggaaacttcatgggaggttcttcgttgaattatccattatatcgaaacatatttccaacatgggctcttggagaataccgaaatcatattttccactctatgacttgattcatgttagcgcacaaggagaaacacatatggaaattatcccagataattttattttataactaaatgttattggttatactatgcaccttattttaatagaattgttcttatcaaactatttattt

SEQ ID NO: 98646 - protein, 759 aa, Costus speciosus
MWRLKVAEGSGPWLRSTNNHVGREVWEFDPSGGTPEEIAEVERARETFRDHWVEHTNSADLIMRLQFEKENPAEMKYSVIRIQEAENISKEAVDICLRKAVTRISTLQAHDGHWPGDCGAGPMFLLPGLVISLHITGALNTILTPEHQKEMRRYLYNHQNVDGGWGLYSNGPSNMIGSVLHYVTLRLLGEGANDGEGAMEKGRKWILDHGSATATSSWGKLWLSVLGVYEWAGNNPMPPEFWLLPYCVPLHPGKMWCLSRTVYLPMSYLYGKRFVGAITPIVVSLRKELYNVPYDHIDWNKARTDCAKEDQYYPHPLIQDIIWGSLHNFVEPILMRWPGSKLREKALSTVMQHIHYEDENTRYICVGPVNKALNMLCCWIDDPNSEAFKLHLPRVYDYLWLAEDGMKMKAYDGFQLWEAAFAVQAIVSTNLSEEFGPTLKKAHEFVKNSQILEDCPGDLNYWYRHISKGAWTFSTADEGWPVSDCTGEGLEAVLLLSMISPKIVGDPLDERRLYDAVNLLLSLMNKNGGFATYELTRSYAWLEIMNPADVFINIVVDHQYVECTSSAIQPLALFKKLYPGHRQEEIDNCIMKAARFIERTQRADGSWYGSWGVCFTYATWFGVKGLVAAGRTYENSCYIQKACNFLLSKQEASGGWGESFLSCRKKVYINLEGNKTHAVNTSWAMLALIAAGQGERDPKPLHRAAKALINMQMENGDFPQQEMMGNFMGGSSLNYPLYRNIFPTWALGEYRNHIFHSMT

SEQ ID NO: 98647 - DNA, 2683 bp, Costus speciosus
  CDS (207)..(2486)
agggcagtcgtttgctctgccctgcgctccctttgaaagcgtactgtgccggaacatcttcgcctcttcccctcggatcccagcagatctgtatacatcccaccccgcagccgatttctcaaccttttccctcggcctttccgcccatcgatcgctcccgacgggcttcgagaagcgttcctgcggcgctcccttttcttccgtgaatgtggaggctcaagatcgcggagggcggcggcccgtggctgcggacgaagaacaaccacgtcgggaggcaggtgtgggagttcgacccgagcctcggcacgcccgaggagatagcggaggtggagagagtccgggaggctttccgcgagacccggttcgagaagaagcacagcgccgatctcctcatgcggttgcagtttgccaaggagaatccacttgaaatgaactatcctatcatcaagattgaagaacacgaagatgtcactgaagaacttgtggtgacctccttaagaaaggctatcagtcgcgtttctactctccaagctcacgatggacactggcctggggattatggtggtccaatgttccttatgccgggattgataataactttgtatgtcactggagctctaaacactgttcttacatctgaacaccagaaggagatccgtcgatacctctacaaccaccagaatgaagacggaggctggggcttgcatattgagggtgaaagcactatgtttggttctgccttgacttatgttattttgagattgctcggagaaggacctgatgatggagatggggcaatggaaaaagggcgaaagtggatcctagatcatggcagtgcaactgctataacctcatggggaaagatgtggttatctgtgcttggagtgtttgactggtctggcaacaatcctttgccgccagaaatgtggttattaccatacttcttgccagttcatccaggacgaatgtggtgtcattgccggatggtttacctgcccatgtcatacatctatggaaagaggtttactggtccaattacaccacttatcttgtcactaaggaaggaactatttaatcttccatttgatcagttagattggaacaaggctcgtaacgagtgtgcaaaggaagatctgtactatccacatccatttatacaagacgtcctttgggcatctctacataaatttgtcgaacctattctgatgcattggcctggaagcaaattaagagagaaggctgttaatactgctatgcagcatgtccattatgaggatgaaaatacaagatatatttgcattggtcctgtcaacaaggtacttaatatgctttgctgctggattgaagatccaaattcagaggcattcaagctacatcttcctagagtaatggattatctgtggttggctgaagatggaatgaaaatgcggggctataatggcagccagttgtgggacacagctttcactgttcaggcaataatatcgactgacctttttgaggaatttggtcttgcactgacgaaggcacatgaatttattaaaaaaacacaggttcttgaagactgccctggcgatcttaatttttggtaccgccacatctctaaaggtgcatggcctttctccaccgctgatcatggatggcctatctcagattgcacttccgaaggacttaaggcagcgctcttattatctaagatttctcctgaaattgttggtgatccacttgatggaaagagcctctatgatgccgttaatgttatcctttcactaatgaataatgatggtggttttgctacgtatgaacttacgagatcctatgcctggttggagattatcaatcctgctgaaacatttggagacattgttatcgattacccatatgttgagtgcacttcggcagcaattcaggcattgacattatttaaaaagacatatcctggacatcgccgagaggagatagacaattgcatcagaaaatcagctcgttttattgaaaagattcagctagctgatggttcatggtatggatcttggggtgtttgcttcacatatggtatatggtttggaatgaagggattacttgccgctggtcggacctatgagactagctcttgcatccgaaaggcatgtgactttctgttgtctaaacaagttgcctctggtggttggggggagagctatctttcatgtcaaaataaggtctacacaaatcttgagggtaacagggctcatgcagtgaatactggctgggccatgctggctctaattgatgctgggcagggtgagagagatccaaaaccattgcacagagcagcaaaagttctaataaacatgcaaatggagaatggcgagtttccccaacaagagattatgggggtttttaacaaaaattgcatgatcagttattcagaatatcgaaacatatttccaatctgggctctcggagaataccgaagacgcgtcctgtgttctcaattccactgaattcatctcctgcctagttaagaatcaatgtagttaaggttcttttcgtcaagaaatggaatggtggtgtgccacgcagcacagttggaatggaatgaattccaactcacaattttgaaccattttgatcgactgaactaatttggttagccttttgtagtactctcaattttagttagtattcatgtgaagaatcc

SEQ ID NO: 98648 - protein, 759 aa, Costus speciosus
MWRLKIAEGGGPWLRTKNNHVGRQVWEFDPSLGTPEEIAEVERVREAFRETRFEKKHSADLLMRLQFAKENPLEMNYPIIKIEEHEDVTEELVVTSLRKAISRVSTLQAHDGHWPGDYGGPMFLMPGLIITLYVTGALNTVLTSEHQKEIRRYLYNHQNEDGGWGLHIEGESTMFGSALTYVILRLLGEGPDDGDGAMEKGRKWILDHGSATAITSWGKMWLSVLGVFDWSGNNPLPPEMWLLPYFLPVHPGRMWCHCRMVYLPMSYIYGKRFTGPITPLILSLRKELFNLPFDQLDWNKARNECAKEDLYYPHPFIQDVLWASLHKFVEPILMHWPGSKLREKAVNTAMQHVHYEDENTRYICIGPVNKVLNMLCCWIEDPNSEAFKLHLPRVMDYLWLAEDGMKMRGYNGSQLWDTAFTVQAIISTDLFEEFGLALTKAHEFIKKTQVLEDCPGDLNFWYRHISKGAWPFSTADHGWPISDCTSEGLKAALLLSKISPEIVGDPLDGKSLYDAVNVILSLMNNDGGFATYELTRSYAWLEIINPAETFGDIVIDYPYVECTSAAIQALTLFKKTYPGHRREEIDNCIRKSARFIEKIQLADGSWYGSWGVCFTYGIWFGMKGLLAAGRTYETSSCIRKACDFLLSKQVASGGWGESYLSCQNKVYTNLEGNRAHAVNTGWAMLALIDAGQGERDPKPLHRAAKVLINMQMENGEFPQQEIMGVFNKNCMISYSEYRNIFPIWALGEYRRRVLCSQFH

SEQ ID NO: 98649 - DNA, 2629 bp, Betula platyphylla
  CDS (225)..(2432)
gcgggtaaaggagatgagttcgattttgggttgatttcttgagtttcggttgattcttgaacgaatttttggttgattttgtgtgggctatctgggtaagcaccgaattggtgtgggtggtttgagaagctttgggcaagaacacaatctcacaagcagatttgggcagattgctcacacccaagctctcaagcagatttgggaggaacacaatcttcagaagaatgtggaggctgaagattgcagagggtggcaatgactctttcctctcaagcacaaacaacttcgtggggagacaaacatgggagtttgatgcaaatgctggtacacctgaagagcgagccgaagttgaagaggcccgtcagaattattacaagaaccgtcataaaatcaagccaggcagtgacctcctatggcaaatgcagtttttaagagagaaaaatttcaagcaaacaattccccaagtgaaggttaaggatggtgaggaaattacatatgaaattgccacaaccacgttaaggagggccgcccgcttcttttcagctttgcaggccagcgacggccattggcctgctgaaatctctggcgtattatttccccttcctccatttatcttgtgtctatacattacagggcatcttaatactatattcactacagaacatcgcaaagaagtcttcggtatataccacaatcatcagtatgtagacggggggtgggggttgcacatagagagtcacagcagtatgtattctacaggtttgcactacgtttgtatgcgtatacttggagaaggagctgatggtgatgcttgtgcgagagcccgaaagtggattctcgaccgtggtggtgtaacccatataccatattggggaaagatttggctttcgatacttggtgtctatgaagcaaacttgtggtgctatattcggatgtcttacttacccatgtcatatttgtacgggaagaggtttgttggccccataacacctctcattttacaattgagagaagagctctacattcaaccttatcatactattaattggtggagagcacgccacttatgtgcgaaggaggatctctattattctcaaacttggatgcaagatttattttgggatagtctttacattttcattgaacctgttcttagttgttggccttttaacaagttgagaaataaggctcttcaagtagcgatgaaacacattcattacgaagatgagaatagtcggtatcttaccattggaggggggcaaaagccattttttatgctcgcttgttgggatgaagatccacatggggattactttaagaagcatcttcctaggatacaagatttcttatggatttcagaagatggaatgaagatgactaatgctggccaggtttgggatgctagttttgccattcaagctttgcttgctactgatcttagtgatgaaattggacaaacactaatgagaggatacgactttataagaatccaggtcaaggataatccttctggcgatttcagcagcatgtggttcgtcacttttctaaaagggggatggcctttctctgaacaagatcatggttggcaagcttctgattgtactgcagaagctttaaagtgctgtttgttgctatctatgcttccatcagaaattgccggtgaggaaatggatcctgagcggctatatgatgcagtccatatcatactttctttgcagagtaaaaacggtggcgtgacaggttgggagccagcaggtggggcatcatgtttcgagctgcttaatcctatagaatttctcgagggcactctccttgagcatgagtatgttgagtgcacttcatcagcaatacaggcattagttttgttcaagaaattatatccagggcacaggaaagaagaatgtgaaatttttatctcaaatgctgtacgattccttgaagatatacaaatgcctaatggttcatggtacggaatttggggaatttgcttcatatatgcaacttggtttgcactcgtagggttagaagttgctggcaagacttatcataactgtcttgctatgcgcaaaggcgtacaatttctcctcaaaacacaaaaccaagatggtggttggggagagagctatctttcatgctcaaaaaaggaatatgtgcctctcgaaggaaatcgatcaaatttggtgcaaactgcgatggctttgattgggctagttcatgctcagcaggcagagagagaccctactcctcttcatcgtgcagcaaagctgttgatcaattctcaaatggaaaatggcgatttcccccaacaggaacttgtgggagctgttatgcagaattgcatgttgcactatacactttttagggatactttcccgttgtgggctcttgcggaatatcgtaattatgtttctctgcccaccaaatccctttaaactatattttgtggattacaaaatgaggagaataaaaggaacttgtgaagtccattaattgatgcgtcatgttgcatcaaagtctatttatagtccaaagggcaattaatggctctgtaacaattattcaacataaataaatggtaacgtaagcataaatggttatgaaatgcattcttcggatgacataatttacg

SEQ ID NO: 98650 - protein, 735 aa, Betula platyphylla
MWRLKIAEGGNDSFLSSTNNFVGRQTWEFDANAGTPEERAEVEEARQNYYKNRHKIKPGSDLLWQMQFLREKNFKQTIPQVKVKDGEEITYEIATTTLRRAARFFSALQASDGHWPAEISGVLFPLPPFILCLYITGHLNTIFTTEHRKEVFGIYHNHQYVDGGWGLHIESHSSMYSTGLHYVCMRILGEGADGDACARARKWILDRGGVTHIPYWGKIWLSILGVYEANLWCYIRMSYLPMSYLYGKRFVGPITPLILQLREELYIQPYHTINWWRARHLCAKEDLYYSQTWMQDLFWDSLYIFIEPVLSCWPFNKLRNKALQVAMKHIHYEDENSRYLTIGGGQKPFFMLACWDEDPHGDYFKKHLPRIQDFLWISEDGMKMTNAGQVWDASFAIQALLATDLSDEIGQTLMRGYDFIRIQVKDNPSGDFSSMWFVTFLKGGWPFSEQDHGWQASDCTAEALKCCLLLSMLPSEIAGEEMDPERLYDAVHIILSLQSKNGGVTGWEPAGGASCFELLNPIEFLEGTLLEHEYVECTSSAIQALVLFKKLYPGHRKEECEIFISNAVRFLEDIQMPNGSWYGIWGICFIYATWFALVGLEVAGKTYHNCLAMRKGVQFLLKTQNQDGGWGESYLSCSKKEYVPLEGNRSNLVQTAMALIGLVHAQQAERDPTPLHRAAKLLINSQMENGDFPQQELVGAVMQNCMLHYTLFRDTFPLWALAEYRNYVSLPTKSL

SEQ ID NO: 98651 - DNA, 2519 bp, Betula platyphylla
  CDS (39)..(2378): n means a or g or c or t/u
ctgatgtaataatgagggaagaaaggcactagtaaggaatgtggaggcttaagatcgcagacggtgggagtgacccttatatctactctacaaacaactttgttgggaggcagacatgggagtttgaccctcaggctggttccccacaagagcgggctgaggttgaagaggctcgtcggaatttctacgacaaccggtatcaggtcaaacctagtggtgatctcctatggcgaatgcagtttcttaaggagaaaaacttcaaacaaacaattcctccagtaaaggttgaggatggagaggaaatcacatatgaaaagtccacagctgcattgagaagggccgtccatttctattcggccttgcaagctagtgatggccattggcctgctgaaaatgccggtccattatttttccttccccccttggttatgtgtatgtacattacaggacatcttaatactgtgttccctgctgagcatcaaaaggaaatccttcgatacatatactatcatcagaatgaagatggtgggtggggattacacatagagggtcacagcaccatgttttgcactgctctcagctacatctgtatgcgcatactcggggaagggcctgatggtggtcaggacaatgcttgtgcaagagcgcgaaagtggatccttgatcatggtggtgtaacacacatgccttcttggggaaagacctggctttcgatacttggtatattcgagtggattggaagcaacccaatgcctccagaattttggatccttccttcatttcttcccatgcatccagccaaaatgtggtgctactgccgcatggtgtacatgcctatgtcatacctctatgggaaaaggtttgtaggcccaatcacacctctcattcttcaattgagggaggaactctacactcaaccttaccaccaagttaactggaagaaagtgcgtcatctatgtgcaaaggaggatatctactatccccaccctttgatacaagatctattgtgggatagtctatacatattcactgagcctcttctaactcgttggccctttaacaagctggtcagagagaaggctcttcaagtaacaatgaagcacattcattatgaagatgagaacagtcgatacatcaccattggatgcgtggaaaaggtcctctgtatgcttgcttgttgggttgaagatccaaatggggattatttcaagaaacatattgctaggataccagattacatatgggttgctgaagatggaatcaagatgcagagttttggaagtcaagagtgggataccggttttgctattcaagctttgcttgctagtaatctaactgatgaaattggacctacacttgcgagagggcacgacttcataaagaaatctcaggtcaaggacaacccttctggagactttgaaagcatgcaccgtcacatttctaaaggatcatggactttctctgatcaagatcatggatggcaagtttctgattgcactgccgaaggtttgaagtgttgcttgcttttctccattatgccaccagaaattgttggtgagaaaatggaacctgagcaattgtatgattctgtaaatgtcctactttctctacagagtaaaaatggtggtttagctgcctgggaaccagcaggagcccaagaatggttggaattgcttaattccacagaattctttgcggacattgtcattgagcatgagtacattgagtgcactgcatcagcaatgcaaactttagttttgtttaagaagttataccccgggcaccgnaagaaagagatcgaaaatttcataaaaaatgctgctcagttccttcaagtcatacaaatgcctgatggttcatggtatggaaattggggagtttgcttcacatatggtacatggtttgcacttggaggattggctgcagttggcaagacttacaacaattgtctagccgtgcgcagagctgttgattttctactcagagcacaaagagataatggtggttggggagagagctatctctcatgtccaaagaaggagtatgtacctcttgaaggaaacaaatcaaatttggtacatactgcatgggcaatgatgggtctcattcatgctggacaggctgaaagagacccaacacctcttcaccgcgcagcaaagttgataattaattctcaactcgaagatggagattttcctcaacaggaaatcactggagtctttatgaagaactgtatgttacactatgcagcatacaaaaatatttacccactgtgggctctggcagaataccgcaagcatgtcccattgccattaggaaaaaatttaaatcaagtagtgaactgtataggtcaatcactatataagaagtataaataagaaatccacttgttaatcctcttactttcccaacacagccatctaagatagatgagagtaaggattacacaatgttgtactagtgaataatatatagtaaacgaaaagctcttcattcggctataccattatttgctcttg

SEQ ID NO: 98652 - protein, 779 aa, Betula platyphylla
MWRLKIADGGSDPYIYSTNNFVGRQTWEFDPQAGSPQERAEVEEARRNFYDNRYQVKPSGDLLWRMQFLKEKNFKQTIPPVKVEDGEEITYEKSTAALRRAVHFYSALQASDGHWPAENAGPLFFLPPLVMCMYITGHLNTVFPAEHQKEILRYIYYHQNEDGGWGLHIEGHSTMFCTALSYICMRILGEGPDGGQDNACARARKWILDHGGVTHMPSWGKTWLSILGIFEWIGSNPMPPEFWILPSFLPMHPAKMWCYCRMVYMPMSYLYGKRFVGPITPLILQLREELYTQPYHQVNWKKVRHLCAKEDIYYPHPLIQDLLWDSLYIFTEPLLTRWPFNKLVREKALQVTMKHIHYEDENSRYITIGCVEKVLCMLACWVEDPNGDYFKKHIARIPDYIWVAEDGIKMQSFGSQEWDTGFAIQALLASNLTDEIGPTLARGHDFIKKSQVKDNPSGDFESMHRHISKGSWTFSDQDHGWQVSDCTAEGLKCCLLFSIMPPEIVGEKMEPEQLYDSVNVLLSLQSKNGGLAAWEPAGAQEWLELLNSTEFFADIVIEHEYIECTASAMQTLVLFKKLYPGHRKKEIENFIKNAAQFLQVIQMPDGSWYGNWGVCFTYGTWFALGGLAAVGKTYNNCLAVRRAVDFLLRAQRDNGGWGESYLSCPKKEYVPLEGNKSNLVHTAWAMMGLIHAGQAERDPTPLHRAAKLIINSQLEDGDFPQQEITGVFMKNCMLHYAAYKNIYPLWALAEYRKHVPLPLGKNLNQVVNCIGQSLYKKYK

SEQ ID NO: 98653 - DNA, 2471 bp, Betula platyphylla
  CDS (87)..(2354)
gatcttgcatcttttcagttaagcacacctcgaggagcaacctcttagaatttattttccactcaaaaactttccaagatagagggatgtggaagttgaagatagcggaaggagggccagggctggtgagcggaaatgatttcatcgggcggcaacactgggaattcgacccggatgccggcactccccaagagcgtgctgaagttgaaaaggtccgggaggagttcaccaaaaatcggtttcagatgaaacaaagcgctgatcttttgatgaggatgcagcttaggaaggagaacccatgccaaccaattccaccaccagtgaaagtgaaagaaacagaggtgataacagaggaagcagtgattactacactgagaagatcactaagcttttattcctccattcaagctcatgatggccactggcctggtgaatctgctggccccttgtttttccttcaaccctttgtaatggcattatacatcactggagatctcaatactattttttccccagcacaccagaaggaaattattcgatacttgtataatcatcagaacgaagatggaggctgggggttccatatagagggtcacagcacaatgtttgggtcagctttgagctacattgccttgagaatacttggagagggacttgaagatggtgaagatggggctatggctaaaagccggaaatggattcttgaccatggtggtttagtggctattccttcatggggaaagttttgggtcacggtactgggactgtatgagtggtcaggctgcaatccactgcccccagagttctggtttcttcctgatatctttcccatacatccaggtaaaatgttatgctactgtcgcttggtttacatgccaatgtcttatttatatgggaagaggtttgttggtccaatcactggattgattcaatcacttagacaagagttatataacgagccttaccatcaaattaactggaataaagcccggagtacagttgcaaaggaggatctctactatccgcatcccctcatacaagatctgctatggggatttcttcaccatgtagccgagcctgtcctgacgcgttggcccttttcaatgctgagagagaaggcactcaaagctgcaattggtcatgtacattatgaggacgagaacagcaaatacctttgcattggaagcgttgaaaaggtattatgtttgattgcctgttgggctgaagatccaaatggggaggcatacaagcttcatctaggaaggattccagacaactattgggttgctgaagatggcttaaaaattcagagtttcggctgtcagatgtgggatgcgggttttgctattcaagcaattctctcttgcaatttaaacgaagagtattggccaacacttcgtaaagcacatgagtttgtaaaggcttcacaggtcccagaaaacccttctggggacttcaaagccatgtaccgccacataaacaaaggagcatggacattctcgatgcaggaccatggatggcaggtctctgactgcaccgctgaagggctgaaggttgcaatcttgttctcgcaaatgcctccggaccttgttggggaaaaaattgagaaagagcggttatatgatgctgtgaatgtcattctttctctacaaagtagcaatggtggtttcccagcatgggagcctcaaagagcatatggttggttggagaagttcaaccccacggaattctttgaagatacccttattgagcgagagtacgtagagtgcacttcacctgcagttcatggtctggcactctttaggaagttctatccccggcaccgggggacggagatagatagtagcatttacaggggaattcaatacattgaagacgtgcaagaacctgatggatcatggtatggtcattgggggatttgctacacctacggtacatggtttgctgtaggggcactggcagcttgtggaagaaactacaaaaattgtcctgcattgcgcaaatcttgtgaatttttgctatcaaagcagctacctaatggtggatggggagaaagttacctatcaagccaaaacaaggtgtggacgaatatagaaggcaaccgtgcaaatttggtccaaacagcatgggccttgttatccctcattgatgctaggcaggccgagatagatccaacaccaattcatcgtggagtaagagtattgatcaattcacagatggaagatggtgactttcctcaacaggaaatcactggagtatttatgcgaaactgcacactaaactactcatcatatagaaacatttttccgatatgggctcttggagaatatcggaggcgagttctatttgcatgaatgatacctgaatgagtaagcaaaggattgcatattgaccttcaggagcccaaattagcttgaaagagaatggtctctctaatgcatatgcaacaactttcatgtaattaagtatac

SEQ ID NO: 98654 - protein, 755 aa, Betula platyphylla
MWKLKIAEGGPGLVSGNDFIGRQHWEFDPDAGTPQERAEVEKVREEFTKNRFQMKQSADLLMRMQLRKENPCQPIPPPVKVKETEVITEEAVITTLRRSLSFYSSIQAHDGHWPGESAGPLFFLQPFVMALYITGDLNTIFSPAHQKEIIRYLYNHQNEDGGWGFHIEGHSTMFGSALSYIALRILGEGLEDGEDGAMAKSRKWILDHGGLVAIPSWGKFWVTVLGLYEWSGCNPLPPEFWFLPDIFPIHPGKMLCYCRLVYMPMSYLYGKRFVGPITGLIQSLRQELYNEPYHQINWNKARSTVAKEDLYYPHPLIQDLLWGFLHHVAEPVLTRWPFSMLREKALKAAIGHVHYEDENSKYLCIGSVEKVLCLIACWAEDPNGEAYKLHLGRIPDNYWVAEDGLKIQSFGCQMWDAGFAIQAILSCNLNEEYWPTLRKAHEFVKASQVPENPSGDFKAMYRHINKGAWTFSMQDHGWQVSDCTAEGLKVAILFSQMPPDLVGEKIEKERLYDAVNVILSLQSSNGGFPAWEPQRAYGWLEKFNPTEFFEDTLIEREYVECTSPAVHGLALFRKFYPRHRGTEIDSSIYRGIQYIEDVQEPDGSWYGHWGICYTYGTWFAVGALAACGRNYKNCPALRKSCEFLLSKQLPNGGWGESYLSSQNKVWTNIEGNRANLVQTAWALLSLIDARQAEIDPTPIHRGVRVLINSQMEDGDFPQQEITGVFMRNCTLNYSSYRNIFPIWALGEYRRRVLFA

SEQ ID NO: 98655 - DNA, 2514 bp, Betula platyphylla
  CDS (162)..(2435): k means g or t/u
cagcgctgcataataatgtcataaatctgtctcctctctctcatatacacattctgaatttcgtttttctttattttgtgatcattttctctgtacgctggagagatcaattttctctcagttgcgttgcagattggtgatcattgtgcgaatagtagacaatgtggaagctgaagatcgcggagggagggagtccatggctgcggacgttgaacaatcacgtcggacgacaagtttgggaattcgatcccaagctcgggtcgcctgaagagcttgccgagatcgaaagagctcgcgagacttctctgaaagtccgtttcgagaaaaagcatagctcagatctacttatgcggattcagttcgccaaggagaacccacgtggtgcagttctaccccaagtcaaagtaaatgaaacagaagatgttacagaggagatggtgacaaggatgttaagaagggctataagtttccactcaactctccaggcccatgatggacattgggcgggggactatggaggtccaatgtttcttatgcctggcttggtaatcactctgtctatcactggagcactaaatacagttttatctgaagaacataaaaaggaaatgtgccgttacctctataatcatcagaacaaagatggtgggtggggattacacattgagggcccaagtaccatgtttggtactgtcttaagctatgttacgttaaggttgcttggtgaaggagctaatgatgggcaaggagcaattgagagagggcgtaaatggattctggaccatggcagtgctactgcaattatatcatggggaaagatgtggctttcagtacttggagcatttgaatggtcgggcaataatccccttccccctgaaatatggcttcttccttacatgctccctgtacatccaggaagaatgtggtgtcactgtcggatggtctatttgccaatgtcttacttatatgggaagagatttgttggtccaatcacgccaacagttatgtctttgaggaaggagctttattctgtcccctatcatgaaatagattggaatcaggcacgcaacctatgtgcaaaggaakatctgtactacccacatccgctggtgcaggatatactttgggcatctcttcataagcttgttgaaccggttttaatgcgttggcctggaaaaagactgagagaaaaggctcttcgcactgtgttggaacatatacactatgaagatgaaaatactcgttatatttgcataggacctgtaaacaaggtgttaaatatgctctgttgttgggtggaagatccaaattccgaggcttttaagttgcatcttccaagaataaatgactatttgtggattgctgaagatggaatgaaaatgcagggttataatggaagtcaattatgggatactgcctttgctgttcaagctattatttcaaccaacctttttgaagaatatggtccaactctcgaaaaagcacatatgtacataaaaaaatcgcaggttcgagaagattgcccaggtgatcttgatttttggtatcgccacatttcaaaaggcgcttggcctttctcaactgccgatcacggatggcccatatcagactgcacagcagaaggattgaaagctgctcttttattatctaaaattccgccagatgttgttggtgaaccattagttgaagagcgattgtatgatgctgtaaatgtcattctctcattacagaatgcggatggtggctttgcaacatatgagctcacaagatcctatccctggttggagttgatcaaccctgctgaaacctttggggacattgttattgattataattatgtggaatgtacgtcagcagcaattcaagctctgacatcgtttaagaaatcatatcccaagcatcgggaggaggaggtagacgtctgtatcaaaagagctgctatgttcactgaaaagatacaagcatcagatggttcatggtatggttcttggggtgtttgcttcacttacggtacatggtttggggtaaaagggttagtggctgctggaaagaacttcaatgattgctttggtatccgcaaagcttgtgattttctgctgtctaagcagcttccttcaggtggctggggagagagttatctttcatgtcaaaacaaggtgtattcacatgtagagggcaacaggtctcatgttgtaaatactggatgggctatgttggcgcttatagaagctggacaggctgagagagacccaacgccattgcaccgtgcagctagggttttgataaattctcaaatggagaatggagattttcctcaagaggaaatcatgggggtcttcaataggaactgtatgattacctacgccgcttacaggaacatttttcctatttgggcattgggagagtaccgctgtcgggtattgcaggctccctaagctaacaatgtcgttattctcagtagtcagtacatttaagtaaagcgttgttgaaatcgccggaatgcaaaacaattcg

SEQ ID NO: 98656 - protein, 757 aa, Betula platyphylla
  misc_feature (309)..(309): Xaa can be Asp or Tyr
MWKLKIAEGGSPWLRTLNNHVGRQVWEFDPKLGSPEELAEIERARETSLKVRFEKKHSSDLLMRIQFAKENPRGAVLPQVKVNETEDVTEEMVTRMLRRAISFHSTLQAHDGHWAGDYGGPMFLMPGLVITLSITGALNTVLSEEHKKEMCRYLYNHQNKDGGWGLHIEGPSTMFGTVLSYVTLRLLGEGANDGQGAIERGRKWILDHGSATAIISWGKMWLSVLGAFEWSGNNPLPPEIWLLPYMLPVHPGRMWCHCRMVYLPMSYLYGKRFVGPITPTVMSLRKELYSVPYHEIDWNQARNLCAKEXLYYPHPLVQDILWASLHKLVEPVLMRWPGKRLREKALRTVLEHIHYEDENTRYICIGPVNKVLNMLCCWVEDPNSEAFKLHLPRINDYLWIAEDGMKMQGYNGSQLWDTAFAVQAIISTNLFEEYGPTLEKAHMYIKKSQVREDCPGDLDFWYRHISKGAWPFSTADHGWPISDCTAEGLKAALLLSKIPPDVVGEPLVEERLYDAVNVILSLQNADGGFATYELTRSYPWLELINPAETFGDIVIDYNYVECTSAAIQALTSFKKSYPKHREEEVDVCIKRAAMFTEKIQASDGSWYGSWGVCFTYGTWFGVKGLVAAGKNFNDCFGIRKACDFLLSKQLPSGGWGESYLSCQNKVYSHVEGNRSHVVNTGWAMLALIEAGQAERDPTPLHRAARVLINSQMENGDFPQEEIMGVFNRNCMITYAAYRNIFPIWALGEYRCRVLQAP

SEQ ID NO: 98657 - DNA, 2460 bp, Betula platyphylla
  CDS (48)..(2351)
gattgtagctcatcgtatccgcgaaaagaatttgacaaaactgtgcaatgtggaagttgaagatcggcgcagagacagccagaggagatggtggtggcggcggcggcagtgaaacatggctgaggagtttgaacaatcacttgggacgccaaatatgggagttccatccagagctcggcacccaagaagagcttcagcagatcgacgatgctcgccggaggttctgggaacgccgcttcgaaaggcggcacagctccgacctcctcatgcggattcagtttgcaaaggagaatccatcttctgcaaatataccacaagtcaaaattaaagatacagaggaggtcagagaggaggctgtaggaatgaccttacgaagggccatcaatttctactcaacaatacaggcagatgatggtcattggcctggggattatgggggtcccatgtttctaattcctggtctggtgattactctttcaattactggaactctaaatgctttcttatcaaaggaacatcaatgtgagatctgcagatatctctacaatcatcagaatgaagatgggggttggggtctacatattgagggcccaagcaccatgtttggtactgcactaaattatattactttgagattgcttggtgaacctgaggatggaatgggagctgtggaaaaagcacggaagtggatcttggatcatggtggtgcaactgcaatcacttcatggggaaaaatgtggctttcagtacttggagtgtacgaatggtctgggaataatccactgccaccagaagtatggctttgcccttatcttctcccatgtcatccaggaaggatgtggtgtcattgccgaatggtgtatttgcccatgtcatatttatatggtaagaggtttgttggtcctatcacatccacaatccaatctttgagaaaggagctttatacagtcccttatcatgagatcgattggaataaggctcgcaatgattgtgcaaaggaagatctatactacccccatccactggttcaggatatcctctgggcatctctttactatgcatatgaacccatttttatgtattggcctgcaaaaagattgagggagaaggctctggacactgtgatgcagcatatccactatgaagatgaaaatacacggtatatatgcatagggcctgtcaataaggtgttaaatatgctttgttgttgggctgaggatccaaactcagaggcattcaaattacatcttccaagaatcttagattatttgtggattgccgaagatggcatgaaaatgcagggatataatggaagtcaattatgggatactacttttgctgttcaagcgattatatcaactaatattgctgaagaatatggacaaactttaagaaaagcacatgagtacataaaggattcccaggtcttagaagattgtccaggagatctaaatttttggtatcgtcatatttcaaagggtgcttggccattctcaactgcagatcatggatggcctatttctgactgtacagcggaaggattgaaggctgttatattgctatcacaatttccatcagaaacagttgggaaatcggtagatgtgaagcggttatatgatgctgtacatgttatcctttccttacagaatactgatggtggctttgcaacttatgaattgaccagatcctaccattggttggagctaatcaatcctgctgaaacttttggtgatattgtcattgattacccatatgttgaatgtacatcagcagcaattcaagcactgacattattcaagaaattacatcctgggcataggagggaagaaatagaaaattgtattgctaaagctgcagagtttattgaaaatatacaagcatcagatggctcttggtatggatcctggggagtctgtttcacctatgctggctggtttgggataaaggggttggttgctgctggaaggacatacaagaattgttctagcatccacaaggcatgcgattatctgttgtccaaagagctcgcttcaggtggttggggagaaagttacctatcatgtcaggacaaggtgtataccaatctcaaagataataggccacatattgtcaatactggatgggctatgttggccctcattgatgccggacaggctgagagagatccaaccccattgcaccgagcggcaagaatactaataaattctcaaatggagaatggagattttcctcaagaggagattatgggagttttcaacaagaattgtatgatcagctattctgcataccgaaacatttttcctatctgggcccttggagaatatcgttgtcgggtattgaaggccctctgatacctgaatgggtaagcaaaggattgcatattgaccttcaggagcccaaattagcttgaaagagaatgggctctctaatgcatatgcaacaactttcatgtaattaagt

SEQ ID NO: 98658 - protein, 767 aa, Betula platyphylla
MWKLKIGAETARGDGGGGGGSETWLRSLNNHLGRQIWEFHPELGTQEELQQIDDARRRFWERRFERRHSSDLLMRIQFAKENPSSANIPQVKIKDTEEVREEAVGMTLRRAINFYSTIQADDGHWPGDYGGPMFLIPGLVITLSITGTLNAFLSKEHQCEICRYLYNHQNEDGGWGLHIEGPSTMFGTALNYITLRLLGEPEDGMGAVEKARKWILDHGGATAITSWGKMWLSVLGVYEWSGNNPLPPEVWLCPYLLPCHPGRMWCHCRMVYLPMSYLYGKRFVGPITSTIQSLRKELYTVPYHEIDWNKARNDCAKEDLYYPHPLVQDILWASLYYAYEPIFMYWPAKRLREKALDTVMQHIHYEDENTRYICIGPVNKVLNMLCCWAEDPNSEAFKLHLPRILDYLWIAEDGMKMQGYNGSQLWDTTFAVQAIISTNIAEEYGQTLRKAHEYIKDSQVLEDCPGDLNFWYRHISKGAWPFSTADHGWPISDCTAEGLKAVILLSQFPSETVGKSVDVKRLYDAVHVILSLQNTDGGFATYELTRSYHWLELINPAETFGDIVIDYPYVECTSAAIQALTLFKKLHPGHRREEIENCIAKAAEFIENIQASDGSWYGSWGVCFTYAGWFGIKGLVAAGRTYKNCSSIHKACDYLLSKELASGGWGESYLSCQDKVYTNLKDNRPHIVNTGWAMLALIDAGQAERDPTPLHRAARILINSQMENGDFPQEEIMGVFNKNCMISYSAYRNIFPIWALGEYRCRVLKAL

SEQ ID NO: 98659 - DNA, 2410 bp, Cephalosporium caerulens
  CDS (46)..(2328)
aagcaattccatcagttgccagcgaaaaataatcctagactcaacatggctcgcgccacgggaagtgaagctcaggagactgagcaagccttgtcgcgcaaaaggtccagcggcccctgtggtgaagggcccaagcatgacttccccaagaggcccaagatcgagaaaggcacagatcccacccgctggcgcatgagagacgatgaaagtcgacacacatggcattatcttccatctgaggaagccgcaaaggcttggcctcagacatgtgctgacaagtattacctaaacctacctctggggcttccctcactgccccagcccaccacgccactggatagcgctcgcaatggcctgacgttttttgagaagctgcaactgccttctggtcactggggttgcgagtatggtggcccaatgttccttttgcctggcatcgtcatcgcttggtacgtgacgaggactcctataccctcggcctatgccacagccatgaaggactacctctctgcacgggcaaaccaggatggtggatggggtcttcacatcgaaggcgagacatcggcttttggtactgcattgaattacaccgcgttgaggctggtgggtgtcgaggcaaacgaaccgatgatgatcaaggctcgagctgctctacacaggcttggaggcgccttgaacgcaccgcactggaccaaattctggcttgctgtactcggtgtcatggattgggatgtcgtgaaccccgttcctcccgagctctggctcctgccagactgggttccaatcgccccctggcgctggtggattcatatccgccaagtctacctcccaatgggttatctttactccaaaaggtggagttgtgaggaaaccgagaccacacgaagcttgaaagaagaactcttcgttcagccacacgctgagattaactgggcagcacaccgaaacgatatctccgtcatggacaattatcaccctaagagctgggtcctgaatacggccaactggttcctggtcaacatctggaacccttacctacgtacaaatgggatcaaggaacgggcggagaagtggaccagtgagctcattgacatggaggacaagaataccgactattctgatctggctcctgtaaacgcaccgatgaacacagtggcatgctacgttagggacgggccggattcctactccgttcgtcgacatctggagcgcctagaggagtgtctatgggtgaaggatgagggcatgctcgtgaatggtaccaacggcgtacagtgttgggacacctcgttcctggtggctgccttctgtgaagctggcctgcaccacgaggatagatggcaaccaatgctgcgcagagcgctcgaattccttgagaagcagcagctgcgagaaaacgtgcaggaccaggctaagtgttaccgacagacaagaaagggtggctggcccttcagcaataaggaccagggctacgctgtgagtgattgtacctcggaagctctgaaggctgttatcaaactgcagaagacccagggcttcccgcagttgctagatgaccgtcgcatcttcgatacggttgatacactcctcttgtatcagaatgacgacacgggtgcctgttcatcttatgagaaccgcagagctggagagtggatggagatgttcaacgctgccgaggtttttggcaacattatggtcgagtatgactaccccgagtgcacaacatcatgtgttacagccctcaatctgttcagaaaacactggcccgagtatcgtgcggaagacatcgagaagtttatcaagagggcaacgaactggattcgagggtcttcattacacctctcaagcggtggccgcatggcagggtggtacggaagctggggcatttgctttacatatgctactatgtttggcttagagagcctggcaagcattggggagacctattcaaattcggatgttgccaagagagcttgcgattaccttctgtccaaacagagggaagacggcggctggtcagagagctacaagtcttgcgagaccatgcaatggcacgaacatcccgatgggtctcaggttgtgcagactgcctgggccttgattgccctcatgcatggacagtgccctgatattgcagccatgaagcgaggtatcaagctcatcatggagcgccagcaaccgaacggcgaatggcttcaggaagcgattgaaggtgttttcaacaagtcttgcatgatctcataccccaactacaagttcatcttccccattaccgcactggggatgtttggcaacaggtacccggatgagaagatcgacctcaactgaagtaaaaagtagaacaatagcgcatgcagatacttagtctaatctaatacataatactctctggtgataaaaaaaaaaaaaa

SEQ ID NO: 98660 - protein, 760 aa, Cephalosporium caerulens
MARATGSEAQETEQALSRKRSSGPCGEGPKHDFPKRPKIEKGTDPTRWRMRDDESRHTWHYLPSEEAAKAWPQTCADKYYLNLPLGLPSLPQPTTPLDSARNGLTFFEKLQLPSGHWGCEYGGPMFLLPGIVIAWYVTRTPIPSAYATAMKDYLSARANQDGGWGLHIEGETSAFGTALNYTALRLVGVEANEPMMIKARAALHRLGGALNAPHWTKFWLAVLGVMDWDVVNPVPPELWLLPDWVPIAPWRWWIHIRQVYLPMGYLYSKRWSCEETETTRSLKEELFVQPHAEINWAAHRNDISVMDNYHPKSWVLNTANWFLVNIWNPYLRTNGIKERAEKWTSELIDMEDKNTDYSDLAPVNAPMNTVACYVRDGPDSYSVRRHLERLEECLWVKDEGMLVNGTNGVQCWDTSFLVAAFCEAGLHHEDRWQPMLRRALEFLEKQQLRENVQDQAKCYRQTRKGGWPFSNKDQGYAVSDCTSEALKAVIKLQKTQGFPQLLDDRRIFDTVDTLLLYQNDDTGACSSYENRRAGEWMEMFNAAEVFGNIMVEYDYPECTTSCVTALNLFRKHWPEYRAEDIEKFIKRATNWIRGSSLHLSSGGRMAGWYGSWGICFTYATMFGLESLASIGETYSNSDVAKRACDYLLSKQREDGGWSESYKSCETMQWHEHPDGSQVVQTAWALIALMHGQCPDIAAMKRGIKLIMERQQPNGEWLQEAIEGVFNKSCMISYPNYKFIFPITALGMFGNRYPDEKIDLN

SEQ ID NO: 98661 - DNA, 2551 bp, Luffa cylindrica
  CDS (130)..(2409)
gttaggtataaattaaaagtcctcctcctccctccacagccggccatgaacaactagcttagattaagtttattatgatttgagaatataggttggtgggtaaagacgattgagttgaggtgattgatcatgtggaggcttaaggtagcagatgggggaaatgacccctacatctattccatgaacaacttcataggaaggcaaatatgggagttcgatccaaatgctggcacccccgaagagcgagcagaaattgaacgcctccgtcaccatttcaccaaaaaccgtcacaagggttttcctagcgccgatttgctttggcgtgtccagcttctgagggagaaaaatttcaaacaaagtatcccagcagtaaaggttggagatggagaagaaataagttatgaaatggcattagatgcaatgaggagaggggcacatttcctagcggccatacaggcgagtgatggacactggccgagtgaaacatcaggcccactattttacgtttgtcccttgctaatttgcatgtacataatgggttttatggataaagtatttagtcccgagcacaaaaaggaaatgatgcgttacatttacaaccatcagaatgaagatgggggatgggggttacacgtaggtggtcacagtaacatgttttgcactaccttcaattatatctctttacgtttacttggtgaagaacctgatgttgaggcagtttgcaaagccagaaattggatccatgaccatgatggtgtcacctccatactttcttggggaaagacatggctctcgatattaaacgtgttcgattggtctgcgagcaaccccatgcctcctgagtattggatgttgcccacttgggtccccattcatccatcaaacatgatgtgctacactcgaatcacctacatgcccatgtcttacttgtatggcaaaaggtttcaagcacctctaacgcctcttgttttacaattaagagacgaacttcacacccaaccctacgatcaaattaactggaggaaagttcgtcacatgtgtgctacggaagacctctactttccacatccctttgttcaagacctactttgggacactctttacttactcagtgaaccactcatgactcggtggccttttaacaaactgattcgccaaaaagccctgaatgaaactatgaggcatattcattatgaggatgaaaacagtcgctacattaccattggctgcgttgaaaagcctttatgcatgcttgcttgctgggttgaagatccgaatagtgagtatgtgaagaaacatttagcacgaattcctgattatttatggatggccgaagatgggatgaaaatgcaaagttttggtagccagtcatgggatgctgctttggccatgcaagctctgctttcttgtaatatcacacgtgaaattgggtctgtgctcaattctggccatgatttcatcaagaactcccaggttagaaacaatcctcccggtgactacaaaagtatgtttcgctatatgtccaaaggatcttggaccttttcagactgtgatcatggatggcaagtgtcggattgcactgccgagaacttgaagtgttgcctactattgtcgttgctaccacctgacatagttggtgagaagatggaacctgaacgtttctacgatgctgtcaatgtcattctaaatatgcaaagcaaaaacgggggtttgccagcttgggagccagcgtcaagttactactggatggagtggttgaatccagtggaatttcttgaagacctaatcatcgagcaccagcatgtggagtgcacctcatctgcgttgcaggcgatactcttatttaggaaacaatacccaggacatagaagaaaagaaatcaataatttcatcaacaaggccgttcaatttcttcaagacatacaactgccagatgggtcttggtatggaaattggggaatttgctatacttatggaacgtggtttgcacttaaggcattgtcgatggcagggaagacgtatgaaaattgtgaggcagttcggaaaggtgcgaattttctaagaaaaatacagaatccagaaggagggtttggagagagctacttgtcatgtccttataagagatatataccgctggatgggaaacgatcaaatttggtgcaaacggcatggggtatgatgggtttgatatgtgcaggacaggcagatgtagatcccactcctattcatcgtgcagccaagttgttgatcaattctcaaacggaagatggtgattttcctcaagaggaaattactggagaattcttcaaaaattgtacattacactttgcagcatttagggaagtctttcctgtgatggcgttgggagaatattgtaacaaggttccgttgccttctaagaaaaaatagtaaattaagattggagacttttactcttcaataatctttaaacggtcacgtgtaatataataacttttttttttttttttttttgaaaagacgtgtagtataatactaaacaaaaggtaatcgagcacaacttttaattccc

SEQ ID NO: 98662 - protein, 759 aa, Luffa cylindrica
MWRLKVADGGNDPYIYSMNNFIGRQIWEFDPNAGTPEERAEIERLRHHFTKNRHKGFPSADLLWRVQLLREKNFKQSIPAVKVGDGEEISYEMALDAMRRGAHFLAAIQASDGHWPSETSGPLFYVCPLLICMYIMGFMDKVFSPEHKKEMMRYIYNHQNEDGGWGLHVGGHSNMFCTTFNYISLRLLGEEPDVEAVCKARNWIHDHDGVTSILSWGKTWLSILNVFDWSASNPMPPEYWMLPTWVPIHPSNMMCYTRITYMPMSYLYGKRFQAPLTPLVLQLRDELHTQPYDQINWRKVRHMCATEDLYFPHPFVQDLLWDTLYLLSEPLMTRWPFNKLIRQKALNETMRHIHYEDENSRYITIGCVEKPLCMLACWVEDPNSEYVKKHLARIPDYLWMAEDGMKMQSFGSQSWDAALAMQALLSCNITREIGSVLNSGHDFIKNSQVRNNPPGDYKSMFRYMSKGSWTFSDCDHGWQVSDCTAENLKCCLLLSLLPPDIVGEKMEPERFYDAVNVILNMQSKNGGLPAWEPASSYYWMEWLNPVEFLEDLIIEHQHVECTSSALQAILLFRKQYPGHRRKEINNFINKAVQFLQDIQLPDGSWYGNWGICYTYGTWFALKALSMAGKTYENCEAVRKGANFLRKIQNPEGGFGESYLSCPYKRYIPLDGKRSNLVQTAWGMMGLICAGQADVDPTPIHRAAKLLINSQTEDGDFPQEEITGEFFKNCTLHFAAFREVFPVMALGEYCNKVPLPSKKK

SEQ ID NO: 98663 - DNA, 2456 bp, Arabidopsis thaliana
  CDS (1)..(2286)
atgtggagactgcgaattggagctgaggcaagacaagaccctcacttgttcaccacgaacaactttgccggaagacagatctgggagtttgatgccaacgggggctctcctgaggaactcgccgaggtcgaggaggctcgcctcaatttcgcaaacaacaagtcacgtttcaaggctagtcccgatctcttctggcgtaggcagtttctgagggagaaaaagttcgagcagaagatcccgagagtgagaatagaggatgcagagaagataacatatgaagacgcaaagacggcactaagaagaggagtactctattacgcggcatgtcaggctaacgatggccattggccttctgaagtctctggttccatgttcttggacgctccctttgtgatatgcttgtacattaccggacacctggagaaaatctttacactagagcatgtcaaagagttactccgttacatgtataacactcagaatgaagatggtgggtgggggttagatgtggaaagccacagtgtcatgttttgcacggtcctcaactacatctgcttacgtattttgggagtagaaccagatcatgacggtcaaaaaagtgcatgcgcaagggctcgtaaatggatcctagaccatgggggtgccacgtatgcgcctatggtggctaaagcttggctttcggttctaggagtgtatgactggtctggttgcaaaccgctaccacccgagatttggatgctcccttctttttctcccattaatggaggtactctatggatatatatccgggatcttctcatgggcatgtcatatttgtatggtaaaaaatttgtagctacaccaaccgctctcattctacagctccgagaagaactttatccccagccttacagcaaaatcatttggagcaaagcccgtaatcgatgcgcaaaggaagatctattatatccaaagtcatttggacaagatttgttttgggaaggtgttcatatgctttcggagaatatcataaaccgctggcctctcaacaagtttgttagacaaagagcactacgaaccacaatggaacttgttcactaccatgatgaaacgacccactatatcacaggtgcatgtgttgcgaagccgtttcatatgcttgcttgttgggtagaagatcctgatggtgattatttcaagaaacatcttgctcgagtccctgatttcatatggattgctgaagatggccttaaatttcagttaatggggatgcagtcgtggaatgcagccctctccctccaagttatgttagccgcaaacatggatgacgaaattcgatcaaccctgataaaaggatacgacttcttgaagcaatctcagattagcgagaaccctcaaggtgaccatctgaaaatgtttagagacattacaaaagggggatggacttttcaagatcgagaacaagggttgccgatttcggatggtacagcagaaagtatagagtgctgcatacacttccaccgcatgccctccgagttcatcggcgaaaaaatggatgtagagaagctctatgatgccgtcaattttctaatctatttgcagagtgataatggaggtatgccagtttgggagccagctcctggaaaaaaatggctagagtggcttagtccggtggagcatgtggagaacacagttgtggagcaagagtaccttgagtgtacgggctcggtgattgcgggattggtttgcttcaagaaagagtttcccgatcacagaccgaaagagatcgaaaagttaataaaaaaaggcctaaaatacatagaggacttgcaaatgccggacggttcatggtacggaaactggggagtttgtttcacgtatggtactctctttgcagtaagaggtctagcggctgcagggaagacttttggcaactctgaagctatacgtagagctgttcagtttattctcaacacgcaaaacgccgaaggcggttggggagaaagtgctctctcttgccctaacaagaaatatattccttctaaaggaaacgtgacgaatgtggttaataccggacaagctatgatggttttacttattggtggtcagatggagagggacccttctcctgttcatcgcgccgccaaagtgttgattaactcacagttggatattggcgatttcccacaacaggaaagaagggggatctacatgaatatgctgctgcattatccaacctatagaaacatgttctctctttgggctctcgcattgtacacaaatgctctgcgtctgcttgtttcttgacgacttcacatttaaatcttaataatgaatcaccatcggtttgatgctatatgtatatcctatctgtatatctttcttgtttgtccctaaatgacataaaaataaaactatttgtgtacaaagtgtttgttgtttatatttgatttaaggaataacgaaatatttcatat

SEQ ID NO: 98664 - protein, 761 aa, Arabidopsis thaliana
MWRLRIGAEARQDPHLFTTNNFAGRQIWEFDANGGSPEELAEVEEARLNFANNKSRFKASPDLFWRRQFLREKKFEQKIPRVRIEDAEKITYEDAKTALRRGVLYYAACQANDGHWPSEVSGSMFLDAPFVICLYITGHLEKIFTLEHVKELLRYMYNTQNEDGGWGLDVESHSVMFCTVLNYICLRILGVEPDHDGQKSACARARKWILDHGGATYAPMVAKAWLSVLGVYDWSGCKPLPPEIWMLPSFSPINGGTLWIYIRDLLMGMSYLYGKKFVATPTALILQLREELYPQPYSKIIWSKARNRCAKEDLLYPKSFGQDLFWEGVHMLSENIINRWPLNKFVRQRALRTTMELVHYHDETTHYITGACVAKPFHMLACWVEDPDGDYFKKHLARVPDFIWIAEDGLKFQLMGMQSWNAALSLQVMLAANMDDEIRSTLIKGYDFLKQSQISENPQGDHLKMFRDITKGGWTFQDREQGLPISDGTAESIECCIHFHRMPSEFIGEKMDVEKLYDAVNFLIYLQSDNGGMPVWEPAPGKKWLEWLSPVEHVENTVVEQEYLECTGSVIAGLVCFKKEFPDHRPKEIEKLIKKGLKYIEDLQMPDGSWYGNWGVCFTYGTLFAVRGLAAAGKTFGNSEAIRRAVQFILNTQNAEGGWGESALSCPNKKYIPSKGNVTNVVNTGQAMMVLLIGGQMERDPSPVHRAAKVLINSQLDIGDFPQQERRGIYMNMLLHYPTYRNMFSLWALALYTNALRLLVS

SEQ ID NO: 98665 - DNA, 3057 bp, Abies magnifica
  CDS (503)..(2773)
attaatttctccgagtctaaagtcttctcttttgaagattacacggtctgaacttacatatacctgttatgcgttgaaccgtggtggggtgcggagtaatagaaagccctccttgatattctaccttttaccagcgatagccttcaatcgcaactcgatctgaagcttaaaaccttccagcactaaacaaaacggcagatcggagcatttggagtcagtttccgacaattatattcctagtttcagtttggagttcagcatttcgttccaacattttaattttaagagtactgagtatagagaatttgaacgagccggcaagcaagaggatgaactcgttgaggattgagttcttcgacactcatgatgtaaaacgaaacaaacatcattggcgttgagaatcaggaaccaagaatatcgcaaactgtgggataggtagagttagaactgcaatctgtgtgtttctgttgaaattccagattgtgcattggaagaattggcaatgtggaagctgaagattgctgaggggggaagcccctggttgcagaccttgaacaatcacgtgggaagacaagtgtgggaatttgatccaaaagctggtacatctgaggaccaccttgctgtagaaaaagctcgtgtagacttttataacaagagatttattcaacaccatagtgctgatcttcttatgaggttgcagtgtggtggagaaaatccactctcacctcttccagctcaagtaaaattagaaagtgctaatgacatcactgaggaggtaatacaaactacattggtgcgagcaatacgcttttatgccactattcaagcacacgatggacactggcctggtgattatggtggtccaatgttccttatgccaggtttggttattgccttgtatgtgacaggagcactaaatgcagttttatctgaaatgcataaaaaggaaatttgtcgttatctatataaccatcagaatgaagatggtggatggggtttgcatattgaggggcacagcacaatgtttggaaccgtgttaaactatgttactttgagacttcttggacaagcacctgatggagggcaaggagccatggaaaaggggtgtgcatggattttggatcatggtggtgccactgcaataccttcctggggaaaaatgtggctctcagtacttggagtatttgattggactggaaacaatccattgcctccagaaatgtggctcctcccttattttcttccaacccatccagggagaatgtggtgtcactgtcgaatggtttatttgccaatgtcatatatatatggacggagatttgtgggtcctctaactggaattgttatgtctttaagggaagagctctatacagtgccttatgagaaaatagattggaatcaagcacgtagcatgtgtgcaaaggaagatctttactacccacatccttttctacaagatatcctatggggaactcttcataaagtagtagagcctgcacttatgcattggccaggatcgatgctacgggagagggcacttcagtcagtgatgaagcatatacattatgaggatgaaaacactcgctacatctgcattggccctgttaacaaagtattgaatatgctttgttgctgggtagaagattcaaactcagaggcatttaaaaggcatcttgctcgagtcgtagactatctatgggttgcagaagatggcatgaagatgcagggatacaatggcagtcagttatgggatacagcatttgctacgcaagctcttatatcgaccaacctccttgatgattgtggtccactgcttaagaaggcacatatatatatagaaaggtcacaggttcaagaagattgtccaggtgatttgaatttctggtatcgccatatttctaatggtgcctggcctttctcgacaagggatcatggttggccaatttcagactgctcttctgaaggcctaaaggccgcattagcattgtcacaattgcctcaagacattgtggggaaaccaattccctcgcaacggatttttgattgtgtcaatttgatgctttctatgcagaatagcgatggtggttttgcaacttatgaattgacaagatcctatccttggctagagaaaatcaatcctgcagagacatttggagatattgtcattgactattcgtatgtggagtgcacttcagcaataactcaagctcttgtatcgtttaagaaactgtatccagagcaccgacacaaagaaatagaaacatgcattttaaaggccacccggtacattgaaaacatccagaggcctgatggttcatggtatggttcatggggagtctgcttcacatatggtacatggtttggtgttctggggttagcagcggctggaaaaacctaccaaaactgttcaaatattcgtaaagcttgcgagttccttctttcaaagcagcttccttctggtggctggggagaaagttatctttcatgccaagagaaggtctatacacacttggagggtggaagatcacacatagtaagcacggcatgggctatgcttgctcttatttatgctggccaggctttgagggatccaaaacctcttcatcgagcagcaattgtactagtcaattatcagatggagaatggtgattttccacaacaggaaattatgggagtattcaataggaattgtatgatctcttactctgcctatcggaatatctttcctatatgggctctaggggaatattgccgtcatgtactgcaatcataatgtatagatttctcatatattttaagggtaagtttttgggataaaccttacaggtatttttgcaggaggcaggattgatctctatggatcagcgattgaagaataaaaataattttcaacttttattgacttctactcaagcttgcatgaaagaaaacttggtaatgtctctcatgtgatgatactcaattttatatttgatcatgactgaagcaattgtatcacccataattattacggtactaaactttctactgcttagatcataattgaagaaaaaaaaa

SEQ ID NO: 98666 - protein, 756 aa, Abies magnifica
MWKLKIAEGGSPWLQTLNNHVGRQVWEFDPKAGTSEDHLAVEKARVDFYNKRFIQHHSADLLMRLQCGGENPLSPLPAQVKLESANDITEEVIQTTLVRAIRFYATIQAHDGHWPGDYGGPMFLMPGLVIALYVTGALNAVLSEMHKKEICRYLYNHQNEDGGWGLHIEGHSTMFGTVLNYVTLRLLGQAPDGGQGAMEKGCAWILDHGGATAIPSWGKMWLSVLGVFDWTGNNPLPPEMWLLPYFLPTHPGRMWCHCRMVYLPMSYIYGRRFVGPLTGIVMSLREELYTVPYEKIDWNQARSMCAKEDLYYPHPFLQDILWGTLHKVVEPALMHWPGSMLRERALQSVMKHIHYEDENTRYICIGPVNKVLNMLCCWVEDSNSEAFKRHLARVVDYLWVAEDGMKMQGYNGSQLWDTAFATQALISTNLLDDCGPLLKKAHIYIERSQVQEDCPGDLNFWYRHISNGAWPFSTRDHGWPISDCSSEGLKAALALSQLPQDIVGKPIPSQRIFDCVNLMLSMQNSDGGFATYELTRSYPWLEKINPAETFGDIVIDYSYVECTSAITQALVSFKKLYPEHRHKEIETCILKATRYIENIQRPDGSWYGSWGVCFTYGTWFGVLGLAAAGKTYQNCSNIRKACEFLLSKQLPSGGWGESYLSCQEKVYTHLEGGRSHIVSTAWAMLALIYAGQALRDPKPLHRAAIVLVNYQMENGDFPQQEIMGVFNRNCMISYSAYRNIFPIWALGEYCRHVLQS

SEQ ID NO: 98667 - DNA, 2301 bp, Arabidopsis thaliana
  CDS (1)..(2301)
atgtggagactaagaattggagctaaggccggaaatgatactcacttgttcacgaccaacaactatgttgggaggcagatttgggagtttgatgccaacgcaggctcccctcaagaacttgccgaggtcgaggaggctcgtcggaatttctctaacaataggtcacattacaaggccagtgctgatctcttatggaggatgcagtttcttagggaaaaaggttttgaacagaagattccacgtgtgagagtagaggatgcagcgaaaataaggtatgaagatgcaaaaaccgcattgaaaagaggattacattattttacggccttgcaggcagatgatggacactggcctgcagataactctggtccaaatttcttcatcgctcctttagttatatgcttgtacattactggacatctggagaaaatctttacagtcgagcatcgtatagagttaatacgttacatgtataaccatcagaacgaagatggtgggtggggattacatgtagaaagccctagtattatgttttgtacagtcatcaactacatttgtttacgaatcgtgggagtagaagccggtcatgatgatgatcaaggaagtacttgtacaaaggctcgtaagtggatactcgaccacggtggtgctacctacacacccttgatcggaaaagcttgcctatcagttcttggagtgtatgattggtctggctgcaaacctatgccgccagagttctggttccttccttcttcttttcctattaatggaggaactctatggatttatttacgggatattttcatggggttgtcatacttgtatggtaaaaaatttgttgcaactccaacacctctcatcctccagctccaagaagagctttatccagagccttacaccaaaatcaattggaggcttaccagaaaccgatgtgcaaaggaagatctctgttatccatcctcatttttacaagatttgttttggaaaggtgttcatatcttctcagagagtattctaaatcgatggcctttcaacaagctcataagacaagcagctcttcgaaccactatgaaactccttcactatcaagatgaagccaatagatacattacaggcggatcagtgccaaaggcctttcatatgcttgcatgttgggtagaagacccagagggtgaatattttaaaaagcatcttgctcgagtctctgatttcatatggattggcgaggatggcctcaaaattcagtcttttggcagccaattgtgggatacagtcatgtcgctacatttcctgttagacggtgttgaggatgatgtcgatgatgaaattagatccacgctcgttaaaggatacgattacttgaagaaatctcaagttacagagaatcctcctagtgatcacataaaaatgttccgccatatttcgaaaggtggatggacgttttcggacaaagatcaaggatggcctgtttcagactgcactgctgagagtttaaaatgctgtctattatttgagaggatgccgtcggagtttgttggccagaaaatggatgtggagaaactctttgatgccgttgattttcttctctacttgcagagtgataacggaggtataacagcttgggaacccgcggatgggaaaacctggttagagtggtttagtccggtggaatttgttcaagacacggtcatcgagcatgagtatgtggaatgtacagggtcagccattgtagcgttgactcagtttagtaaacaattcccggagtttagaaagaaagaggttgaaaggtttataactaacggagtgaaatacattgaggatttgcaaatgaaggatggttcatggtgcggaaactggggagtgtgctttatctatgggaccttatttgccgtaagaggtcttgtggctgcaggaaagactttccataactgtgaacccattcgtcgagcagttcgtttccttctcgacacgcaaaaccaggagggtggttggggagagagctatctctcttgcctaaggaagaaatatactcctttagcaggaaacaagacaaatatagtgagtacaggacaagcgcttatggttctaattatgggtggtcagatggagagagatcctttgccggttcatcgtgctgccaaagtagtgatcaatttacagttggataacggtgatttcccgcaacaggaagtaatgggagtattcaatatgaatgtgctgctccattatccaacatataggaacatttattctctttgggccctcacactatacacgcaagctctacggcggcttcagccttga

SEQ ID NO: 98668 - protein, 766 aa, Arabidopsis thaliana
MWRLRIGAKAGNDTHLFTTNNYVGRQIWEFDANAGSPQELAEVEEARRNFSNNRSHYKASADLLWRMQFLREKGFEQKIPRVRVEDAAKIRYEDAKTALKRGLHYFTALQADDGHWPADNSGPNFFIAPLVICLYITGHLEKIFTVEHRIELIRYMYNHQNEDGGWGLHVESPSIMFCTVINYICLRIVGVEAGHDDDQGSTCTKARKWILDHGGATYTPLIGKACLSVLGVYDWSGCKPMPPEFWFLPSSFPINGGTLWIYLRDIFMGLSYLYGKKFVATPTPLILQLQEELYPEPYTKINWRLTRNRCAKEDLCYPSSFLQDLFWKGVHIFSESILNRWPFNKLIRQAALRTTMKLLHYQDEANRYITGGSVPKAFHMLACWVEDPEGEYFKKHLARVSDFIWIGEDGLKIQSFGSQLWDTVMSLHFLLDGVEDDVDDEIRSTLVKGYDYLKKSQVTENPPSDHIKMFRHISKGGWTFSDKDQGWPVSDCTAESLKCCLLFERMPSEFVGQKMDVEKLFDAVDFLLYLQSDNGGITAWEPADGKTWLEWFSPVEFVQDTVIEHEYVECTGSAIVALTQFSKQFPEFRKKEVERFITNGVKYIEDLQMKDGSWCGNWGVCFIYGTLFAVRGLVAAGKTFHNCEPIRRAVRFLLDTQNQEGGWGESYLSCLRKKYTPLAGNKTNIVSTGQALMVLIMGGQMERDPLPVHRAAKVVINLQLDNGDFPQQEVMGVFNMNVLLHYPTYRNIYSLWALTLYTQALRRLQP

SEQ ID NO: 98669 - DNA, 2718 bp, Trypanosoma brucei brucei
  CDS (1)..(2718)
atgctataccagagaaggggcaggggcgagatgcacagacccggcattcgaaccattgttggaagtggtaactctacacccagttcactatgcgcaccgttcccgtttgatagtgtgatcccgccgccaccaagaggcttgttggagcgctttctgcggcgactgacctcaaccatctcatgggtggtttcgtttcttctcgtcgtttgctcgattccctttctgcttctcatccacgcgctactggtctactgtgatggatataatcgtgaagttgtcgcgcgacatcgtagaaaatggctacaccaaacggttccacacgtaagaccagtgagggtggcgccgtctcccaactttccccttgagggttggcatatgcgctgcgaggacggccgtcagcgctggcactacggtcggctgctcaatgtggaggaggggaatgaactcgggaaggcccaggctgagggatgtccgtacaccccttatggtgaggctggaaatgctaatgatgactttgaggatacaggcgcaacaaggactggcccacgaggtggtccggacatgcgtgcagtgaaggaagagcgatgccgctttgttgagcgatatcaattgggtctcacaggcacggctcatgtaaagcctagggggtctgtggaagaggccatgcgagcaggcgctgagttcttattgcgcctacagcacccatattccggtcattggccaaatgactatagcgggcccctatttcttacccccggtgttatctttgttaggtacattgtggctcgtggcaacattcgcaatatgttcccaccccatgcagatcaccatcacgagggagacgagccgtgcctctgtggagaagcagagcgactagaacttatacgttacatacgaaactatatgaacgaggacggtggctttggtcaacatactgagggacacagcaccatgcttgggactgtcctcaattacgttgcactacgactcatgggggtttcagatgatgacagcgacgcggctcgcgctcgtcagtggatccgtggtgaaggcggtgctgtttccattcccacgtggggtaaggtgtggctatgtgtccttggtctgtacgaatgggacggcgttaaccccattccaccggagttgtcattgctgcccaactggataccgttttcaccgagccgcctgtggtgtcacagtcgtgtcgtttccatagccttctcgtacttgtatggtttgcgatggaggcagcccgataatctacttcttcaatgcctgcggtacgagatttaccttgagccatatggaaacattaagtgggctaagcatcgaagcaacatttgtgccaaggactgctatacacctctttcttccgtgtacaaagttttcgccgccgttatgagtttgtatgagaagcggcccatcaaatttcttcgcaggcgggcgctggaggtagcatggacccatattgcttacgatgatgaaagcacacatttcatatgccttgggccggtgaacaaggcgttcgacatgctcataacgtggatacgtgagggagaaactagtggaaggtacctaaaccaccttaatcgtctcgatgattatttcttcatgggacctgaagggcttaggatgagtggttataacggttcacaattatgggacacgtcgttcgctgtacaggccctctgcgcctgcaacatggagttgttgtaccctgaggagatggcccttgctcatcactacgtagatgttgcgcaggtgcaggagaatccggtggcagcgacacagttttaccgccatcggacgaaaggtgcgtggaacttcagtacacgcccgcaagcgtggcaggtgtcagattgcacagccgaagggcttcgtgtattgctgctgctccgtcacaagccatttcctcaccaacgcatttatgacgctgtggatcagattttgtccctgaggaatcgaggcggcgggtgggcttcttatgagccaacttgcgcaccccactacgtagaacttctcaactgctcggatgtgttcaaggatgtcatgactgactacgtctacacggagtgcacaagcagttgtgtgcacacactctcgcttttccgagagcactttcccgactaccggcgggaggatgtagatagggccattcgcgatggtgtgaagtgcatgctggcgaaccagcggacggatggttcgtattacggaagttgggccgtatgctttacatatgctgcttggctctgcgctagtgcgcttcgcatatctggtgagatttacagcatggagagacatccgacgtgtgtgcgcctcgttaactttttgttgtcacaccagaatacggacggcggttggggggaggatgtgagcgcgtgcgctcgtggtgtgtgggttgataatccaagtggaagtcaagtcgtcaacactgcgtgggcggtcatggctatcatggctgcctctggcgaagcgagctcaaccgaactgcgccgccagcttcgtattctaaaggctgtaagtgcaggtattcactttattgtgtcgcgtcagctatcaacaggtgactgggcacaagagcgaattagcggtgtgtttaacggtaacaacccgattcactacccaggatataaaaataccatgccagtgtgggcactgggggtgtacaggcgctggagtaaaacatatggtcaacattttccccgatcgatggattag

SEQ ID NO: 98670 - protein, 905 aa, Trypanosoma brucei brucei
MLYQRRGRGEMHRPGIRTIVGSGNSTPSSLCAPFPFDSVIPPPPRGLLERFLRRLTSTISWVVSFLLVVCSIPFLLLIHALLVYCDGYNREVVARHRRKWLHQTVPHVRPVRVAPSPNFPLEGWHMRCEDGRQRWHYGRLLNVEEGNELGKAQAEGCPYTPYGEAGNANDDFEDTGATRTGPRGGPDMRAVKEERCRFVERYQLGLTGTAHVKPRGSVEEAMRAGAEFLLRLQHPYSGHWPNDYSGPLFLTPGVIFVRYIVARGNIRNMFPPHADHHHEGDEPCLCGEAERLELIRYIRNYMNEDGGFGQHTEGHSTMLGTVLNYVALRLMGVSDDDSDAARARQWIRGEGGAVSIPTWGKVWLCVLGLYEWDGVNPIPPELSLLPNWIPFSPSRLWCHSRVVSIAFSYLYGLRWRQPDNLLLQCLRYEIYLEPYGNIKWAKHRSNICAKDCYTPLSSVYKVFAAVMSLYEKRPIKFLRRRALEVAWTHIAYDDESTHFICLGPVNKAFDMLITWIREGETSGRYLNHLNRLDDYFFMGPEGLRMSGYNGSQLWDTSFAVQALCACNMELLYPEEMALAHHYVDVAQVQENPVAATQFYRHRTKGAWNFSTRPQAWQVSDCTAEGLRVLLLLRHKPFPHQRIYDAVDQILSLRNRGGGWASYEPTCAPHYVELLNCSDVFKDVMTDYVYTECTSSCVHTLSLFREHFPDYRREDVDRAIRDGVKCMLANQRTDGSYYGSWAVCFTYAAWLCASALRISGEIYSMERHPTCVRLVNFLLSHQNTDGGWGEDVSACARGVWVDNPSGSQVVNTAWAVMAIMAASGEASSTELRRQLRILKAVSAGIHFIVSRQLSTGDWAQERISGVFNGNNPIHYPGYKNTMPVWALGVYRRWSKTYGQHFPRSMD

SEQ ID NO: 98671 - DNA, 2516 bp, Pisum sativum
  CDS (73)..(2367)
aaatgtattataagctgaaacttgcagtatatatattaaagtgaagagatagtataatacacctaaaataagatgtggaagctgaagataggagatggtggaaaagatcgaaacatattcagcacaaataattttgtagggagacaaacatgggagtttgatcctgatgctggtacttcccaagagaaagctcaagttgaagctgctcgccaacatttctatgataaccgtttcgaggttaaggcatgcagtgatcttctttggcgctttcagattctgaaagaaaagaattttaaacaaacaatagaaagtgtaaagatcaaagatgaagaggagatatcagaagaaaatgttgcaattacattaagaagagctgttcatcacctatcaactcttcaatctaatgatggtcattggcctgctttaaacgcaggtcctctattttattttcctcctctggtcttttgtatgtacgttacaggacatcttgattcaatattcccctatgagtatcggaaagagattcttcgttacatatattgtcatcagaatgaagatggagggtggggactacacgtggagggtcacagtatcatgttttgtactgtactcaattacatatgtatgcgaatacttggagaaggtccaaatggaggtaaagaagatgcttgtgctagagcaagaaaatggattcatgatcatggtagtgtgacacatgtatcttcatgggggaaaatctggctttcggtacttggtatctttgattggtgtgcaagcaacccaatgccccctgagttttggatgcttccctcatttcttctcaagcatccagctaaaatgttgtgttattgccgattggtatacatgcctatgtcttacttgtatgggaagagatttgtgggtccaatcacaccactcatcttaatgttgagagaagaactcctgactcaaccatatgaaaaagttaactggaaaaaaacacgtcacctatgtgcaaaggaagatctttactatccccatcctttgatacaagatctaatatgggatagtttatacattttcgtggagccacttttgactcattggccttttaacaagctgcttagagaaaaagctctccaaacagtaatgaaacatatccattatgaagatgaaaatagtcgatacataactattgggtgtgtggaaaaggttttgtgcatactagcttgttgggtggaagatccaaatggagatgcattcaagaagcatcttgctaggctcccagattatttatgggtttcagaagatggaatgaccttgcatagttttggtagccaaacatgggatgctagtttgatcattcaagctttgcttgccactaacctaattgaggatgttggtccaatacttacaaaagcacatgaattcatcaagaagtctcaggttagggacaacccttcaggagactttaagagcatgtatcgtcatatctctaaagggtcatggaccttctctgataaagatcatggatggcaagtttctgattgcacagcagaaagtttaaagtgttgtctgcttttgtctatgttgcctccggagattgtgggggaaaagatggaacctgaaatgttatatgattcggtcaacattctattatcacttcagggtaaaaaaggtggtttaccagcttgggagccatcagaagctgtagaatggttggaactattcaatccaatagaatttcttgaggaaattgtagttgagcgtgaatatgttgaatgcacttcatcagcaattcaagctttagttttgtttaaaaaactatatccagaacacagaaagaaagaggttgaaaatttcattgcaaatgcagttcgatttctcgaatataaacaaacaagtgatggttcatggtatggaaattggggaatttgcttcacttatggttcttggtttgcacttaacggtctagtggctgctggcaagacttatgataattgtgcagccattcgcaaaggtgttgaatttttgcttacaacacaaagagaggatggtgggtggggggagagccatctttctagctcaaaaaagatatatgtacctcttgaaagaagtcaatcaaatattgtgcagacatcatgggctattatgggtttaattcatgctggtcagatggagagagaccctactcctcttcatcgtgctgtaaagttgatcatcaatttccaacaagaagagggtgattggccccaacaggaacttacaggagtattcatgaaaaattgtatgttacaatatgcaatgtatagagatattttcccaacatgggctctagctgaatatcgtagacggattctgttggcttcaccagcagttgcaatttaaaatgaaacatttatgcaattatgtgtgtatcttacttcataaaagatatttgaaagatatatatatatatatacacaaattagtctcggtataagataacaaaaaaaaaaaaatcgatgtcgactcgagtcaatccatatgactagtag

SEQ ID NO: 98672 - protein, 764 aa, Pisum sativum
MWKLKIGDGGKDRNIFSTNNFVGRQTWEFDPDAGTSQEKAQVEAARQHFYDNRFEVKACSDLLWRFQILKEKNFKQTIESVKIKDEEEISEENVAITLRRAVHHLSTLQSNDGHWPALNAGPLFYFPPLVFCMYVTGHLDSIFPYEYRKEILRYIYCHQNEDGGWGLHVEGHSIMFCTVLNYICMRILGEGPNGGKEDACARARKWIHDHGSVTHVSSWGKIWLSVLGIFDWCASNPMPPEFWMLPSFLLKHPAKMLCYCRLVYMPMSYLYGKRFVGPITPLILMLREELLTQPYEKVNWKKTRHLCAKEDLYYPHPLIQDLIWDSLYIFVEPLLTHWPFNKLLREKALQTVMKHIHYEDENSRYITIGCVEKVLCILACWVEDPNGDAFKKHLARLPDYLWVSEDGMTLHSFGSQTWDASLIIQALLATNLIEDVGPILTKAHEFIKKSQVRDNPSGDFKSMYRHISKGSWTFSDKDHGWQVSDCTAESLKCCLLLSMLPPEIVGEKMEPEMLYDSVNILLSLQGKKGGLPAWEPSEAVEWLELFNPIEFLEEIVVEREYVECTSSAIQALVLFKKLYPEHRKKEVENFIANAVRFLEYKQTSDGSWYGNWGICFTYGSWFALNGLVAAGKTYDNCAAIRKGVEFLLTTQREDGGWGESHLSSSKKIYVPLERSQSNIVQTSWAIMGLIHAGQMERDPTPLHRAVKLIINFQQEEGDWPQQELTGVFMKNCMLQYAMYRDIFPTWALAEYRRRILLASPAVAI

SEQ ID NO: 98673 - DNA, 2601 bp, Pisum sativum
  CDS (70)..(2346)
cgataaacaacgagttcatcactttgtatagctaccatcacctcttcacacaccaccttctctaaaaagatgtggaggttgaagatagcagaaggtggtaacgatccatatttgttcagcacaaacaactttgttggaagacagacatgggagtatgatccagaagcaggtagtgaagaagaaagagctcaagttgaagaagctcgtcgcaatttctacaacaaccgcttcgaggttaagccatgtggtgatctcctatggcgttttcaggttcttagagaaaataacttcaagcaaacaataggcggcgtaaagatagaagatgaagaagaaataacatatgaaaaaactacaacaacattgagaagaggcacacatcacttagcaacattgcaaaccagtgatggtcattggccagctcaaattgcaggtcctctatttttcatgcctcctttggttttctgtgtctacattactggacatcttgattcggtgttcccaccagagcatcgcaaagagattcttcgttatatatattgccaccagaacgaagatggagggtgggggcttcacattgagggtcatagcaccatgttttgtactgcactcaactatatatgtatgcggattctcggagaagggcctgatggtggtgaagacaatgcttgcgttagagcaagaaattggattcgtcaacacggtggtgtcacacatataccttcctgggggaaaacttggctttcgatacttggtgtgtttgattggttgggaagtaacccaatgccccctgaattttggatccttccttcatttcttcctatgcatccagctaaaatgtggtgttattgtcgattggtatacatgcctatgtcttatttgtatggaaaaagatttgtgggtcctatcacaccgctcattttacagttgcgagaagaactccatactgaaccttatgaaaagattaattggacgaaaacacgtcatctatgtgcaaaggaagatatttactatcctcatcctttgatacaagatcttatatgggatagcttgtatattttcaccgagccacttttgactcgttggcctttcaacaaattggtcaggaaaagagctcttgaagtaacaatgaagcatattcactacgaggatgagaatagtcgataccttactattggctgtgtggaaaaggttttatgtatgcttgcttgttgggtggaagatccaaatggagatgctttcaagaagcatatagcaagagttccagattatttgtggatttctgaagatggaatgaccatgcagagtttcggtagtcaagagtgggatgctggttttgccgttcaagctttgcttgccactaacctaattgaggaaatcaaacctgcacttgcaaaaggacacgatttcatcaaaaagtctcaggttacagagaatccttccggagattttaagagtatgcatcgtcatatttctaaaggctcgtggaccttctctgatcaagaccacggatggcaagtttctgattgcaccgcagaaggtttaaagtgttgtctacttttatcattgttgcctccagaaattgtgggggaaaagatggaacccgaaaggctatttgattctgtcaatctcctactatcgcttcagagtaaaaaaggaggtttggcggcctgggagcccgcaggagctcaagaatggttagaactactcaatcctacagaattttttgcggacattgttgttgaacatgaatatgttgagtgcacgggatcagcaattcaagctttagttttattcaagaagttatatccgggtcataggaagaaagagatagaaaatttcattttcaatgcagttcgattccttgaagatacgcagacagaggatggttcatggtatggaaactggggagtttgctttacgtatggctcttggttcgctcttggcggtttagcggccgccggaaagacttataccaattgtgctgctattcgtaaaggtgttaaatttcttcttacaacacagagagaggacggcgggtggggggaaagctatctttcaagcccaaaaaagatatatgtacctcttgaaggaaaccggtcaaatgtggtacatactgcatgggctcttatgggtttaattcatgccggccagtcagagagagaccccactcctcttcatcgtgcagcaaaattgcttattaattcccaattagaacaaggcgattggccacaacaggaaatcacaggagtattcatgaaaaattgcatgttgcactatccaatgtatagagatatatatccactatgggctctagctgagtatcgtagaagagttcctttgccttgagaaaaaggacaaatccatatcattaaagaaagaatcgctcaaatgattactttttcttacatgttagcttgtgaatgtatcaatagatgtgtcgtttcatattttgctttctaaaatggatgtctctacctccacacaaaaaaaggtagtatttgctgcaagatgtataacaacaatgaagtataggtagaatatttacatatttatttttaacaatatattaatatttgctcctaaaaaaaaaaaaaaaaaaaa

SEQ ID NO: 98674 - protein, 758 aa, Pisum sativum
MWRLKIAEGGNDPYLFSTNNFVGRQTWEYDPEAGSEEERAQVEEARRNFYNNRFEVKPCGDLLWRFQVLRENNFKQTIGGVKIEDEEEITYEKTTTTLRRGTHHLATLQTSDGHWPAQIAGPLFFMPPLVFCVYITGHLDSVFPPEHRKEILRYIYCHQNEDGGWGLHIEGHSTMFCTALNYICMRILGEGPDGGEDNACVRARNWIRQHGGVTHIPSWGKTWLSILGVFDWLGSNPMPPEFWILPSFLPMHPAKMWCYCRLVYMPMSYLYGKRFVGPITPLILQLREELHTEPYEKINWTKTRHLCAKEDIYYPHPLIQDLIWDSLYIFTEPLLTRWPFNKLVRKRALEVTMKHIHYEDENSRYLTIGCVEKVLCMLACWVEDPNGDAFKKHIARVPDYLWISEDGMTMQSFGSQEWDAGFAVQALLATNLIEEIKPALAKGHDFIKKSQVTENPSGDFKSMHRHISKGSWTFSDQDHGWQVSDCTAEGLKCCLLLSLLPPEIVGEKMEPERLFDSVNLLLSLQSKKGGLAAWEPAGAQEWLELLNPTEFFADIVVEHEYVECTGSAIQALVLFKKLYPGHRKKEIENFIFNAVRFLEDTQTEDGSWYGNWGVCFTYGSWFALGGLAAAGKTYTNCAAIRKGVKFLLTTQREDGGWGESYLSSPKKIYVPLEGNRSNVVHTAWALMGLIHAGQSERDPTPLHRAAKLLINSQLEQGDWPQQEITGVFMKNCMLHYPMYRDIYPLWALAEYRRRVPLP

SEQ ID NO: 98675 - DNA, 2190 bp, Arabidopsis thaliana
  CDS (1)..(2190)
atgtggaggctgaggatcggagctaaggcaggagatgaccctcacttgtgcaccaccaacaacttcttgggaaggcagatatgggagtttgatgccaacgcaggctctccagcggaactctctgaggttgatcaggctcgacaaaatttctcaaacaataggtcacaatacaaggcttgtgccgatctcctttggcgtatgcagtttctaagggagaagaatttcgagcaaaagattccacgagtgagaatagaggatgccaagaaaataacatttgaagacgcaaaaaatacactgagaagaggaatacattatatggcagcgttgcaatctgatgatggacattggccttccgaaaacgctggttgcattttcttcaatgccccctttgttatatgtttgtatatcactggccatctggataaagttttctctgaagagcatcggaaagagatgttgcgttacatgtacaaccatcagaacgacgatggtggatggggaatagacgtagaaagccatagttttatgttttgcacggtcatcaactacatctgcctacgaatcttcggagtagatcccgatcatgatggtgaaagtgcttgtgcaagggctcgtaaatggatcattgaccacggtggcgctacctatacgccattatttggaaaagcctggctttcggttcttggagtatatgaatggtctggttgcaaacccatacccccagagttctggttttttccttcctattttcctattaatggaggcactctctggatatatttacgggatactttcatggcaatgtcctatttgtatggtaaaaaatttgttgctaaaccaacacctctcattctacaacttcgtgaagaactttatcctcaaccttatgctgaaattgtttggagccaagctcgcagtcgatgtgcgaaggaagatctatattatccacaatcattggtacaagacttgttttggaaacttgttcacatgttttcggagaatatcttaaatcgatggcctttcaacaagctcattagagaaaaagctattcgaacggcaatggaactcattcactaccatgacgaagccacccggtacattacaggtggagcagtgccaaaggtgtttcatatgcttgcttgttgggttgaagatccagagagtgattattttaaaaaacatcttgcgcgagtctctcatttcatatggattgcggaggacggcttgaaaatccagacttttggtagccaaatatgggatacagccttcgttctccaagtcatgttagcggctgatgttgacgatgagataaggccaacgctcataaagggatactcttacttgaggaaatcccaatttacagagaatcctcccggtgactatatcaatatgtttagagacatatccaaaggagggtggggctattcagacaaagatcaaggatggcctgtttcagattgtatttctgagagtttagagtgctgcctgatctttgagagtatgtcatccgaattcattggtgagaaaatggaagtggagaggctttatgatgccgtcaatatgcttctctatatgcagagcagaaatggagggatatctatatgggaagcagcgagtgggaaaaaatggctagagtggcttagtcccatagagtttattgaagacactatcctcgagcatgagtatctagaatgcacggggtcagcgatagtggtgttggcacgcttcatgaaacagtttccagggcatagaacagaagaagtcaaaaaatttataacaaagggagtgaaatacatagaaagcttacaaattgcggatggttcgtggtacggaaactggggaatatgttttatatatgggactttctttgctgtccgaggtttagtggccgcgggaaacacttacgataactgtgaggcaatccgtagagcagttcgattccttcttgatatacaaaacggtgaaggcggttggggagagagttttctttcttgccccaacaaaaattatattcctttggaggggaacaagaccgatgtggtgaatacaggacaagcattgatggttctaataatgggtggtcagatggatagagatcctttaccggttcaccgcgctgcaaaagtattaatcaattcacaaatggataacggtgattttccacagcaggtgtgtttcttgttaccctaa

SEQ ID NO: 98676 - protein, 729 aa, Arabidopsis thaliana
MWRLRIGAKAGDDPHLCTTNNFLGRQIWEFDANAGSPAELSEVDQARQNFSNNRSQYKACADLLWRMQFLREKNFEQKIPRVRIEDAKKITFEDAKNTLRRGIHYMAALQSDDGHWPSENAGCIFFNAPFVICLYITGHLDKVFSEEHRKEMLRYMYNHQNDDGGWGIDVESHSFMFCTVINYICLRIFGVDPDHDGESACARARKWIIDHGGATYTPLFGKAWLSVLGVYEWSGCKPIPPEFWFFPSYFPINGGTLWIYLRDTFMAMSYLYGKKFVAKPTPLILQLREELYPQPYAEIVWSQARSRCAKEDLYYPQSLVQDLFWKLVHMFSENILNRWPFNKLIREKAIRTAMELIHYHDEATRYITGGAVPKVFHMLACWVEDPESDYFKKHLARVSHFIWIAEDGLKIQTFGSQIWDTAFVLQVMLAADVDDEIRPTLIKGYSYLRKSQFTENPPGDYINMFRDISKGGWGYSDKDQGWPVSDCISESLECCLIFESMSSEFIGEKMEVERLYDAVNMLLYMQSRNGGISIWEAASGKKWLEWLSPIEFIEDTILEHEYLECTGSAIVVLARFMKQFPGHRTEEVKKFITKGVKYIESLQIADGSWYGNWGICFIYGTFFAVRGLVAAGNTYDNCEAIRRAVRFLLDIQNGEGGWGESFLSCPNKNYIPLEGNKTDVVNTGQALMVLIMGGQMDRDPLPVHRAAKVLINSQMDNGDFPQQVCFLLP

SEQ ID NO: 98677 - DNA, 2671 bp, Glycyrrhiza glabra
  CDS (308)..(2605)
gactcactctccaaatcaattgagattcaacagtgttggtgttgagcgtcacctgctctgctctgctctgctctgcttgctttaaaactcgtttaatttgtggagactagctgtgtgattcagctaagcttatagttcaaaagttcagcaccggatcaatctcaagacacacaaattaatctcacggatggagtggaggaggtagctagcactttcaattgattcaagcattaaggcggggattgtaataataatagaatagaatagaatagaatagaatactaagaagaagaatcagaagaggaagatgtggaggctgaagatagcggaaggagggaaggacccatacatatacagcacaaacaacttcgtggggaggcagacatgggagtatgatcccgatggtgggactcccgaggagagagctcaggttgatgccgctcgtctccatttctataacaaccgcttccaggtcaagccctgtggcgacctcctttggcgttttcagattctgagagaaaataacttcaaacaaacaatagctagcgtgaagataggagatggagaggaaataacatacgaaaaggcgacaacggcggtgagaagggctgcacatcacctatccgcattgcagaccagcgatggccattggcctgctcaaattgcaggtcctctgtttttccttccccccttggttttttgtatgtacattacaggacatcttgattcggtattcccagaagagtatcgcaaagagattcttcgttacatatactatcaccagaatgaagatggagggtgggggctacacatagagggtcacagcaccatgttttgtactgcactcaactatatatgcatgcgaattcttggagaagggcccgatgggggtcaagacaatgcttgtgctagagcaagaaagtggattcatgatcatggtggtgtaacacatataccttcatggggaaaaacttggctttcgatacttggtgtatttgattggtgcggaagcaacccaatgccccctgagttttggatcctgccttcatttcttcctatgcatccagctaaaatgtggtgttattgccgattggtatacatgcctatgtcttacttgtatgggaaaaggtttgtgggtccaatcacaccgctcattctacagctgagagaagaactgtttactgaaccttacgaaaaagttaattggaagaaagcacgtcaccaatgtgcaaaggaagatctttactatccccatcctttgttacaagatctgatatgggatagtttatacttattcactgagccacttctgactcgttggcctttcaacaagctggttagagaaaaggcccttcaagtaacaatgaagcatatccactatgaagatgagactagtcgatacataaccattgggtgtgtggaaaaggttttatgtatgcttgcttgttgggtggaagatccaaatggagatgctttcaagaagcatcttgcaagggtcccggattacttatgggtttcggaagatggaatgaccatgcagagttttggtagccaagaatgggatgctggttttgccgttcaagctttgcttgccactaacctagtcgaggaaattgctcccacacttgccaaaggacatgatttcatcaagaaatctcaggttagggacaacccttcaggagattttaagagcatgtatcgtcatatttctaaaggctcatggaccttctccgatcaagaccatggatggcaagtttctgattgcacagcagaaggtttgaagtgttgtctacttttatcaatgttgcctccagagattgtgggggaaaagatggaacctgaaaggttatatgattcagtcaatgtcctattgtcgcttcagagtaaaaagggtggtttatcagcgtgggaaccagcaggagctcaagaatggttagaactactcaatcccacggaattttttgcggacattgtagttgagcatgaatacgttgagtgcactggatcagcaattcaggcactagttctgttcaagaagctatatccagggcataggaagaaagagatagagaatttcattgccaatgcagttcgattccttgaagatacacaaacagctgatggttcatggtatggaaattggggagtttgcttcacttacggttcttggttcgcacttggtggtcttgcagctgctggcaagacttttgccaattgtgctgctattcgcaaagctgttaaatttcttctcacaacacagagagaggatggtggatggggggagagctatctttcaagcccaaaaaagatatatgtacctcttgaaggaagtcgatcaaatgttgtgcatactgcatgggcccttatgggtttaattcatgctggccaggcagagagagaccctgctcctcttcatcgagctgcaaaattgatcatcaattcccaattggaagagggtgattggccccaacaggaaatcacgggagtattcatgaaaaattgtatgctgcattacccaatgtatagagatatttatccaatgtgggctctagctgagtatcgtagacgggttccattgccttccactccagtttgtttaacttaaaagctgtgtgagcacaaaaaggacaaagccatatatcaataaagaaccatgcaggcaaattaaatc

SEQ ID NO: 98678 - protein, 765 aa, Glycyrrhiza glabra
MWRLKIAEGGKDPYIYSTNNFVGRQTWEYDPDGGTPEERAQVDAARLHFYNNRFQVKPCGDLLWRFQILRENNFKQTIASVKIGDGEEITYEKATTAVRRAAHHLSALQTSDGHWPAQIAGPLFFLPPLVFCMYITGHLDSVFPEEYRKEILRYIYYHQNEDGGWGLHIEGHSTMFCTALNYICMRILGEGPDGGQDNACARARKWIHDHGGVTHIPSWGKTWLSILGVFDWCGSNPMPPEFWILPSFLPMHPAKMWCYCRLVYMPMSYLYGKRFVGPITPLILQLREELFTEPYEKVNWKKARHQCAKEDLYYPHPLLQDLIWDSLYLFTEPLLTRWPFNKLVREKALQVTMKHIHYEDETSRYITIGCVEKVLCMLACWVEDPNGDAFKKHLARVPDYLWVSEDGMTMQSFGSQEWDAGFAVQALLATNLVEEIAPTLAKGHDFIKKSQVRDNPSGDFKSMYRHISKGSWTFSDQDHGWQVSDCTAEGLKCCLLLSMLPPEIVGEKMEPERLYDSVNVLLSLQSKKGGLSAWEPAGAQEWLELLNPTEFFADIVVEHEYVECTGSAIQALVLFKKLYPGHRKKEIENFIANAVRFLEDTQTADGSWYGNWGVCFTYGSWFALGGLAAAGKTFANCAAIRKAVKFLLTTQREDGGWGESYLSSPKKIYVPLEGSRSNVVHTAWALMGLIHAGQAERDPAPLHRAAKLIINSQLEEGDWPQQEITGVFMKNCMLHYPMYRDIYPMWALAEYRRRVPLPSTPVCLT

SEQ ID NO: 98679 - DNA, 2262 bp, Neurospora crassa
  CDS (1)..(2262)
atggccaggaagcaggccactgaagccccggcggtctcaaacggatcacccaagaaacggtccagcgccgacagcgataatcacaatgtcaaacggcctcggctacaggagagcaccgataaggcgcgttggcgtttgagcagtgagggcggccgacacacatggcactatctcgaggacgacgaggctgcaaaagaatggccgcagtcatatgctgacaagtacttcctgggaatgcctctggtaaaacatccagccgagctccccgaacttcccaaggcgacgaaccccctcgatgcggtacgaaacggccttactttcttcgaaaagctccagctccccgagggccattggggttgcgagtacggcggtcccatgttcctcctccccggtgttgtcatcgctcgctacgtcaccaagaacccagtcccttggtactatgctaccgagatcaagaactacctgtttgcgcgagcgaaccccgtcgacggcggatgggggctacacattgaaggcgagagcaccatgttgggtacgacgctgaactatacgacgttgcgccttgtgggtgtggaggcagaccatccggtcatggtgaaagcgcgagcaacaatgcataagatgggaggtgctatttacgcgccacactgggccaaattttggctcacggtattgggcattatgaaatgggacatcgtaaaccctgtcccgcccgagctttggcttctccccgactgggtgccgattgcgccgtggagatggtggattcatatgcgccaggtcttcctgcctatgagttacctatggtccaagaagtggcaggcggaggagacggacttgattcgggagttgcgcaatgaattgttcgtggaggactggaacaagattgattgggctggaaaccgcaacaccattcatcccaacgacaactaccacccaaaaaccgccttcctcaacaccgtcaactggcttcttgtaaacatctggaatcccgtcttccgaaccaagtacttggtagagaaggcagaggcatgggcgtcggagctcatcgacatggaggacgaaaacacggattattctgacctagccccggtcaacgccgcgatgaataccgtttgctgttatgttcgggacggacctggggcctactctgtacgaaggcatgtggaaaggctggatgaggtactctgggtcaacgccgagggtatgctctgcaatggcacaaacggcgtgcaatgctgggacactgcctttgcaatccaggctatcatggacgccggcctgactgaagacccacgctggaggccgatgcttatcaagtcattggaattcctggaggaccagcagattcgagaaaacgtcaaggatcaggataagtgctatcgccatccccgcaagggtgcttgggcatttagcaacaaggaccaagggtatgcagtcagcgattgtgtctctgaagcgttgaagtccgtcatcatcctgcaaaagacgccaggcttccctactctgattgatgaccagcgtatttttgacgccgttgacacaatgcttacctaccaaaacccatctggcgcctgctcatcctacgagactccgcgcgccggccagtggatggaggttttgaatgccgcggaagtgttcggcaacatcatggtcgaatatgaatatcccgaatgcaccacggccgttctcactacactctcgcttttcaagaaacactggcccaatcatcgcacagccgagattgacaacttcatcacccgcgctgtcaagtggattaagagcaatcagaagcctcatggtggttggtatggcaattggggcatttgcttcacgtacgccactatgtttgctttggagagtttggccagcgttggtgaaacgtatgagaacagcagatatgccaagaagggatgtgatttcctcgtcgccaagcagagggaggacggtggttggtctgagagctacaaggcatgtgagacgggcgagtacgttgagcatccaactggatcccaagtggtcatgaccgcctgggcccttgttgggttgatcaaggccaaatatcccaataacgacccgatcaagaagggcatcaagttgatcatggaccgtcagcagcctaacggagagtggcggcaagaggctatcgagggtgtcttcaacaagagctgcatgatttcttacccgaactacaagttcagctttccgttgaaggcactgggcttgtttgccacacggtatccggacgagaaggtcgtttga

SEQ ID NO: 98680 - protein, 753 aa, Neurospora crassa
MARKQATEAPAVSNGSPKKRSSADSDNHNVKRPRLQESTDKARWRLSSEGGRHTWHYLEDDEAAKEWPQSYADKYFLGMPLVKHPAELPELPKATNPLDAVRNGLTFFEKLQLPEGHWGCEYGGPMFLLPGVVIARYVTKNPVPWYYATEIKNYLFARANPVDGGWGLHIEGESTMLGTTLNYTTLRLVGVEADHPVMVKARATMHKMGGAIYAPHWAKFWLTVLGIMKWDIVNPVPPELWLLPDWVPIAPWRWWIHMRQVFLPMSYLWSKKWQAEETDLIRELRNELFVEDWNKIDWAGNRNTIHPNDNYHPKTAFLNTVNWLLVNIWNPVFRTKYLVEKAEAWASELIDMEDENTDYSDLAPVNAAMNTVCCYVRDGPGAYSVRRHVERLDEVLWVNAEGMLCNGTNGVQCWDTAFAIQAIMDAGLTEDPRWRPMLIKSLEFLEDQQIRENVKDQDKCYRHPRKGAWAFSNKDQGYAVSDCVSEALKSVIILQKTPGFPTLIDDQRIFDAVDTMLTYQNPSGACSSYETPRAGQWMEVLNAAEVFGNIMVEYEYPECTTAVLTTLSLFKKHWPNHRTAEIDNFITRAVKWIKSNQKPHGGWYGNWGICFTYATMFALESLASVGETYENSRYAKKGCDFLVAKQREDGGWSESYKACETGEYVEHPTGSQVVMTAWALVGLIKAKYPNNDPIKKGIKLIMDRQQPNGEWRQEAIEGVFNKSCMISYPNYKFSFPLKALGLFATRYPDEKVV

SEQ ID NO: 98681 - DNA, 2433 bp, Luffa cylindrica
  CDS (3)..(2300)
aaatgtggcagctcaagattggggccgataccgtacctgccgatccttctaacgccggcggatggctctcatctctcaacaaccacgtgggtcgccaggtttggcattttcatcccgaactcggcaccccggaagatcttcagcagatacaacatgcgcgccagcgcttctctgaccacagattcgagaagaagcatagtgctgatctccttatgcggatgcagtttgcgaagaataactcatcctttgtgaatctaccgcaaatcaaagttaaagataaagaagacgtgacagaggaggcagtatcgcgcactctaagaagggctatcaatttttattcaacaatccagggagatgatggtcactggcctggagattatggcggtccaatgtttctaattcctggtttggtcattactctttccattactggtgccttgaatgccgtcttatctacagaacaccagcgtgagatttgcagatatctatacaatcatcagaataaagatgggggttggggtttacatattgaaggcccaagcacaatgttcggttctgtgctgaattatgtttctttgagattgcttggtgaagaagctgaagatgggcagggtgctgtggacaaagcacggaaatggatcttggaccatggtggtgcatctgcaattacttcttgggggaaaatgtggctttcagtacttggagtatatgaatgggctggaaataatccacttcctcccgaactatggctcttgccttatcttctcccttttcatccaggaaggatgtggtgtcactgccgaatggtatacttgcctatgtgttatctgtatggcaagagatttgttggtcctataacgcctataattcgatctttaaggaaggaactttatcttgtcccttatcatgaagttgattggaataaggctcgcaatgagtgtgcaaaggaagatctgtattacccacatccgctggttcaggatattgtgtgggcttcgcttcatcatgtctatgagcctctttttatgcgttggcctgcaaaaagactgagggaaaaggctttgcagtgtgtaatgcagcatatccactatgaagatgaaaatactcggtatatatgcatagggcctgtcaacaaggtattaaacatgctttgttgttgggtggaggatccacattcggaggcattcaaattgcatattccaagaatctttgactatctgtggattgctgaagatggcatgaaaatgcagggttataatggaagtcaattatgggatactgcatttgctgttcaagccatcatgtcaactaagcttgctgaagaatatgggacaactttaagaaaggcacacaagtatataaaagattcccaggtcttagaagattgtcctggtgatttacaaagttggtatcgtcatatttcaaaaggtgcatggccattttcaactgcagatcatggatggcccatctctgactgcactgctgaaggtttgaaggctgttcttttattatcaaaacttccttcagaaatagtagggaagtcaattgatgaagaacagatatacgatgctgtaaatgtcatcctctccttacagaatactgatggtggctttgccacttacgaactgaccagatcttacccgtggctggagctaatgaaccctgctgaaactttcggtgatattgtcattgactacacatatgtcgagtgtacctcagcagcaattcaagcacttgtagcgttcaagaaattatatccaggtcatagaagggatgaaattgataattgtgttgctaaagctgcggacttcattgaaagcatacaagcaactgatggatcttggtatggatcttggggggtctgcttcacctatggtggttggtttgggataaggggtctggtcgctgctggaaggagatacgataactgttctagccttcgtaaagcttgtgatttcctgttgtctaaagagcttgcttccggtggctggggagaaagttatctttccggccagaataaggtgtacacgaatattaaagatgataggccgcatattgtcaatactggttgggctatgttatccctcatcgatgctgggcagtctgagagagatccaacaccgttacaccgtgcagcaaggatattaatcaattctcagatggacgatggagattttcctcaagaggagatcatgggaatttttaacaagaactgcatgattagttatgccgcttatcgtaacatttttcctatatgggcccttggagaatatcgctgccgggtactgcaagccccttaaataatgtattactgccaatgtgtcggtcataaaactatttggatcttatttcagatgcttatgttttcttgagatctaaactaaatcagatgaacaaatatttctttattaccaggtcaagttgcaggagagc

SEQ ID NO: 98682 - protein, 765 aa, Luffa cylindrica
MWQLKIGADTVPADPSNAGGWLSSLNNHVGRQVWHFHPELGTPEDLQQIQHARQRFSDHRFEKKHSADLLMRMQFAKNNSSFVNLPQIKVKDKEDVTEEAVSRTLRRAINFYSTIQGDDGHWPGDYGGPMFLIPGLVITLSITGALNAVLSTEHQREICRYLYNHQNKDGGWGLHIEGPSTMFGSVLNYVSLRLLGEEAEDGQGAVDKARKWILDHGGASAITSWGKMWLSVLGVYEWAGNNPLPPELWLLPYLLPFHPGRMWCHCRMVYLPMCYLYGKRFVGPITPIIRSLRKELYLVPYHEVDWNKARNECAKEDLYYPHPLVQDIVWASLHHVYEPLFMRWPAKRLREKALQCVMQHIHYEDENTRYICIGPVNKVLNMLCCWVEDPHSEAFKLHIPRIFDYLWIAEDGMKMQGYNGSQLWDTAFAVQAIMSTKLAEEYGTTLRKAHKYIKDSQVLEDCPGDLQSWYRHISKGAWPFSTADHGWPISDCTAEGLKAVLLLSKLPSEIVGKSIDEEQIYDAVNVILSLQNTDGGFATYELTRSYPWLELMNPAETFGDIVIDYTYVECTSAAIQALVAFKKLYPGHRRDEIDNCVAKAADFIESIQATDGSWYGSWGVCFTYGGWFGIRGLVAAGRRYDNCSSLRKACDFLLSKELASGGWGESYLSGQNKVYTNIKDDRPHIVNTGWAMLSLIDAGQSERDPTPLHRAARILINSQMDDGDFPQEEIMGIFNKNCMISYAAYRNIFPIWALGEYRCRVLQAP

SEQ ID NO: 98683 - DNA, 2493 bp, Taraxacum officinale
  CDS (116)..(2392)
gacaactataaaagttggcgatccctcgttcatcaacagcccagcctctacggccacccccttgcaattgtgcacaggatttgaaatatctctgagtctgaaactcaaggaaataatgtggaaacttcagctgtcaaaaggtgacgatgatccagaagtcagaagcgtgaatcatcatatgggtaggcaatattgggaattcgatccacacgcaggaactccagaagagcaatctcaaatcgagagcatgcgtgaagaatttaccagaaacaggttgaatgtgacgcatagttctgatcttctgatgagattccagttaacaagcaagaatcgtggtggaattgaaaagtctcatgtaaaggaggaaggaggggacgatgaagtggtagtaaagacgttgaagaaagcgttgaagttctattcaagtcttcaaggtgaggatgggagttggcctggtgattatggtggtcctttgtttctccttccaggcctgatcattggattgcatgtcatggggatgaaggaccttgttttgtccatagaacagcaaaatgaaatccgtcgatatctttataatcatcagaatgtagatggaggttggggtttacacatagaagggaatagcaccatgctttctacagccttgaactatgtgagcctaagattgcttggagaagagctagatgatggtaaaggagccatgactaaagcacaatcttggattcttaaacatggtagtgtcacacacataccctcttgggggaaattgtggctctcagtacttggtgtgtatgaatggagaggcaacaatccattgccaccagaaacttggcttctcccatactttcttcctttacacccaggaagattgtggtgccatacaaggatggtatacctaccaatgtcctatttatatggtaaacgatttgtcgggccaattagttccattgttttgtcactaagaagagagttgtactcgacactttattaccaagttaattgggacttggctagaaagcaatgtgccaaggatgatttgtattatcctcatcccttaatacaagaccttctatgggatagtttgaacaagatcgttgaaccccttctgatgcaatggcccgtcgcaaaactcagaaaagaagcattgaaaacggtgatgcagcatatcattatgaggatgagaacacgaactatattttgcattggacctgttaataaggttctcaacatgttatgttgttgggtggaggatccaaaaacacctataaataaactgcacctctctaggataaaagactatctttgggtagctgaagatggcatgaagatgcagggatacaacggatcacaattatgggatgttgttttctctgttcaagcaatagtagcaaccaatcttgttgatgaatacagttccatgcttcataaagcacacgacttcattaaaaactcacaagtaaagaaaaatagttcaggtaatagtcagtcatggtaccgccacatatcacggggtggatggccattttctactcccgataatggttggcctgtatcggattgtactgctgaagctttaaagacagtattgatgctatcacaaatgccacatgacatagttggagaagcaatagcaccagaatgtttatatgatgccgtcaatgttattttatctttacagaattctgatggtagttttgcaacatatgaactcacaagatcctacagctggttagagttagtgaatcctgctgaaactttcggcgacattgttatcgactacccgtatgtagagtgcacatcggctgtggtgcagagcctaagatcatttacaaaactgtatccaagtcaccgtaggattcaaatagaaacgtgcattgaaaaagccatagcatttattgagagatcacaactaggagatggctcatggtatggatcatgggcaatatgctacacttatggaacatggtttggtataaaaggattggttgcaggtggtaagacatatgaaactagccatagcattagaaaggcttgtgctttcttactctcgaagcagcttcattctgggggttggggagaaagctacacttcttgccaacaaaagacgtatacaaatcttgtaggaaacaaatcccacataacaaacacttcatgggctttgctagctctcatagaagccggacaacccagaagagatcgaatcccactccatcgtgctgcaaaggtactcattgatcaccaactgggaaatggagattttccacaacaggaaattataggggtgtttaacaagaactgtatgataagttactcgtcgtataggaacatatttcctatttgggctcttggagaatacctcaatcatgtaatcacgaagaaatctcttggttgatatgcatgtatttaaaaccttttcatatgatgtcttcatgtacgtttgtatttatctttttacacatctatatataatcaaatataaaaaaaaaaaaaaaa

SEQ ID NO: 98684 - protein, 758 aa, Taraxacum officinale
MWKLQLSKGDDDPEVRSVNHHMGRQYWEFDPHAGTPEEQSQIESMREEFTRNRLNVTHSSDLLMRFQLTSKNRGGIEKSHVKEEGGDDEVVVKTLKKALKFYSSLQGEDGSWPGDYGGPLFLLPGLIIGLHVMGMKDLVLSIEQQNEIRRYLYNHQNVDGGWGLHIEGNSTMLSTALNYVSLRLLGEELDDGKGAMTKAQSWILKHGSVTHIPSWGKLWLSVLGVYEWRGNNPLPPETWLLPYFLPLHPGRLWCHTRMVYLPMSYLYGKRFVGPISSIVLSLRRELYSTLYYQVNWDLARKQCAKDDLYYPHPLIQDLLWDSLNKIVEPLLMQWPVAKLRKEALKTVMQHIIMRMRTRTIFCIGPVNKVLNMLCCWVEDPKTPINKLHLSRIKDYLWVAEDGMKMQGYNGSQLWDVVFSVQAIVATNLVDEYSSMLHKAHDFIKNSQVKKNSSGNSQSWYRHISRGGWPFSTPDNGWPVSDCTAEALKTVLMLSQMPHDIVGEAIAPECLYDAVNVILSLQNSDGSFATYELTRSYSWLELVNPAETFGDIVIDYPYVECTSAVVQSLRSFTKLYPSHRRIQIETCIEKAIAFIERSQLGDGSWYGSWAICYTYGTWFGIKGLVAGGKTYETSHSIRKACAFLLSKQLHSGGWGESYTSCQQKTYTNLVGNKSHITNTSWALLALIEAGQPRRDRIPLHRAAKVLIDHQLGNGDFPQQEIIGVFNKNCMISYSSYRNIFPIWALGEYLNHVITKKSLG

SEQ ID NO: 98685 - DNA, 2452 bp, Taraxacum officinale
  CDS (30)..(2306)
actttgagattttagttacaaaagatagtatgtggaagctgaaaatagcagaaggtggtgatgatgagtggctgaccaccaccaacaaccacgtcggccgtcagcactggcagtttgatccggatgctggaaccgaagaggaacgtgctgagattgaaaagattcgtctcaacttcaaacttaatcgttttcaattcaaacaaagtgccgacttgttaatgcgtactcaactaagaaaagagaacccaatcaataaaataccggatgcaataaaattgaatgaaacagaagaagtgacaaatgacgcagtgacaactacactcaaaagagccattagcttttactccaccattcaagcccatgatgggcactggccagctgagtctgctggccctttgttcttccttcctccattggtaatagcactatatgtgactggagcaatgaatgatattctaacacccgcacatcagctagaaataaaacgttacatatacaatcatcagaatgaagatggaggttggggattacatatagagggtcatagcacaatatttggatcagtacttagttacataactttaagattacttggggaagaagctgatagtgttgcagaggacatggctttggttaaggggcgtaaatggatccttgaccatggtggtgcagttgggattccttcatggggaaagttttggcttacgatacttggagtatacgaatggggaggctgtaatcctatgccacccgaattttggctcatgcctaagtttttcccaattcatccaggcaaaatgttgtgttattgtcgcttagtttacatgcccatgtcgtacttatacggcaaaagatttgtgggaaaaataaccgagttggttcgagacctaaggcaagagctttatacggacccttatgatgagattaattggaataaagcacgaaacacgtgtgcaaaggaagatctctactatccacacccttttgttcaagatatggtatggggtgtacttcataatgttgttgaacctgtattaacaagtcgtccgatttccacactaagagaaaaggctttgaaagtcgcaatggatcatgttcactatgaagataagagcagtagatatctttgcattggatgtgtggaaaaggtgttatgcttgattgcaacgtgggtggaagatccaaatggtgatgcatataaacgtcatcttgctagaattcctgactacttttgggttgctgaggatgggatgaaaatgcagagttttggatgtcaaatgtgggatgcagcatttgctattcaagctattttttcaagtaatctaacagaagaatacggcccgactcttaaaaaagcacacgagtttgtaaaagcatcacaggttcgtgataatcctcctggagatttcagtaaaatgtaccgacatacttctaagggtgcatggacattttccatacaagaccacggttggcaagtctctgattgtaccgcagaaggcttgaaggtttcacttttgtactcccaaatgaacccaaaactagtgggcgaaaaagttgaaacggagcatctctacgacgctgtcaatgtcattctttcattacaaagtgaaaatggtggctttcctgcttgggaaccacaaagggcgtacgcttggctggagaaattcaaccccactgaattctttgaagatgtgttgattgagcgagagtatgttgaatgcacttcatctgcaatccaaggtttgacactcttcaagaagttgcacccagggcacagaaccaaggagatcgagcattgtatatcaagagctgtaaagtacgttgaagacacacaagaaagtgatggttcatggtatggttgttggggaatttgctacacctatggtacatggtttgcggtagatgcgctagtagcttgtgggaagaactatcataactgtcccgctcttcaaaaagcttgcaaatttctgttatccaaacaacttccggatggtggatggggagagagttatctttcgagctcaaataaggtgtatacgaatttggagggaaatcgttcgaatttagtgcatacatcatgggctttaatatcccttattaaagctggacaggctgaaattgatcctacaccaatatctaatggcgtacggcttctcatcaattcacaaatggaagaaggggactttcctcaacaggaaatcacaggagtgttcatgaagaactgtaacctcaattactcatcatttcgaaatatttttcccatatgggcacttggtgaatatcgtcgtattgttcaaaatatatgaactcttcttatgtaaaataaggacagaggctataacacatatttatacaatgggacgattagggttattttaaatgtatcaaagatttgttattacttgttatatatacaaccggagtctttaaattaaaaaaaaaaaaaaaaaaa

SEQ ID NO: 98686 - protein, 758 aa, Taraxacum officinale
MWKLKIAEGGDDEWLTTTNNHVGRQHWQFDPDAGTEEERAEIEKIRLNFKLNRFQFKQSADLLMRTQLRKENPINKIPDAIKLNETEEVTNDAVTTTLKRAISFYSTIQAHDGHWPAESAGPLFFLPPLVIALYVTGAMNDILTPAHQLEIKRYIYNHQNEDGGWGLHIEGHSTIFGSVLSYITLRLLGEEADSVAEDMALVKGRKWILDHGGAVGIPSWGKFWLTILGVYEWGGCNPMPPEFWLMPKFFPIHPGKMLCYCRLVYMPMSYLYGKRFVGKITELVRDLRQELYTDPYDEINWNKARNTCAKEDLYYPHPFVQDMVWGVLHNVVEPVLTSRPISTLREKALKVAMDHVHYEDKSSRYLCIGCVEKVLCLIATWVEDPNGDAYKRHLARIPDYFWVAEDGMKMQSFGCQMWDAAFAIQAIFSSNLTEEYGPTLKKAHEFVKASQVRDNPPGDFSKMYRHTSKGAWTFSIQDHGWQVSDCTAEGLKVSLLYSQMNPKLVGEKVETEHLYDAVNVILSLQSENGGFPAWEPQRAYAWLEKFNPTEFFEDVLIEREYVECTSSAIQGLTLFKKLHPGHRTKEIEHCISRAVKYVEDTQESDGSWYGCWGICYTYGTWFAVDALVACGKNYHNCPALQKACKFLLSKQLPDGGWGESYLSSSNKVYTNLEGNRSNLVHTSWALISLIKAGQAEIDPTPISNGVRLLINSQMEEGDFPQQEITGVFMKNCNLNYSSFRNIFPIWALGEYRRIVQNI

SEQ ID NO: 98687 - DNA, 2546 bp, Olea europaea
  CDS (89)..(2365): n means a or g or c or t/u
catcgagttcctttctgtgtcaagaatcataccgctcctactatcattttgtaattcccgaaaactaaaaggcatatctcaccagaaaatgtggaagttgaagattgctgatggaacagggccgtggcttacaacaaccaataatcatattggaagacagcattgggaattcgatcctgaggctggaactccagatgaacgagtcgaggttgaaagactgcgtgaagagttcaagaagaacagatttcgaactaaacaaagtgctgatttgctgatgcgtatgcagcttgtgaaggagaaccaacgtgttcaaatcccaccagcgatcaaaatcaaagaaacagaaggtataacagaggaagcagtgataactactctaagaagagccataagtttctattccacaattcaagctcacgatggccactggccagctgaatccgccggccctttgtttttcctccctcctttggtcttagccttgtatgtgactggagcaatcaatgttgttctatcgcgagaacatcagaaagagattacacgatacatatacaatcatcagaatgaagatggaggttgggggatacatatagagggtcatagcaccatgtttggttctgtgcttagctacattacgcttaggttgctaggagaaggacaagaagatggtgaagacaaggccgtagctagaggtcgaaaatggatacttgaccatggtggcgccgtggggataccatcgtggggnaagttttggcttacggtgctcggagtatacgagtgggatggctgcaacccaatgcccccagaattctggctgcttcccaatttttccccaattcatccaggaaagatgttgtgttattgtcggttggtatacatgcccatgtcatatttgtatggcaagaggtttgttggaccaattactggattggtgctatcactaaggcaagagatttatactgaaccttatcatggaataaattggaatagggcaaggaacacctgtgcaaaggaggatctttactacccacaccctctggcacaagatatgctttggggattcctccatcattttgccgagccagttctaactcgatggccgttttctaaactaagagagaaggctttaaaagttgcaatggagcatgttcattatgaggacatgaacagcagatacctttgcattggatgtgtagagaaggtgttatgtcttattgcttgttgggtagaagatcctaattctgaagcatacaaaagacatatagcacgtatacctgattacttctgggtcgccgaagatggcctgaaaatgcagagttttgggtgtcaaatgtgggatgcagcttttgctattcaagccatattatcatccaatctagctgaagagtacgggccgaccctcatgaaagcacacaactttgtgaaagcctcacaggtccaagaaaatccatctggagattttaatgaaatgtatcgtcacacttctaaaggcgcctggacattttctatgcaagatcatggttggcaagtctcagattgtacagctgaaggacttaaggccgcactcttattctcgcaaatgcctatagaactagttggagcagaaatcgaaacaggacatttatatgatgctgtaaatgtcattttgacccttcagagtgctagtggcggttttccagcatgggagcctcagaaagcatatcgatggttggagaagctcaaccctacagagttttttgaagatgttcttatagagcgagattatgtagagtgcacatcatcagcagtccaagccttaaagctctttaagcagttgcatccaggacacagaagaaaggaaatagcaagctgcatctcaaaagcaatacaatacatcgaagctactcaaaatcctgatggttcatgggatggtagttggggaatatgctttacgtatggcacgtggtttgcagtagagggcttggtcgcttgtgggaaaaattatcataactctcccacactacggagagcatgtgaatttttgttgtcgaaacaattaccggatggtggatggagtgaaagctacctttcgagctcgaacaaggtatatactaatcttgaaggtaatcggtcaaatttggtgcaaacctcatgggctctgttgtctctcatcaaagctgggcaggtcgagattgatcctgggcctatacatcgtggaataaaactgctagtaaattcacaaatggaagatggtgactttcctcaagaggaaattacaggagcattcatgaagaattgtactctgaactattcatcgtaccggaatatctttccaatatgggctctcggtgagtatcgtcgtcggattcttcatgcacaaacatagttaaatcgatgtgaaagaggaaaattataaatgcgaagtgaaagtaaaatataaatgtatgttaaaatttgctctctctctctctctctctctctacacattatgatgttagtacaactacttttttcccgtaaagtgccatgttataagatatttatgtttgaaataaaaaaaaaaaaaa

SEQ ID NO: 98688 - protein, 758 aa, Olea europaea
MWKLKIADGTGPWLTTTNNHIGRQHWEFDPEAGTPDERVEVERLREEFKKNRFRTKQSADLLMRMQLVKENQRVQIPPAIKIKETEGITEEAVITTLRRAISFYSTIQAHDGHWPAESAGPLFFLPPLVLALYVTGAINVVLSREHQKEITRYIYNHQNEDGGWGIHIEGHSTMFGSVLSYITLRLLGEGQEDGEDKAVARGRKWILDHGGAVGIPSWGKFWLTVLGVYEWDGCNPMPPEFWLLPNFSPIHPGKMLCYCRLVYMPMSYLYGKRFVGPITGLVLSLRQEIYTEPYHGINWNRARNTCAKEDLYYPHPLAQDMLWGFLHHFAEPVLTRWPFSKLREKALKVAMEHVHYEDMNSRYLCIGCVEKVLCLIACWVEDPNSEAYKRHIARIPDYFWVAEDGLKMQSFGCQMWDAAFAIQAILSSNLAEEYGPTLMKAHNFVKASQVQENPSGDFNEMYRHTSKGAWTFSMQDHGWQVSDCTAEGLKAALLFSQMPIELVGAEIETGHLYDAVNVILTLQSASGGFPAWEPQKAYRWLEKLNPTEFFEDVLIERDYVECTSSAVQALKLFKQLHPGHRRKEIASCISKAIQYIEATQNPDGSWDGSWGICFTYGTWFAVEGLVACGKNYHNSPTLRRACEFLLSKQLPDGGWSESYLSSSNKVYTNLEGNRSNLVQTSWALLSLIKAGQVEIDPGPIHRGIKLLVNSQMEDGDFPQEEITGAFMKNCTLNYSSYRNIFPIWALGEYRRRILHAQT

SEQ ID NO: 98689 - DNA, 2347 bp, Luffa cylindrica
  CDS (7)..(2289)
agagagatgtggaagttgaaggtctcgaaaggatgggagacgagcgagaacgatcatgtaggaagacaatattgggaattcgacccgaatctcgaaccttctgaagaagaaagggctgaaatagaaaatgtttgcaatgagttccacaaaaatcgttttcatgtcaaacagagctctgatcttcttatgagacttcagttgagaaaggagaatgcaagcaacgtgaagcttcttactcaaataaaagttgcaagcgaagaggaaataagtgaggaagcagttgaaaccacattgagaagggcaatcagattctactcaaccatgcaaacacaagatggcttttggcctggtgattatggtggccctttgtttctccttcctggcctggtgattgggttaagtgtaacaaatgccctcaatgtagctctctcgtgcaaccatcgacaacagatgtgtcgttacctttacaatcatcagaatgaagatggagggtggggattgcatatagaagggaacagcacaatgctctgtacggctctatcgtacgtgagcctaagattaatgggagaggaaatggacggtcacgatggagccttgcccaaagcaagaagatggattcttgatcgaggtggggcaacctcaatcccctcttggggaaaaatatggctctccgtccttggtgtctatgagtgggaaggaaacaatccacttctacccgagatatggctcttgccttacaatattcttccatttcatccaggaagaatgtggtgtcatagtcgaatggtatatctaccaatgtcatatttgtatggaaaaagatttgtaggatcaattagccccatcgtaatgagcctccggcgagagctttacaaatgtccttatcatatggttgattggaattcttctcgaaacctatgtgctaaggaggacttatacactccacattccaagatacaagacatgttatgggactcaattaacaagtttggggaaccatttatgaagaaatggcctctctcaaagcttaggcaaagggctcttgaccttgtgattcaacacatccactatgaggatgaaaacactcactacctttgccttggacctgttaacaaggtgctaaacatggtgtgttgttgggttgaggatcaaaactcagaagcatttagaagacacatctcaagaatcaaagattatctttggctagctgaggatggaatgaaaatgcagggatacaatgggtctcaattatgggatgtagcttttgcagtgcaagccgtagttgcagctgatttggttgaagaatatggttcagtccttaagaaagctcatgattttgtcaagaactcacaagtgaggagaaatgggcttggagattcaagtgattggtaccgccacatctcaaagggtggatggcccttctcaactccagacaatggatggcctgtctctgactgtacttctgaagctttgaaggtagcaattttgctatcaaaaatgccatcaacaatggtgggtgagccaatagatgtagataagttatatgatgctgttaatctcattctgtcacttcagaatcccaatggaggatttgcatcatatgaactcacaagatcctatccatggttggagatgttcaatccagctgaaatatttggagatgtcatgattgattatcaatatgtggagtgcacttcagcagcaattcaaggacttaaagcattcatgcagttacatccaggccatcgcaagaaagagatacaaaaatgtattgctaaagcagcaaatttcattgaaagcattcaacagactgatggatcatggtatggatcatggggaatttgctacacatatgggacatggtttgggataaagggattggttgcctgtggaaggacctatgataatagcaaaagcataagaaaggcaacagaatttcttctttcaaaacaactcaaatctggtggttggggagagagctacctctcagcccatcataaggtatacaccaatctcaaagggtgcaaatcacatatagtcaatacttcttgggccttgttggctctcattaaagcgggtcaggcgcaaagagacctaactcctttacatcgagcagcaatggtgctgattaattcccaactccacgatggagatttcccacaacaggaaatcatgggagttttcaacaagagttgtatgatcagttactcagcctacagaaacatatttccaatatgggcccttggagagtatcgcattagggttttgcaactccatgaaaaattctagctatatttcaacattacatggacatggaagtgtattatattatatgtataaagaaatt

SEQ ID NO: 98690 - protein, 760 aa, Luffa cylindrica
MWKLKVSKGWETSENDHVGRQYWEFDPNLEPSEEERAEIENVCNEFHKNRFHVKQSSDLLMRLQLRKENASNVKLLTQIKVASEEEISEEAVETTLRRAIRFYSTMQTQDGFWPGDYGGPLFLLPGLVIGLSVTNALNVALSCNHRQQMCRYLYNHQNEDGGWGLHIEGNSTMLCTALSYVSLRLMGEEMDGHDGALPKARRWILDRGGATSIPSWGKIWLSVLGVYEWEGNNPLLPEIWLLPYNILPFHPGRMWCHSRMVYLPMSYLYGKRFVGSISPIVMSLRRELYKCPYHMVDWNSSRNLCAKEDLYTPHSKIQDMLWDSINKFGEPFMKKWPLSKLRQRALDLVIQHIHYEDENTHYLCLGPVNKVLNMVCCWVEDQNSEAFRRHISRIKDYLWLAEDGMKMQGYNGSQLWDVAFAVQAVVAADLVEEYGSVLKKAHDFVKNSQVRRNGLGDSSDWYRHISKGGWPFSTPDNGWPVSDCTSEALKVAILLSKMPSTMVGEPIDVDKLYDAVNLILSLQNPNGGFASYELTRSYPWLEMFNPAEIFGDVMIDYQYVECTSAAIQGLKAFMQLHPGHRKKEIQKCIAKAANFIESIQQTDGSWYGSWGICYTYGTWFGIKGLVACGRTYDNSKSIRKATEFLLSKQLKSGGWGESYLSAHHKVYTNLKGCKSHIVNTSWALLALIKAGQAQRDLTPLHRAAMVLINSQLHDGDFPQQEIMGVFNKSCMISYSAYRNIFPIWALGEYRIRVLQLHEKF

SEQ ID NO: 98691 - DNA, 2579 bp, Allium macrostemon
  CDS (81)..(2369)
cctaatattcattaaccacgtctgttagttcaatatccaagctacttacagggcaatcgactctttccacggattgaataatgtggaagctgctgaagatggcggatggtggcaaccagtggttaagaacaactaataatcatgctggaagacagatctgggagtttgatcccaatctaggcacgcccgaagaaatcgaagcagtcgaaaatgcacgtgaaatttataggaaaaatcgttttaagatgaagcatagttctgatcttctaatgagattgcagtttgcaaaggaaaatcctgcagaaattggtcttccacaagtcaagctcgcagagaatgaaaatattacagaagaagcagcagccataactttaagaagagctatgaaccggtattcaactcttcaagcccatgacgggcaatggcctggtgactatggtggtccaatgtttcttatgcccggactgataatagcactatcagttactggggcattaaatactgtattatctgtagaacatcagcatgagattcgccgttatctgtacaatcaccagaatgaagatggaggatggggtttgcacattgaaggacacagtacgatgtttggttcagttcttgcatatgttactctgagattgcttggtgaaggagctgatggtggagatgatcaagcaatgcagaaaggacgaaagtggattttggatcatggcagtgcaacagcaataacatcatggggaaaattttggctctcggtgcttggtgtttttgactggtctggcaacaatcccctacctccagagatgtatttacttccatatgttcttccagtgcatccaggtcgaatgtggtgccattgtcggatgatttatcttcctatgtcgtatatatatggaaaaagattcgtgggccctgtaacacaaactattatatcattaagaaaggaattgtttaatgttccatatgatcaggtagattggaatgcagcacgtaaccagtgtgccaaggaagatttgtactatcctcatcctttaatacaagatattctttggacaactctacacaaatgtgtggaacctattttgatgcgctggcccggtggcaagttgagggggaaagctctaaaaactgttatggagcatgttcattatgaagatgaaaatactcgatatatttgtcttggccatttctctaaggttctaaatatgctttgctgttgggtggaagatcaaaattcagaggctttcaaattgcacctacctaggctcaatgattatctctggattgccgaagatggaatgaaaatacagggttacaatggaagccagttgtgggacactgcttatgctgttcaagcaataattgcgactgggttttccaatgaatttgggaccacactcaaaaaggcgtataaatatgtcaaggactcccaggttctagaagactgccctggcgatcttagttactggcatcgccatatatctaagggttcatggcctttctccacggctgatcaaggatggctcgtctctgattgtacagctgaaggattgaaggcagcactcctgttgtcaaaaatttctccagaaatcgttggtgacccaatagttgcaaatcgtctttatgatgctgtaaatgtgattctttctctaaagaatcctggcggtggatttgcatcaattgaattgacaaggtcatatgcatggttggagatcatcaatcctgcagaatcatttggagacattgttatagattatccaactgctgaatctacatcagcatgtattcaggcattggcttcatttagaatgttataccctggacatcgcagagatgaaatagaaaaatgcattacgaaaggcgttcagtttattgaaaagacacaagagcatgatggttcatggtatggttcttgggcagtctgctacacaaatggaacatggtatggagtaaagggattgatttccggggggaaatgttatgaaaacagccatagcatcaggaaagcatgtgattttctgctgtcaaaacagttgaaatcaggtggatggggcgagagttacctttcatgtcaagagaaggtctacaccaatctcgagggcaatagagctcatgcagtgaacactagttgggctatgttggctcttattgatgcagggcaggcacaaagagatgctgagcctttgcatcgagctgcaaaagtattgataaatatgcagatggaaaatggagagttcccacagcaagaaataatgggagttttcaatagaaattgcatgataagctattcagcatatcggaatatctttccaatatgggctctaggagagtatcgcacaagggtattgtcttcctctgcaggtcattgactaccttgactgatgaaaacttatgagtgagtacccaagaaccgtacatggttattgctgtatcatttggtctgtagttccaataaaagctggtttaaatgcacagtgttggggttctgtatatcttaacctgagcattttccctcaagtcagttctgtatctttaatttattcttctttttttaataataatttagtaccatcttaaaa

SEQ ID NO: 98692 - protein, 762 aa, Allium macrostemon
MWKLLKMADGGNQWLRTTNNHAGRQIWEFDPNLGTPEEIEAVENAREIYRKNRFKMKHSSDLLMRLQFAKENPAEIGLPQVKLAENENITEEAAAITLRRAMNRYSTLQAHDGQWPGDYGGPMFLMPGLIIALSVTGALNTVLSVEHQHEIRRYLYNHQNEDGGWGLHIEGHSTMFGSVLAYVTLRLLGEGADGGDDQAMQKGRKWILDHGSATAITSWGKFWLSVLGVFDWSGNNPLPPEMYLLPYVLPVHPGRMWCHCRMIYLPMSYIYGKRFVGPVTQTIISLRKELFNVPYDQVDWNAARNQCAKEDLYYPHPLIQDILWTTLHKCVEPILMRWPGGKLRGKALKTVMEHVHYEDENTRYICLGHFSKVLNMLCCWVEDQNSEAFKLHLPRLNDYLWIAEDGMKIQGYNGSQLWDTAYAVQAIIATGFSNEFGTTLKKAYKYVKDSQVLEDCPGDLSYWHRHISKGSWPFSTADQGWLVSDCTAEGLKAALLLSKISPEIVGDPIVANRLYDAVNVILSLKNPGGGFASIELTRSYAWLEIINPAESFGDIVIDYPTAESTSACIQALASFRMLYPGHRRDEIEKCITKGVQFIEKTQEHDGSWYGSWAVCYTNGTWYGVKGLISGGKCYENSHSIRKACDFLLSKQLKSGGWGESYLSCQEKVYTNLEGNRAHAVNTSWAMLALIDAGQAQRDAEPLHRAAKVLINMQMENGEFPQQEIMGVFNRNCMISYSAYRNIFPIWALGEYRTRVLSSSAGH

SEQ ID NO: 98693 - DNA, 2889 bp, Glycyrrhiza glabra
  CDS (131)..(2404)
atcttctagtactactcctccaaagcaataaccatccttcattcccatttctccactctttctctttgattggtcagtcaggcctcttccaaatcgcagtagtatatcacacagactcacacagaggaaaatgtggaagctcaagattgcggagggagggagtccatggcttcggacagtgaacaatcacgttggaagacaggtgtgggagttcgatcctaagcttggatcgccagaagatctcctcgagattgaaaaggctcgccagaatttccacgacaaccgcttcactcacaaacacagcgctgatctactcatgcgcattcactttgcaaaagagaacccaatgaacgaagtcctacccaaagtcagagtcaaagatattgaagatgtaactgaagagaccgtgaaaactacattaagaagggccataaatttccattcaactctccagagtcatgatggacactggccaggagattatggaggtcccatgtttcttatgcctggcttggtaattactctgtctatcaccggggctctgaatgcagtcttaacagaagagcatagaaaggaaatatgccgttacctctataaccatcagaacaaggatggtgggtggggtttacatattgaaggtccaagcaccatgtttggctctgtcttgaattatgttgctctgagattgcttggcgagggacctaatgatagacaaggggaaatggagaagggacgtgactggattcttgggcatggcggtgctacttttataacatcgtggggaaagatgtggctttcagtacttggagtgtatgaatggtctggaaataatcccctgcctcctgagatatggctccttccatacgttcttccaattcatccaggaaggatgtggtgtcactgccggatggtctatttgccaatgtcctacttatatggaaagaggtttgttggcccaatcacaccaacaatattatctttgagaaaggagctttataccataccatatcatgatatagactggaatcaggctcgcaatttgtgtgcaaaggaagacttatactatcctcacccacttgtgcaagatattctgtgggcatctctacacaagttcttggagcctattttgatgcattggcctggcaaaaagttgagagaaatggctattaagactgcaatcgagcatatacattatgaagatgataatactcgttatctttgcataggtcctgtaaataaggtgttaaatatgctttgctgttgggtggaggatccaaattcagaggccttcaagttgcatcttccaaggatctatgattatctatggattgctgaagatggcatgaaaatgcagggctacaatggaagtcaactatgggatactgcatttactgctcaagcaattatttcatctaacctcatcgaagaatatggtccaactctaagaaaagcccatacatacattaagaattcgcaggttttagaagattgtccaggtgatcttagtaaatggtatcgtcacatttcaaaaggtgcttggcctttttcgactgcagatcatggatggccaatttctgactgcacagctgaaggactgaaagctgttctattgctatctaaaattgcaccagagattgttggtgagccattggatgcaaagcgattatatgatgctgtaaatgtcattctctcattacagaatgaagatggtggctttgcaacatatgagctcacaagatcttatacctggttggagttaatcaatccggctgagacttttggtgacatcgttattgattacccttatgtggaatgtacctcagcggcaattcaagctttgacatcatttaagaaactatatcctgggcatcgtcgagaagaaatacaatgctgtattgaaaaagctgcttcctttattgaaaaaacacaagcttcagatggttcatggtatggttcttggggagtttgcttcacttatggcacttggtttggggtaaaagggctgattgctgctggaaagagtttcaataattgctcaagcatccgtaaagcttgtgaatttctgctgtctaagcagctcccatctggtggctggggagagagctatctgtcatgccaaaacaaggtgtattcaaatgtggaaagcaaccggtctcatgtagtaaatactgggtgggctatgctggctctcattgatgctgaacaggctaagagagatccaacgccactgcaccgtgcagctgtatacttgataaattcccaaatggagaatggtgactttccgcaacaggaaataatgggagtcttcaacaagaattgcatgatcacatacgcagcatacagaaatgtattccccatatgggcgttgggagaataccgtcatcgcgtattgcagtcgcagtaatcccgctttagttaggatgccataattacttcggctatttatctttttccatggttctcatctttaaaaagtttatggttaatgagtttggtagtccgctaaacagaaagcaaactcgtgtggagaatgtctatttgctttttctaatgctgattagcgcctctcttgctttccctgcggctgcggcggaggaactagatttatagaggaaaaaatgtttgtgtcgcccttccttttagcacaaggagcacagctatgtgtgttttaattatgtaaatttcaaaaacttacccatcatctctctacccccaattatctccttcattctatatcccttttgcagttttgcgcctacctctgccttcactcttattgagtatccttttggctatcacacttgcattactattactaaatactaggagtaaatgttttgtgtcccttggcctttctttttatagtgcaagtgaaaatttttgctttca

SEQ ID NO: 98694 - protein, 757 aa, Glycyrrhiza glabra
MWKLKIAEGGSPWLRTVNNHVGRQVWEFDPKLGSPEDLLEIEKARQNFHDNRFTHKHSADLLMRIHFAKENPMNEVLPKVRVKDIEDVTEETVKTTLRRAINFHSTLQSHDGHWPGDYGGPMFLMPGLVITLSITGALNAVLTEEHRKEICRYLYNHQNKDGGWGLHIEGPSTMFGSVLNYVALRLLGEGPNDRQGEMEKGRDWILGHGGATFITSWGKMWLSVLGVYEWSGNNPLPPEIWLLPYVLPIHPGRMWCHCRMVYLPMSYLYGKRFVGPITPTILSLRKELYTIPYHDIDWNQARNLCAKEDLYYPHPLVQDILWASLHKFLEPILMHWPGKKLREMAIKTAIEHIHYEDDNTRYLCIGPVNKVLNMLCCWVEDPNSEAFKLHLPRIYDYLWIAEDGMKMQGYNGSQLWDTAFTAQAIISSNLIEEYGPTLRKAHTYIKNSQVLEDCPGDLSKWYRHISKGAWPFSTADHGWPISDCTAEGLKAVLLLSKIAPEIVGEPLDAKRLYDAVNVILSLQNEDGGFATYELTRSYTWLELINPAETFGDIVIDYPYVECTSAAIQALTSFKKLYPGHRREEIQCCIEKAASFIEKTQASDGSWYGSWGVCFTYGTWFGVKGLIAAGKSFNNCSSIRKACEFLLSKQLPSGGWGESYLSCQNKVYSNVESNRSHVVNTGWAMLALIDAEQAKRDPTPLHRAAVYLINSQMENGDFPQQEIMGVFNKNCMITYAAYRNVFPIWALGEYRHRVLQSQ

SEQ ID NO: 98695 - DNA, 2160 bp, Pneumocystis carinii
  CDS (1)..(2160)
atgatttatgggtataccgaaaaagaactagaaaaaacggacccggatgggtggagattgatcgtagaagatacaggacgacaacgctggaagtacctaaaaacagaggaagagaggcgagaaaggcctcaaacatatatggaaaagtattttctggggaaaaatatggatctaccggaacaaccagcagcaaaaacgccgatagaatcggcgagaaaagggttttcgttttataaacatctacaaacgagtgatggtaattgggcatgtgaatatgggggggtaatgtttcttcttccgggacttataattgcaatgtatatttcaaaaatcgaatttccagatgaaatgagaattgaagtaattcgttatttagtgaaccatgctaatcctgaagatggtggttgggggatacacatagagggaaaatctacagtttttgggacagcacttaattatgttgttttacgtatcctaggtcttggaccagaccatccagttactatgaaagcaagaataaggttgaatgagcttgggggtgctattggatgtcctcaatggggaaagttttggctagcagttttaaattgttatggttgggaaggtataaatcctattttacccgagttttggatgttacctgaatggcttcctatacatccatcacgttggtgggtccatacaagagctgtatatcttccaatgggatatatttatggagagaaatttacagcgcctgttgatcctttgatagaatctttgagagaagaattatatactcagccttattcttcaattaatttctcaaaacatagaaacacaacatcaccagtagatgtttatgtacctcatactagatttcttcgtgttattaattctattttaacattttatcatacaatttttcggttttcatggataaaagatatggcatcaaaatatgcttacaaattgattgaatatgaaaataagaatactgatttcttatgtattggtccagttaattttagtattcatattttagcagtttattggaaagaaggtcctgatagttatgcatttaaatctcataaagaaaggatggccgactttttatggatatctaaaaaaggaatgatgatgaatggcactaatggtgttcagctttgggatacttcttttgctgtacaagctcttgtagaatctggattagcagaagatcctgagtttaaagatcatatgattaaggcattggactttcttgataagtgtcaaatacaaaaaaattgtgatgatcagcaaaaatgttatagacatcgaagaaagggtgcatggccatttagtacacgacaacagggatatactgtttcagattgtactgcagaggctttaaaagctgttttacttttacaaaatttaaaatcatttccaaagagagtgtcatatgacagattaaaagattccgttgatgtaatcttatctttacagaataaagatggcggttttgcttcttatgaattgatacgaggaccatcatggttagaatttattaatccagctgaagtttttggagatatcatgatagaacattcttatccagagtgtacaaccgctgctgtcactgctttatgttattttagatcattgtgttctcattaccgtggaccagaaattaataaaagtgttaaaaatgccatccaatttattaaagaaagtcaacgtcctgatgggagttggtatgaaagttgggcaatctgctttacttatgctactatgtttgctttagaaagtctatcatgtgttaaagatttttatgaaaatagtttccattctagaagagcatgtgactttttagttaataaacaagaagaagatggaggatggtccgaaggctatcaatcatgtacagatggcatatggactagacatccaactggtagtcaagtagtacaaactgcatgggcatgcattggacttatgtatgcaaattatcctgatgaaacacctatcaaacgtggaattaatttaatcatgtcgagacaacagcctaatggtgaatggaaacaagaagcaattgaaggtgtttttaataaaaattgtatgattagttatccaaactataaattcaatttcactatcaaagctcttggaatgtattcgaaaagatatggtaatatttag

SEQ ID NO: 98696 - protein, 719 aa, Pneumocystis carinii
MIYGYTEKELEKTDPDGWRLIVEDTGRQRWKYLKTEEERRERPQTYMEKYFLGKNMDLPEQPAAKTPIESARKGFSFYKHLQTSDGNWACEYGGVMFLLPGLIIAMYISKIEFPDEMRIEVIRYLVNHANPEDGGWGIHIEGKSTVFGTALNYVVLRILGLGPDHPVTMKARIRLNELGGAIGCPQWGKFWLAVLNCYGWEGINPILPEFWMLPEWLPIHPSRWWVHTRAVYLPMGYIYGEKFTAPVDPLIESLREELYTQPYSSINFSKHRNTTSPVDVYVPHTRFLRVINSILTFYHTIFRFSWIKDMASKYAYKLIEYENKNTDFLCIGPVNFSIHILAVYWKEGPDSYAFKSHKERMADFLWISKKGMMMNGTNGVQLWDTSFAVQALVESGLAEDPEFKDHMIKALDFLDKCQIQKNCDDQQKCYRHRRKGAWPFSTRQQGYTVSDCTAEALKAVLLLQNLKSFPKRVSYDRLKDSVDVILSLQNKDGGFASYELIRGPSWLEFINPAEVFGDIMIEHSYPECTTAAVTALCYFRSLCSHYRGPEINKSVKNAIQFIKESQRPDGSWYESWAICFTYATMFALESLSCVKDFYENSFHSRRACDFLVNKQEEDGGWSEGYQSCTDGIWTRHPTGSQVVQTAWACIGLMYANYPDETPIKRGINLIMSRQQPNGEWKQEAIEGVFNKNCMISYPNYKFNFTIKALGMYSKRYGNI

SEQ ID NO: 98697 - DNA, 1896 bp, Alicyclobacillus acidocaldarius
  CDS (1)..(1896)
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggcgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 98698 - protein, 631 aa, Alicyclobacillus acidocaldarius [sequence omitted]

SEQ ID NO: 98699 - DNA, 1983 bp, Bradyrhizobium japonicum
  CDS (1)..(1983)
atggattccgtgaacgcgaccgcccgcgaagccaaggaatccaagatctcggaatcggagatcttggaatcgagcattgcgtcagccacgcaaggcgtcctcggcttccagcaatccgacggccattgggtgttcgagctcgaggccgactgcacgattccggccgaatacgttctgttgcgccactatctcgccgagccggtcgacaccgtgctcgaggccaagatcggcaattatctccgtcgcgtgcagggcgcccatggcggctggccgctcgtgcatgacggcgagttcgacatgagcgccagcgtgaaggcgtacttcgcgctgaagatgatcggggattccatcgacgccccgcacatggtgcgtgcgcgcgaggcgatccacgcccgcggcggcgctattcacagcaacgtcttcacgcgcttcatgctcgcgatgttcggcatcgtgacctggcgcgcggtgccggtgctgccgatcgagatcatgctgctgccgttctggtcgccgttccacatcaacaagatctcctactgggcgcgcaccaccatggtgccgctgatggtgatcgccgcgctgaagccgcgcgcgaagaatccgaagggcgtcggcatcgacgagctgtttctccaggatccgcgctcgatcggcatgaccgcgaaggcgccgcaccagagcatggcctggttcctgctgttccgttcgctcgatgcgatcttgcgcgtcatcgagccgctgtttccgaagagcctgcgcaagcgcgccatcgacaccgcgctcgccttcagcgaggagcggctcaacggcgaggacggcatgggcgcgatctatccgccgatggccaacctcgtcatgatgtacgacgcgctcggcaaggacgagaactatccgccgcgcgcggtcacgcgccggggcatcgacaagctgctcgtgatcggcgacgacgaggcctattgccagccctgcgtctcgccggtgtgggatacgacgctgaccgcccacgcgctgctggaggccggcggcgacaaggcggtgcctgcggcgaagcatggcctcgactggctgatcccgaagcaggagctcgaggtgaagggcgactgggccgtgaagcggcccgacgtgcgcccgggcggctgggcgttccagtacaacaatgcctactatcccgatctcgacgacaccgcggtcgtggtgatgtcgatggaccggatgcgccgggagcacggcgtcaccggctatgattccgcgatcgaccgtggccgggagtggatcgagggcatgcagagcgacgacggcggctgggccgccttcgacgtcaacaatctcgaatattacctgaacaacatcccgttctcggaccatggcgcgctgctagatccgccgaccgaggacgtcaccgcgcgctgcgtctcgatgctggcccagctcggcgagaccgccaagaccagcaagcatgtggccgacggggtcgcctacctccgcaagacccagcacccggaagggtcctggtacggccgctggggcatgaacttcatctatggaacctggtcggtgctctgcgccctgaacatggccggcgtccgccacgacgacccgatgattcggaaagccgccgactggctggcctcgatccagaacaaggacgggggctggggcgaggacgccgtcagctaccggctggactacaagggctgggaagccgccccctcgaccgcctcgcaaacggcatgggccttgcttgccctgatggcggcaggcgaggttgatcacccggccgtcgcccgcggggtggagtacctgattgcaacacagaacgaaaaaggactgtgggacgagcagcggtacaccgccacaggctttccccgtgtattctatctacggtatcatggttactcgaagttcttcccgctgtgggcgctggcgcggtaccggaacttgcggaacaccaacagcagggtggtaggggtcggaatgtga

SEQ ID NO: 98700 - protein, 660 aa, Bradyrhizobium japonicum
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAVPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDAVSYRLDYKGWEAAPSTASQTAWALLALMAAGEVDHPAVARGVEYLIATQNEKGLWDEQRYTATGFPRVFYLRYHGYSKFFPLWALARYRNLRNTNSRVVGVGM

SEQ ID NO: 98701 - DNA, 25 bp, Primer
ttaaagcgtatgtgtttcatatgcc

SEQ ID NO: 98702 - DNA, 27 bp, Primer
atgacagaattttattctgacacaatc

SEQ ID NO: 98703 - protein, 737 aa, consensus
  MISC_FEATURE (1)..(737): consensus for the disclosure of xaa see table XV
QXXXDGXWXXXXXXGXXXXXXXXXXXXXXXXXXXXXXXXXXXXXXXXXXXXXXXXXXXXXXXXXRYXXXXQXXXXDGGWGXXXXXXSXXXXXXXXYXXLXXXGXXXXXXXXXXXXXXXXXXXXXXXXIXXXGGXXXXXXXXKXWLXXXGXXXWXGXXXXPPEXXXLPXXXXPXXXXXXXXXXRXXXXPXXYXXXXXXXXXXXXXXXXXXXXXXXXXXXXXXXXXXXXXRXXXXXXXXXXPXXXXXXXXXXXXXXXXXXXXXXXXXXXXXRXXXXXXXXXXXXXXXXXXXXXXXXXXXXXXXXXXXXXXXXXXXXXXXXXXXXXXRXXXXXXXXXXGXXXXXXXXXXXXXXWDXXXXXXAXXXXXXXXXXXXXXXXXXXXXXXXXXXXQXXXXXXXXXXXXXXXRXXXXGXWXFSXXXXXXXXXDXTAEXXXXXXXXXXXXXXXXXXXXXXXXXXXXXXXXXXXXXXXXXXXXGGXXXXEXXXXXXXLXXXXXXXXXXXXXXXXXXXECTXXXXXXLXXFXXXXXXXXXXXXXXXXXXXXXXXXXXQXXXDGSXXXXXWXGXWGXCXXYXXXXXXXXLXXXGXXXXXXXXXXXXXXXXXXLXXXQXXXGGWGEXXXSXXXXXYXXXXXXXXXXXXTXWAXXXLXXXXXXXXXXXXXXXXXXXXXXXXXXXXXXXXXXXXXXXXXXXXXXXXXXXLXXXQXXXGXXXXXXXXGXXFXXXXXXXYXXYXXXXPXXALXXY

SEQ ID NO: 98704 - protein, 764 aa, consensus
  MISC_FEATURE (1)..(764): consensus for the disclosure of xaa see table XV
RXXXXXXXXXXXXXXXXXXXXEXXXXXXXXXXXXXXXXXXXDXXXXXXXXXXXXXXXXXXXXXXXXXXXXXXXXXXXXXXXXXXXXXXXXXXQXXXDGHWPXXXXXGPXFXXPXXXXXXXXXXXXXXXXXXXXXXEXXRYXXXXQNXXDGGWGLHXEXXSTMFXXXLXYXXLRXLGXXXXXXXXXXXXXXXXXXXXXXXGGXXXXXXWGKXWLXXLGXXXWXGXNPXPPEXWXLPXXXXPXHPXXXWXXXRXXYXPMXYXYGKXXXXXXXXXXXXLRXELXXXXXXXYXXIXWXXXRXXXXXXDXYYPHXXXXDXXXXXLXXXXEXXXXXXXXXXXXRXXAXXXXXXXXXXXDXXXXYXXIXXXXKXXXXXXMXXXWXEXXXXXXXFXXHXXRXXDXXWXXXDGMXXQXXXXXQXWDXXFXXQAXXXXXXXXXXXXXXXXXLXXXXXFXXXSQXXXXXXXXXDXXXXXRHXXKGXWXFSXXDXGWXXSDCTAEXXKXXXXXXXXXXXXXXXXXXXXXXLXDXVXXXLXXXXXXXXXXGXXXXXEXXXXXXWLEXXNPXEXFXXXXXXXXYVECTXXXXXXLXXFXXXXPXXRXXEXXXXIXXAXXXXXXXQXXXDGSWYGXWGXCFXYXXXFXXXXLXXXGXXXXXXXXXXXXXKXXXFLXXXQXXXGGWGESXXSXXXXXYXXXXXXXXXXVXTXWAXXXLIXXXXXXXDXXPXXRXXXXLXXXQXXXGXXPQXXXXGXFXXXCXXXYXXYRXXFPXXALXXY

SEQ ID NO: 98705 - protein, 69 aa, consensus
  MISC_FEATURE (1)..(69): consensus for the disclosure of xaa see table XV
XXXXGXXXXXXXXXXXXXXXXXXXXXXXXXXXXXXXXXXXXXXXPXXXXXXXXXXRXXXXXXXXXXXXX

SEQ ID NO: 98706 - protein, 80 aa, consensus
  MISC_FEATURE (1)..(80): consensus for the disclosure of xaa see table XV
WXXXXXXXXXXXXXXXXXXXXXXXXXXXXXXXXXXXXXXXXXXXXXXXXXXXXXXXXXGXXXXXXXXXXXXXXDXXXXXX

SEQ ID NO: 98707 - protein, 101 aa, consensus
  MISC_FEATURE (1)..(101): consensus for the disclosure of xaa see table XV
XXXXXXXXQXXXXGXWXGXWXXXXXYXXXXXXXXXXXXXXXXXXXXXXXXXXXXXXXXXXXXXXXGGWXEXXXXXXXXXXXXXXXXXXXXXXXXXXXXXXX

SEQ ID NO: 98708 - protein, 51 aa, consensus
  MISC_FEATURE (1)..(51): consensus for the disclosure of xaa see table XV
XXXXXXXXXXXXXXXXXXXXXXXXXXXXXXXXXXXXXXXXXXXXXXXLXXX

SEQ ID NO: 98709 - protein, 92 aa, consensus
  MISC_FEATURE (1)..(92): consensus for the disclosure of xaa see table XV
XXXXXXXXQXXXXGXXXXXXXXGXXXXXXXXXXXXXXXXXXXXXXXXXXXXXXXXXXXXXXXXXXGGWGXXXXXXXXXXXXXXXYXXXXXXG

SEQ ID NO: 98710 - protein, 101 aa, consensus
  MISC_FEATURE (1)..(101): consensus for the disclosure of xaa see table XV
XXXXXXXXXXXXXWXXXXXXXXEXXXXXXXXXXXXXXXXXXXXRXXXXXXXYXXXXXXXXXXXXXXXXXXXXXXXXXXXXXXXXXXXXXXXXXXXXXXXXX

SEQ ID NO: 98711 - protein, 110 aa, consensus
  MISC_FEATURE (1)..(110): consensus for the disclosure of xaa see table XV
XXXXXXRXXXXXXXXXXGXXXXXXXXXXXWXXXXXXXXXXXXXXXXXXXXXXXXXXXXXXXXXXXXQXXXXXXXXXXXXXXXRXXXXGXXXXXXXXXGXXXXDCXXEXXX

SEQ ID NO: 98712 - protein, 107 aa, consensus
  MISC_FEATURE (1)..(107): consensus for the disclosure of xaa see table XV
GXXXXXEXXXXXXXXEXXXXXXXXXXXXXXXXXXECXXXXXXXXXXFXXXXXXXXXXXXXXXXXXXXXXXXXXQXXXXGXWXGXWXXCXXYXXXFXXXXXXXXGXXX

SEQ ID NO: 98713 - protein, 106 aa, consensus
  MISC_FEATURE (1)..(106): consensus for the disclosure of xaa see table XV
FXXXXXXXXGGWXEXXXXXXXXXXXXXXXXXXXXXXXXXXXXXLXXXXXXXXXXXXXXXXXXXXXXXQXXXGXXXXXXXXGXXXXXXXXXXXXXXXXXXXXALXXX

SEQ ID NO: 98714 - DNA, 336 bp, Escherichia coli; identical to SEQ ID NO: 48937
  CDS (1)..(336)

SEQ ID NO: 98715 - protein, 111 aa, Escherichia coli; identical to SEQ ID NO: 48938

SEQ ID NO: 98716 - DNA, 333 bp, Synechocystis sp. PCC 6803; identical to SEQ ID NO: 48939
  CDS (1)..(333): transl_table=11

SEQ ID NO: 98717 - protein, 110 aa, Synechocystis sp. PCC 6803; identical to SEQ ID NO: 48940

SEQ ID NO: 98718 - DNA, 390 bp, Pseudomonas putida KT2440; identical to SEQ ID NO: 48941
  CDS (1)..(390): transl_table=11

SEQ ID NO: 98719 - protein, 129 aa, Pseudomonas putida KT2440; identical to SEQ ID NO: 48942

SEQ ID NO: 98720 - DNA, 336 bp, Escherichia coli CFT073; identical to SEQ ID NO: 48943
  CDS (1)..(336): transl_table=11

SEQ ID NO: 98721 - protein, 111 aa, Escherichia coli CFT073; identical to SEQ ID NO: 48944

SEQ ID NO: 98722 - DNA, 363 bp, Bradyrhizobium japonicum USDA 110; identical to SEQ ID NO: 48945
  CDS (1)..(363)

SEQ ID NO: 98723 - protein, 120 aa, Bradyrhizobium japonicum USDA 110; identical to SEQ ID NO: 48946

SEQ ID NO: 98724 - DNA, 327 bp, Ruegeria sp. PR1b; identical to SEQ ID NO: 48947
  CDS (1)..(327): transl_table=11

SEQ ID NO: 98725 - protein, 108 aa, Ruegeria sp. PR1b; identical to SEQ ID NO: 48948

SEQ ID NO: 98726 - DNA, 330 bp, Nitrosomonas europaea ATCC 19718; identical to SEQ ID NO: 48949
  CDS (1)..(330): transl_table=11

SEQ ID NO: 98727 - protein, 109 aa, Nitrosomonas europaea ATCC 19718; identical to SEQ ID NO: 48950

SEQ ID NO: 98728 - DNA, 351 bp, Photorhabdus luminescens subsp. laumondii TTO1; identical to SEQ ID NO: 48951
  CDS (1)..(351): transl_table=11

SEQ ID NO: 98729 - protein, 116 aa, Photorhabdus luminescens subsp. laumondii TTO1; identical to SEQ ID NO: 48952

SEQ ID NO: 98730 - DNA, 318 bp, Pseudomonas aeruginosa; identical to SEQ ID NO: 48953
  CDS (1)..(318): transl_table=11

SEQ ID NO: 98731 - protein, 105 aa, Pseudomonas aeruginosa; identical to SEQ ID NO: 48954

SEQ ID NO: 98732 - DNA, 20 bp, Primer
atgcccgctaatgctcgctc

SEQ ID NO: 98733 - DNA, 24 bp, Primer
ttattcgtcgtcgccaatctcatc

SEQ ID NO: 98734 - protein, 89 aa, consensus; identical to SEQ ID NO: 48957
  MISC_FEATURE (1)..(89): consensus for the disclosure of xaa see table XV

SEQ ID NO: 98735 - protein, 102 aa, consensus; identical to SEQ ID NO: 48958
  MISC_FEATURE (1)..(102): consensus for the disclosure of xaa see table XV

SEQ ID NO: 98736 - DNA, 2196 bp, Saccharomyces cerevisiae; identical to SEQ ID NO: 98533
  CDS (1)..(2196)

SEQ ID NO: 98737 - protein, 731 aa, Saccharomyces cerevisiae; identical to SEQ ID NO: 98534

SEQ ID NO: 98738 - DNA, 1671 bp, Bacillus subtilis; identical to SEQ ID NO: 98535
  CDS (1)..(1671)

SEQ ID NO: 98739 - protein, 556 aa, Bacillus subtilis; identical to SEQ ID NO: 98536

SEQ ID NO: 98740 - DNA, 1914 bp, Nostoc sp. PCC 7120; identical to SEQ ID NO: 98537
  CDS (1)..(1914)

SEQ ID NO: 98741 - protein, 637 aa, Nostoc sp. PCC 7120; identical to SEQ ID NO: 98538

SEQ ID NO: 98742 - DNA, 2292 bp, Arabidopsis thaliana (mouse-ear cress); identical to SEQ ID NO: 98539
  CDS (1)..(2292)

SEQ ID NO: 98743 - protein, 763 aa, Arabidopsis thaliana (mouse-ear cress); identical to SEQ ID NO: 98540

SEQ ID NO: 98744 - DNA, 2304 bp, Arabidopsis thaliana (mouse-ear cress); identical to SEQ ID NO: 98541
  CDS (1)..(2304)

SEQ ID NO: 98745 - protein, 767 aa, Arabidopsis thaliana (mouse-ear cress); identical to SEQ ID NO: 98542

SEQ ID NO: 98746 - DNA, 2280 bp, Arabidopsis thaliana (mouse-ear cress); identical to SEQ ID NO: 98543
  CDS (1)..(2280)

SEQ ID NO: 98747 - protein, 759 aa, Arabidopsis thaliana (mouse-ear cress); identical to SEQ ID NO: 98544

SEQ ID NO: 98748 - DNA, 2637 bp, Homo sapiens (man); identical to SEQ ID NO: 98545
  CDS (19)..(2217)

SEQ ID NO: 98749 - protein, 732 aa, Homo sapiens (man); identical to SEQ ID NO: 98546

SEQ ID NO: 98750 - DNA, 2284 bp, Schizosaccharomyces pombe; identical to SEQ ID NO: 98547
  CDS (105)..(2270)

SEQ ID NO: 98751 - protein, 721 aa, Schizosaccharomyces pombe; identical to SEQ ID NO: 98548

SEQ ID NO: 98752 - DNA, 2677 bp, Pisum sativum (garden pea); identical to SEQ ID NO: 98549
  CDS (116)..(2386)

SEQ ID NO: 98753 - protein, 756 aa, Pisum sativum (garden pea); identical to SEQ ID NO: 98550

SEQ ID NO: 98754 - DNA, 3769 bp, Candida albicans; identical to SEQ ID NO: 98551
  CDS (186)..(2372)

SEQ ID NO: 98755 - protein, 728 aa, Candida albicans; identical to SEQ ID NO: 98552

SEQ ID NO: 98756 - DNA, 2173 bp, Zymomonas mobilis; identical to SEQ ID NO: 98553
  CDS (91)..(2067)

SEQ ID NO: 98757 - protein, 658 aa, Zymomonas mobilis; identical to SEQ ID NO: 98554

SEQ ID NO: 98758 - DNA, 1905 bp, Alicyclobacillus acidoterrestris; identical to SEQ ID NO: 98555
  CDS (1)..(1905)

SEQ ID NO: 98759 - protein, 634 aa, Alicyclobacillus acidoterrestris; identical to SEQ ID NO: 98556

SEQ ID NO: 98760 - DNA, 1944 bp, Synechocystis sp; identical to SEQ ID NO: 98557
  CDS (1)..(1944)

SEQ ID NO: 98761 - protein, 647 aa, Synechocystis sp; identical to SEQ ID NO: 98558

SEQ ID NO: 98762 - DNA, 2493 bp, Arabidopsis thaliana (mouse-ear cress); identical to SEQ ID NO: 98559
  CDS (1)..(2493)

SEQ ID NO: 98763 - protein, 830 aa, Arabidopsis thaliana (mouse-ear cress); identical to SEQ ID NO: 98560

SEQ ID NO: 98764 - DNA, 2043 bp, Streptomyces coelicolor; identical to SEQ ID NO: 98561
  CDS (1)..(2043)

SEQ ID NO: 98765 - protein, 680 aa, Streptomyces coelicolor; identical to SEQ ID NO: 98562

SEQ ID NO: 98766 - DNA, 1965 bp, Methylococcus capsulatus; identical to SEQ ID NO: 98563
  CDS (1)..(1965): b means g or c or t/u

SEQ ID NO: 98767 - protein, 654 aa, Methylococcus capsulatus; identical to SEQ ID NO: 98564
  misc_feature (591)..(591): Xaa can be Gly or Ala or Val

SEQ ID NO: 98768 - DNA, 2229 bp, Arabidopsis thaliana (mouse-ear cress); identical to SEQ ID NO: 98565
  CDS (1)..(2229)

SEQ ID NO: 98769 - protein, 742 aa, Arabidopsis thaliana (mouse-ear cress); identical to SEQ ID NO: 98566

SEQ ID NO: 98770 - DNA, 2449 bp, synthetic construct; identical to SEQ ID NO: 98567
  CDS (1)..(2292)

SEQ ID NO: 98771 - protein, 763 aa, synthetic construct; identical to SEQ ID NO: 98568

SEQ ID NO: 98772 - DNA, 2486 bp, Arabidopsis thaliana; identical to SEQ ID NO: 98569
  CDS (112)..(2385)

SEQ ID NO: 98773 - protein, 757 aa, Arabidopsis thaliana; identical to SEQ ID NO: 98570

SEQ ID NO: 98774 - DNA, 1965 bp, Rhodopseudomonas palustris; identical to SEQ ID NO: 98571
  CDS (1)..(1965)

SEQ ID NO: 98775 - protein, 654 aa, Rhodopseudomonas palustris; identical to SEQ ID NO: 98572

SEQ ID NO: 98776 - DNA, 2559 bp, Panax ginseng; identical to SEQ ID NO: 98573
  CDS (85)..(2361)

SEQ ID NO: 98777 - protein, 758 aa, Panax ginseng; identical to SEQ ID NO: 98574

SEQ ID NO: 98778 - DNA, 2589 bp, Panax ginseng; identical to SEQ ID NO: 98575
  CDS (111)..(2402)

SEQ ID NO: 98779 - protein, 763 aa, Panax ginseng; identical to SEQ ID NO: 98576

SEQ ID NO: 98780 - DNA, 2684 bp, Panax ginseng; identical to SEQ ID NO: 98577
  CDS (131)..(2473)

SEQ ID NO: 98781 - protein, 780 aa, Panax ginseng; identical to SEQ ID NO: 98578

SEQ ID NO: 98782 - DNA, 2729 bp, Panax ginseng; identical to SEQ ID NO: 98579
  CDS (73)..(2358)

SEQ ID NO: 98783 - protein, 761 aa, Panax ginseng; identical to SEQ ID NO: 98580

SEQ ID NO: 98784 - DNA, 2851 bp, Rattus norvegicus; identical to SEQ ID NO: 98581
  CDS (42)..(2243)

SEQ ID NO: 98785 - protein, 733 aa, Rattus norvegicus; identical to SEQ ID NO: 98582

SEQ ID NO: 98786 - DNA, 2409 bp, Cucurbita pepo; identical to SEQ ID NO: 98583
  CDS (26)..(2305)

SEQ ID NO: 98787 - protein, 759 aa, Cucurbita pepo; identical to SEQ ID NO: 98584

SEQ ID NO: 98788 - DNA, 2444 bp, Cucurbita pepo; identical to SEQ ID NO: 98585
  CDS (21)..(2315)

SEQ ID NO: 98789 - protein, 764 aa, Cucurbita pepo; identical to SEQ ID NO: 98586

SEQ ID NO: 98790 - DNA, 2556 bp, Cucurbita pepo; identical to SEQ ID NO: 98587
  CDS (123)..(2423)

SEQ ID NO: 98791 - protein, 766 aa, Cucurbita pepo; identical to SEQ ID NO: 98588

SEQ ID NO: 98792 - DNA, 2190 bp, Debaryomyces hansenii CBS767; identical to SEQ ID NO: 98589
  CDS (1)..(2190)

SEQ ID NO: 98793 - protein, 729 aa, Debaryomyces hansenii CBS767; identical to SEQ ID NO: 98590

SEQ ID NO: 98794 - DNA, 2229 bp, Yarrowia lipolytica CLIB99; identical to SEQ ID NO: 98591
  CDS (1)..(2229)

SEQ ID NO: 98795 - protein, 742 aa, Yarrowia lipolytica CLIB99; identical to SEQ ID NO: 98592

SEQ ID NO: 98796 - DNA, 2196 bp, Kluyveromyces lactis NRRL Y; identical to SEQ ID NO: 98593
  CDS (1)..(2196)

SEQ ID NO: 98797 - protein, 731 aa, Kluyveromyces lactis NRRL Y; identical to SEQ ID NO: 98594

SEQ ID NO: 98798 - DNA, 2202 bp, Candida glabrata CBS138; identical to SEQ ID NO: 98595
  CDS (1)..(2202)

SEQ ID NO: 98799 - protein, 733 aa, Candida glabrata CBS138; identical to SEQ ID NO: 98596

SEQ ID NO: 98800 - DNA, 1854 bp, Bacillus thuringiensis; identical to SEQ ID NO: 98597
  CDS (1)..(1854)

SEQ ID NO: 98801 - protein, 617 aa, Bacillus thuringiensis; identical to SEQ ID NO: 98598

SEQ ID NO: 98802 - DNA, 2274 bp, Avena prostrata; identical to SEQ ID NO: 98599
  CDS (1)..(2274)

SEQ ID NO: 98803 - protein, 757 aa, Avena prostrata; identical to SEQ ID NO: 98600

SEQ ID NO: 98804 - DNA, 2274 bp, Avena clauda; identical to SEQ ID NO: 98601
  CDS (1)..(2274)

SEQ ID NO: 98805 - protein, 757 aa, Avena clauda; identical to SEQ ID NO: 98602

SEQ ID NO: 98806 - DNA, 2280 bp, Avena longiglumis; identical to SEQ ID NO: 98603
  CDS (1)..(2280)

SEQ ID NO: 98807 - protein, 759 aa, Avena longiglumis; identical to SEQ ID NO: 98604

SEQ ID NO: 98808 - DNA, 2280 bp, Avena clauda; identical to SEQ ID NO: 98605
  CDS (1)..(2280)

SEQ ID NO: 98809 - protein, 759 aa, Avena clauda; identical to SEQ ID NO: 98606

SEQ ID NO: 98810 - DNA, 2547 bp, Centella asiatica; identical to SEQ ID NO: 98607
  CDS (32)..(2305)

SEQ ID NO: 98811 - protein, 757 aa, Centella asiatica; identical to SEQ ID NO: 98608

SEQ ID NO: 98812 - DNA, 2562 bp, Centella asiatica; identical to SEQ ID NO: 98609
  CDS (77)..(2359)

SEQ ID NO: 98813 - protein, 760 aa, Centella asiatica; identical to SEQ ID NO: 98610

SEQ ID NO: 98814 - DNA, 1854 bp, Bacillus cereus; identical to SEQ ID NO: 98611
  CDS (1)..(1854)

SEQ ID NO: 98815 - protein, 617 aa, Bacillus cereus; identical to SEQ ID NO: 98612

SEQ ID NO: 98816 - DNA, 2193 bp, Geobacter sulfurreducens; identical to SEQ ID NO: 98613
  CDS (1)..(2193)

SEQ ID NO: 98817 - protein, 730 aa, Geobacter sulfurreducens; identical to SEQ ID NO: 98614

SEQ ID NO: 98818 - DNA, 2040 bp, Geobacter sulfurreducens; identical to SEQ ID NO: 98615
  CDS (1)..(2040)

SEQ ID NO: 98819 - protein, 679 aa, Geobacter sulfurreducens; identical to SEQ ID NO: 98616

SEQ ID NO: 98820 - DNA, 2190 bp, Ashbya gossypii; identical to SEQ ID NO: 98617
  CDS (1)..(2190)

SEQ ID NO: 98821 - protein, 729 aa, Ashbya gossypii; identical to SEQ ID NO: 98618

SEQ ID NO: 98822 - DNA, 2562 bp, Panax ginseng; identical to SEQ ID NO: 98619
  CDS (48)..(2357)

SEQ ID NO: 98823 - protein, 769 aa, Panax ginseng; identical to SEQ ID NO: 98620

SEQ ID NO: 98824 - DNA, 1899 bp, Bacillus subtilis; identical to SEQ ID NO: 98621
  CDS (1)..(1899)

SEQ ID NO: 98825 - protein, 632 aa, Bacillus subtilis; identical to SEQ ID NO: 98622

SEQ ID NO: 98826 - DNA, 2505 bp, Oryza sativa; identical to SEQ ID NO: 98623
  CDS (1)..(2505)

SEQ ID NO: 98827 - protein, 834 aa, Oryza sativa; identical to SEQ ID NO: 98624

SEQ ID NO: 98828 - DNA, 1914 bp, Gloeobacter violaceus; identical to SEQ ID NO: 98625
  CDS (1)..(1914)

SEQ ID NO: 98829 - protein, 637 aa, Gloeobacter violaceus; identical to SEQ ID NO: 98626

SEQ ID NO: 98830 - DNA, 1794 bp, Stigmatella aurantiaca; identical to SEQ ID NO: 98627
  CDS (1)..(1794)

SEQ ID NO: 98831 - protein, 597 aa, Stigmatella aurantiaca; identical to SEQ ID NO: 98628

SEQ ID NO: 98832 - DNA, 1854 bp, Bacillus cereus; identical to SEQ ID NO: 98629
  CDS (1)..(1854)

SEQ ID NO: 98833 - protein, 617 aa, Bacillus cereus; identical to SEQ ID NO: 98630

SEQ ID NO: 98834 - DNA, 2001 bp, Streptomyces avermitilis; identical to SEQ ID NO: 98631
  CDS (1)..(2001)

SEQ ID NO: 98835 - protein, 666 aa, Streptomyces avermitilis; identical to SEQ ID NO: 98632

SEQ ID NO: 98836 - DNA, 2001 bp, Nitrosomonas europaea; identical to SEQ ID NO: 98633
  CDS (1)..(2001)

SEQ ID NO: 98837 - protein, 666 aa, Nitrosomonas europaea; identical to SEQ ID NO: 98634

SEQ ID NO: 98838 - DNA, 2458 bp, Lotus japonicus; identical to SEQ ID NO: 98635
  CDS (12)..(2300)

SEQ ID NO: 98839 - protein, 762 aa, Lotus japonicus; identical to SEQ ID NO: 98636

SEQ ID NO: 98840 - DNA, 2202 bp, Mus musculus; identical to SEQ ID NO: 98637
  CDS (1)..(2202)

SEQ ID NO: 98841 - protein, 733 aa, Mus musculus; identical to SEQ ID NO: 98638

SEQ ID NO: 98842 - DNA, 1929 bp, Synechococcus elongatus; identical to SEQ ID NO: 98639
  CDS (1)..(1929)

SEQ ID NO: 98843 - protein, 642 aa, Synechococcus elongatus; identical to SEQ ID NO: 98640

SEQ ID NO: 98844 - DNA, 2729 bp, Medicago truncatula; identical to SEQ ID NO: 98641
  CDS (96)..(2384)

SEQ ID NO: 98845 - protein, 762 aa, Medicago truncatula; identical to SEQ ID NO: 98642

SEQ ID NO: 98846 - DNA, 2416 bp, Glycine max; identical to SEQ ID NO: 98643
  CDS (48)..(2267)

SEQ ID NO: 98847 - protein, 739 aa, Glycine max; identical to SEQ ID NO: 98644

SEQ ID NO: 98848 - DNA, 2487 bp, Costus speciosus; identical to SEQ ID NO: 98645
  CDS (80)..(2359)

SEQ ID NO: 98849 - protein, 759 aa, Costus speciosus; identical to SEQ ID NO: 98646

SEQ ID NO: 98850 - DNA, 2683 bp, Costus speciosus; identical to SEQ ID NO: 98647
  CDS (207)..(2486)

SEQ ID NO: 98851 - protein, 759 aa, Costus speciosus; identical to SEQ ID NO: 98648

SEQ ID NO: 98852 - DNA, 2629 bp, Betula platyphylla; identical to SEQ ID NO: 98649
  CDS (225)..(2432)

SEQ ID NO: 98853 - protein, 735 aa, Betula platyphylla; identical to SEQ ID NO: 98650

SEQ ID NO: 98854 - DNA, 2519 bp, Betula platyphylla; identical to SEQ ID NO: 98651
  CDS (39)..(2378): n means a or g or c or t/u

SEQ ID NO: 98855 - protein, 779 aa, Betula platyphylla; identical to SEQ ID NO: 98652

SEQ ID NO: 98856 - DNA, 2471 bp, Betula platyphylla; identical to SEQ ID NO: 98653
  CDS (87)..(2354)

SEQ ID NO: 98857 - protein, 755 aa, Betula platyphylla; identical to SEQ ID NO: 98654

SEQ ID NO: 98858 - DNA, 2514 bp, Betula platyphylla; identical to SEQ ID NO: 98655
  CDS (162)..(2435): k means g or t/u

SEQ ID NO: 98859 - protein, 757 aa, Betula platyphylla; identical to SEQ ID NO: 98656
  misc_feature (309)..(309): Xaa can be Asp or Tyr

SEQ ID NO: 98860 - DNA, 2460 bp, Betula platyphylla; identical to SEQ ID NO: 98657
  CDS (48)..(2351)

SEQ ID NO: 98861 - protein, 767 aa, Betula platyphylla; identical to SEQ ID NO: 98658

SEQ ID NO: 98862 - DNA, 2410 bp, Cephalosporium caerulens; identical to SEQ ID NO: 98659
  CDS (46)..(2328)

SEQ ID NO: 98863 - protein, 760 aa, Cephalosporium caerulens; identical to SEQ ID NO: 98660

SEQ ID NO: 98864 - DNA, 2551 bp, Luffa cylindrica; identical to SEQ ID NO: 98661
  CDS (130)..(2409)

SEQ ID NO: 98865 - protein, 759 aa, Luffa cylindrica; identical to SEQ ID NO: 98662

SEQ ID NO: 98866 - DNA, 2456 bp, Arabidopsis thaliana; identical to SEQ ID NO: 98663
  CDS (1)..(2286)

SEQ ID NO: 98867 - protein, 761 aa, Arabidopsis thaliana; identical to SEQ ID NO: 98664

SEQ ID NO: 98868 - DNA, 3057 bp, Abies magnifica; identical to SEQ ID NO: 98665
  CDS (503)..(2773)

SEQ ID NO: 98869 - protein, 756 aa, Abies magnifica; identical to SEQ ID NO: 98666

SEQ ID NO: 98870 - DNA, 2301 bp, Arabidopsis thaliana; identical to SEQ ID NO: 98667
  CDS (1)..(2301)

SEQ ID NO: 98871 - protein, 766 aa, Arabidopsis thaliana; identical to SEQ ID NO: 98668

SEQ ID NO: 98872 - DNA, 2718 bp, Trypanosoma brucei brucei; identical to SEQ ID NO: 98669
  CDS (1)..(2718)

SEQ ID NO: 98873 - protein, 905 aa, Trypanosoma brucei brucei; identical to SEQ ID NO: 98670

SEQ ID NO: 98874 - DNA, 2516 bp, Pisum sativum; identical to SEQ ID NO: 98671
  CDS (73)..(2367)

SEQ ID NO: 98875 - protein, 764 aa, Pisum sativum; identical to SEQ ID NO: 98672

SEQ ID NO: 98876 - DNA, 2601 bp, Pisum sativum; identical to SEQ ID NO: 98673
  CDS (70)..(2346)

SEQ ID NO: 98877 - protein, 758 aa, Pisum sativum; identical to SEQ ID NO: 98674

SEQ ID NO: 98878 - DNA, 2190 bp, Arabidopsis thaliana; identical to SEQ ID NO: 98675
  CDS (1)..(2190)

SEQ ID NO: 98879 - protein, 729 aa, Arabidopsis thaliana; identical to SEQ ID NO: 98676

SEQ ID NO: 98880 - DNA, 2671 bp, Glycyrrhiza glabra; identical to SEQ ID NO: 98677
  CDS (308)..(2605)

SEQ ID NO: 98881 - protein, 765 aa, Glycyrrhiza glabra; identical to SEQ ID NO: 98678

SEQ ID NO: 98882 - DNA, 2262 bp, Neurospora crassa; identical to SEQ ID NO: 98679
  CDS (1)..(2262)

SEQ ID NO: 98883 - protein, 753 aa, Neurospora crassa; identical to SEQ ID NO: 98680

SEQ ID NO: 98884 - DNA, 2433 bp, Luffa cylindrica; identical to SEQ ID NO: 98681
  CDS (3)..(2300)

SEQ ID NO: 98885 - protein, 765 aa, Luffa cylindrica; identical to SEQ ID NO: 98682

SEQ ID NO: 98886 - DNA, 2493 bp, Taraxacum officinale; identical to SEQ ID NO: 98683
  CDS (116)..(2392)

SEQ ID NO: 98887 - protein, 758 aa, Taraxacum officinale; identical to SEQ ID NO: 98684

SEQ ID NO: 98888 - DNA, 2452 bp, Taraxacum officinale; identical to SEQ ID NO: 98685
  CDS (30)..(2306)

SEQ ID NO: 98889 - protein, 758 aa, Taraxacum officinale; identical to SEQ ID NO: 98686

SEQ ID NO: 98890 - DNA, 2546 bp, Olea europaea; identical to SEQ ID NO: 98687
  CDS (89)..(2365): n means a or g or c or t/u

SEQ ID NO: 98891 - protein, 758 aa, Olea europaea; identical to SEQ ID NO: 98688

SEQ ID NO: 98892 - DNA, 2347 bp, Luffa cylindrica; identical to SEQ ID NO: 98689
  CDS (7)..(2289)

SEQ ID NO: 98893 - protein, 760 aa, Luffa cylindrica; identical to SEQ ID NO: 98690

SEQ ID NO: 98894 - DNA, 2579 bp, Allium macrostemon; identical to SEQ ID NO: 98691
  CDS (81)..(2369)

SEQ ID NO: 98895 - protein, 762 aa, Allium macrostemon; identical to SEQ ID NO: 98692

SEQ ID NO: 98896 - DNA, 2889 bp, Glycyrrhiza glabra; identical to SEQ ID NO: 98693
  CDS (131)..(2404)

SEQ ID NO: 98897 - protein, 757 aa, Glycyrrhiza glabra; identical to SEQ ID NO: 98694

SEQ ID NO: 98898 - DNA, 2160 bp, Pneumocystis carinii; identical to SEQ ID NO: 98695
  CDS (1)..(2160)

SEQ ID NO: 98899 - protein, 719 aa, Pneumocystis carinii; identical to SEQ ID NO: 98696

SEQ ID NO: 98900 - DNA, 1896 bp, Alicyclobacillus acidocaldarius; identical to SEQ ID NO: 98697
  CDS (1)..(1896)

SEQ ID NO: 98901 - protein, 631 aa, Alicyclobacillus acidocaldarius [sequence omitted]

SEQ ID NO: 98902 - DNA, 1983 bp, Bradyrhizobium japonicum; identical to SEQ ID NO: 98699
  CDS (1)..(1983)

SEQ ID NO: 98903 - protein, 660 aa, Bradyrhizobium japonicum; identical to SEQ ID NO: 98700

SEQ ID NO: 98904 - DNA, 25 bp, Primer
ttaaagcgtatgtgtttcatatgcc

SEQ ID NO: 98905 - DNA, 27 bp, Primer
atgacagaattttattctgacacaatc

SEQ ID NO: 98906 - protein, 737 aa, consensus; identical to SEQ ID NO: 98703
  MISC_FEATURE (1)..(737): consensus for the disclosure of xaa see table XV

SEQ ID NO: 98907 - protein, 764 aa, consensus; identical to SEQ ID NO: 98704
  MISC_FEATURE (1)..(764): consensus for the disclosure of xaa see table XV

SEQ ID NO: 98908 - protein, 69 aa, consensus; identical to SEQ ID NO: 98705
  MISC_FEATURE (1)..(69): consensus for the disclosure of xaa see table XV

SEQ ID NO: 98909 - protein, 80 aa, consensus; identical to SEQ ID NO: 98706
  MISC_FEATURE (1)..(80): consensus for the disclosure of xaa see table XV

SEQ ID NO: 98910 - protein, 101 aa, consensus; identical to SEQ ID NO: 98707
  MISC_FEATURE (1)..(101): consensus for the disclosure of xaa see table XV

SEQ ID NO: 98911 - protein, 51 aa, consensus; identical to SEQ ID NO: 98708
  MISC_FEATURE (1)..(51): consensus for the disclosure of xaa see table XV

SEQ ID NO: 98912 - protein, 92 aa, consensus; identical to SEQ ID NO: 98709
  MISC_FEATURE (1)..(92): consensus for the disclosure of xaa see table XV

SEQ ID NO: 98913 - protein, 101 aa, consensus; identical to SEQ ID NO: 98710
  MISC_FEATURE (1)..(101): consensus for the disclosure of xaa see table XV

SEQ ID NO: 98914 - protein, 110 aa, consensus; identical to SEQ ID NO: 98711
  MISC_FEATURE (1)..(110): consensus for the disclosure of xaa see table XV

SEQ ID NO: 98915 - protein, 107 aa, consensus; identical to SEQ ID NO: 98712
  MISC_FEATURE (1)..(107): consensus for the disclosure of xaa see table XV

SEQ ID NO: 98916 - protein, 106 aa, consensus; identical to SEQ ID NO: 98713
  MISC_FEATURE (1)..(106): consensus for the disclosure of xaa see table XV

SEQ ID NO: 98917 - DNA, 1290 bp, Escherichia coli; identical to SEQ ID NO: 79937
  CDS (1)..(1290)

SEQ ID NO: 98918 - protein, 429 aa, Escherichia coli; identical to SEQ ID NO: 63800

SEQ ID NO: 98919 - DNA, 1242 bp, Helicobacter pylori 26695; identical to SEQ ID NO: 63715
  CDS (1)..(1242): transl_table=11

SEQ ID NO: 98920 - protein, 413 aa, Helicobacter pylori 26695; identical to SEQ ID NO: 63716

SEQ ID NO: 98921 - DNA, 1194 bp, Chlamydia trachomatis D/UW-3/CX; identical to SEQ ID NO: 79941
  CDS (1)..(1194): transl_table=11

SEQ ID NO: 98922 - protein, 397 aa, Chlamydia trachomatis D/UW-3/CX; identical to SEQ ID NO: 79942

SEQ ID NO: 98923 - DNA, 1254 bp, Vibrio cholerae O1 biovar eltor str. N16961; identical to SEQ ID NO: 79943
  CDS (1)..(1254): transl_table=11

SEQ ID NO: 98924 - protein, 417 aa, Vibrio cholerae O1 biovar eltor str. N16961; identical to SEQ ID NO: 79944

SEQ ID NO: 98925 - DNA, 1254 bp, Vibrio cholerae O1 biovar eltor str. N16961; identical to SEQ ID NO: 63717
  CDS (1)..(1254): transl_table=11

SEQ ID NO: 98926 - protein, 417 aa, Vibrio cholerae O1 biovar eltor str. N16961; identical to SEQ ID NO: 63718

SEQ ID NO: 98927 - DNA, 1242 bp, Pasteurella multocida subsp. multocida str. Pm70; identical to SEQ ID NO: 63719
  CDS (1)..(1242): transl_table=11

SEQ ID NO: 98928 - protein, 413 aa, Pasteurella multocida subsp. multocida str. Pm70; identical to SEQ ID NO: 63720

SEQ ID NO: 98929 - DNA, 1188 bp, Chlamydia muridarum Nigg; identical to SEQ ID NO: 79949
  CDS (1)..(1188): transl_table=11

SEQ ID NO: 98930 - protein, 395 aa, Chlamydia muridarum Nigg; identical to SEQ ID NO: 79950

SEQ ID NO: 98931 - DNA, 1671 bp, Mycobacterium tuberculosis CDC1551; identical to SEQ ID NO: 9201
  CDS (1)..(1671): transl_table=11

SEQ ID NO: 98932 - protein, 556 aa, Mycobacterium tuberculosis CDC1551; identical to SEQ ID NO: 9202

SEQ ID NO: 98933 - DNA, 1191 bp, Chlamydophila pneumoniae AR39; identical to SEQ ID NO: 79953
  CDS (1)..(1191): transl_table=11

SEQ ID NO: 98934 - protein, 396 aa, Chlamydophila pneumoniae AR39; identical to SEQ ID NO: 79954

SEQ ID NO: 98935 - DNA, 1290 bp, Salmonella typhimurium LT2; identical to SEQ ID NO: 79955
  CDS (1)..(1290): transl_table=11

SEQ ID NO: 98936 - protein, 429 aa, Salmonella typhimurium LT2; identical to SEQ ID NO: 79956

SEQ ID NO: 98937 - DNA, 1332 bp, Salmonella typhimurium LT2; identical to SEQ ID NO: 63725
  CDS (1)..(1332): transl_table=11

SEQ ID NO: 98938 - protein, 443 aa, Salmonella typhimurium LT2; identical to SEQ ID NO: 63726

SEQ ID NO: 98939 - DNA, 1299 bp, Salmonella typhimurium LT2; identical to SEQ ID NO: 79959
  CDS (1)..(1299): transl_table=11

SEQ ID NO: 98940 - protein, 432 aa, Salmonella typhimurium LT2; identical to SEQ ID NO: 79960

SEQ ID NO: 98941 - DNA, 1287 bp, Yersinia pestis KIM; identical to SEQ ID NO: 63727
  CDS (1)..(1287): transl_table=11

SEQ ID NO: 98942 - protein, 428 aa, Yersinia pestis KIM; identical to SEQ ID NO: 63728

SEQ ID NO: 98943 - DNA, 1119 bp, Shigella flexneri 2a str. 301; identical to SEQ ID NO: 63729
  CDS (1)..(1119): transl_table=11

SEQ ID NO: 98944 - protein, 372 aa, Shigella flexneri 2a str. 301; identical to SEQ ID NO: 63730

SEQ ID NO: 98945 - DNA, 1332 bp, Shigella flexneri 2a str. 301; identical to SEQ ID NO: 63733
  CDS (1)..(1332): transl_table=11

SEQ ID NO: 98946 - protein, 443 aa, Shigella flexneri 2a str. 301; identical to SEQ ID NO: 63734

SEQ ID NO: 98947 - DNA, 1248 bp, Shigella flexneri 2a str. 301; identical to SEQ ID NO: 79967
  CDS (1)..(1248): transl_table=11

SEQ ID NO: 98948 - protein, 415 aa, Shigella flexneri 2a str. 301; identical to SEQ ID NO: 79968

SEQ ID NO: 98949 - DNA, 1320 bp, Shewanella oneidensis MR-1; identical to SEQ ID NO: 79969
  CDS (1)..(1320): transl_table=11

SEQ ID NO: 98950 - protein, 439 aa, Shewanella oneidensis MR-1; identical to SEQ ID NO: 79970

SEQ ID NO: 98951 - DNA, 1293 bp, Shewanella oneidensis MR-1; identical to SEQ ID NO: 63737
  CDS (1)..(1293): transl_table=11

SEQ ID NO: 98952 - protein, 430 aa, Shewanella oneidensis MR-1; identical to SEQ ID NO: 63738

SEQ ID NO: 98953 - DNA, 1188 bp, Shewanella oneidensis MR-1; identical to SEQ ID NO: 79973
  CDS (1)..(1188): transl_table=11

SEQ ID NO: 98954 - protein, 395 aa, Shewanella oneidensis MR-1; identical to SEQ ID NO: 79974

SEQ ID NO: 98955 - DNA, 1188 bp, Shewanella oneidensis MR-1; identical to SEQ ID NO: 79975
  CDS (1)..(1188): transl_table=11

SEQ ID NO: 98956 - protein, 395 aa, Shewanella oneidensis MR-1; identical to SEQ ID NO: 79976

SEQ ID NO: 98957 - DNA, 1281 bp, Pseudomonas putida KT2440; identical to SEQ ID NO: 79977
  CDS (1)..(1281): transl_table=11

SEQ ID NO: 98958 - protein, 426 aa, Pseudomonas putida KT2440; identical to SEQ ID NO: 79978

SEQ ID NO: 98959 - DNA, 1281 bp, Lactobacillus plantarum WCFS1; identical to SEQ ID NO: 63739
  CDS (1)..(1281): transl_table=11

SEQ ID NO: 98960 - protein, 426 aa, Lactobacillus plantarum WCFS1; identical to SEQ ID NO: 63740

SEQ ID NO: 98961 - DNA, 1278 bp, Pseudomonas syringae pv. tomato str. DC3000; identical to SEQ ID NO: 79981
  CDS (1)..(1278): transl_table=11

SEQ ID NO: 98962 - protein, 425 aa, Pseudomonas syringae pv. tomato str. DC3000; identical to SEQ ID NO: 79982

SEQ ID NO: 98963 - DNA, 1230 bp, Salmonella enterica subsp. enterica serovar Typhi Ty2; identical to SEQ ID NO: 63745
  CDS (1)..(1230): transl_table=11

SEQ ID NO: 98964 - protein, 409 aa, Salmonella enterica subsp. enterica serovar Typhi Ty2; identical to SEQ ID NO: 63746

SEQ ID NO: 98965 - DNA, 1299 bp, Salmonella enterica subsp. enterica serovar Typhi Ty2; identical to SEQ ID NO: 79985
  CDS (1)..(1299): transl_table=11

SEQ ID NO: 98966 - protein, 432 aa, Salmonella enterica subsp. enterica serovar Typhi Ty2; identical to SEQ ID NO: 79986

SEQ ID NO: 98967 - DNA, 1281 bp, Coxiella burnetii RSA 493; identical to SEQ ID NO: 79987
  CDS (1)..(1281): transl_table=11

SEQ ID NO: 98968 - protein, 426 aa, Coxiella burnetii RSA 493; identical to SEQ ID NO: 79988

SEQ ID NO: 98969 - DNA, 1188 bp, Chlamydophila caviae GPIC; identical to SEQ ID NO: 79989
  CDS (1)..(1188): transl_table=11

SEQ ID NO: 98970 - protein, 395 aa, Chlamydophila caviae GPIC; identical to SEQ ID NO: 79990

SEQ ID NO: 98971 - DNA, 1320 bp, Bacillus cereus ATCC 14579; identical to SEQ ID NO: 79991
  CDS (1)..(1320): transl_table=11

SEQ ID NO: 98972 - protein, 439 aa, Bacillus cereus ATCC 14579; identical to SEQ ID NO: 79992

SEQ ID NO: 98973 - DNA, 1380 bp, Helicobacter hepaticus ATCC 51449; identical to SEQ ID NO: 63749
  CDS (1)..(1380): transl_table=11

SEQ ID NO: 98974 - protein, 459 aa, Helicobacter hepaticus ATCC 51449; identical to SEQ ID NO: 63750

SEQ ID NO: 98975 - DNA, 1290 bp, Wigglesworthia glossinidia endosymbiont of Glossina brevipalpis; identical to SEQ ID NO: 63751
  CDS (1)..(1290): transl_table=11

SEQ ID NO: 98976 - protein, 429 aa, Wigglesworthia glossinidia endosymbiont of Glossina brevipalpis; identical to SEQ ID NO: 63752

SEQ ID NO: 98977 - DNA, 1227 bp, Haemophilus ducreyi 35000HP; identical to SEQ ID NO: 79997
  CDS (1)..(1227): transl_table=11

SEQ ID NO: 98978 - protein, 408 aa, Haemophilus ducreyi 35000HP; identical to SEQ ID NO: 79998

SEQ ID NO: 98979 - DNA, 1299 bp, Chromobacterium violaceum ATCC 12472; identical to SEQ ID NO: 63753
  CDS (1)..(1299): transl_table=11

SEQ ID NO: 98980 - protein, 432 aa, Chromobacterium violaceum ATCC 12472; identical to SEQ ID NO: 63754

SEQ ID NO: 98981 - DNA, 1299 bp, Photorhabdus luminescens subsp. laumondii TTO1; identical to SEQ ID NO: 63755
  CDS (1)..(1299): transl_table=11

SEQ ID NO: 98982 - protein, 432 aa, Photorhabdus luminescens subsp. laumondii TTO1; identical to SEQ ID NO: 63756

SEQ ID NO: 98983 - DNA, 1254 bp, Vibrio vulnificus YJ016; identical to SEQ ID NO: 80003
  CDS (1)..(1254): transl_table=11

SEQ ID NO: 98984 - protein, 417 aa, Vibrio vulnificus YJ016; identical to SEQ ID NO: 80004

SEQ ID NO: 98985 - DNA, 1344 bp, Corynebacterium diphtheriae NCTC 13129; identical to SEQ ID NO: 63759
  CDS (1)..(1344): transl_table=11

SEQ ID NO: 98986 - protein, 447 aa, Corynebacterium diphtheriae NCTC 13129; identical to SEQ ID NO: 63760

SEQ ID NO: 98987 - DNA, 1200 bp, Parachlamydia sp. UWE25; identical to SEQ ID NO: 80007
  CDS (1)..(1200): transl_table=11

SEQ ID NO: 98988 - protein, 399 aa, Parachlamydia sp. UWE25; identical to SEQ ID NO: 80008

SEQ ID NO: 98989 - DNA, 1284 bp, Parachlamydia sp. UWE25; identical to SEQ ID NO: 80009
  CDS (1)..(1284): transl_table=11

SEQ ID NO: 98990 - protein, 427 aa, Parachlamydia sp. UWE25; identical to SEQ ID NO: 80010

SEQ ID NO: 98991 - DNA, 1290 bp, Erwinia carotovora subsp. atroseptica SCRI1043; identical to SEQ ID NO: 63763
  CDS (1)..(1290)

SEQ ID NO: 98992 - protein, 429 aa, Erwinia carotovora subsp. atroseptica SCRI1043; identical to SEQ ID NO: 63764

SEQ ID NO: 98993 - DNA, 1416 bp, Propionibacterium acnes KPA171202; identical to SEQ ID NO: 63765
  CDS (1)..(1416): transl_table=11

SEQ ID NO: 98994 - protein, 471 aa, Propionibacterium acnes KPA171202; identical to SEQ ID NO: 63766

SEQ ID NO: 98995 - DNA, 1197 bp, Desulfotalea psychrophila LSv54; identical to SEQ ID NO: 80015
  CDS (1)..(1197): transl_table=11

SEQ ID NO: 98996 - protein, 398 aa, Desulfotalea psychrophila LSv54; identical to SEQ ID NO: 80016

SEQ ID NO: 98997 - DNA, 1302 bp, Yersinia pseudotuberculosis IP 32953; identical to SEQ ID NO: 63767
  CDS (1)..(1302): transl_table=11

SEQ ID NO: 98998 - protein, 433 aa, Yersinia pseudotuberculosis IP 32953; identical to SEQ ID NO: 63768

SEQ ID NO: 98999 - DNA, 1362 bp, Legionella pneumophila subsp. pneumophila str. Philadelphia 1; identical to SEQ ID NO: 80019
  CDS (1)..(1362): transl_table=11

SEQ ID NO: 99000 - protein, 453 aa, Legionella pneumophila subsp. pneumophila str. Philadelphia 1; identical to SEQ ID NO: 80020

SEQ ID NO: 99001 - DNA, 1254 bp, Photobacterium profundum SS9; identical to SEQ ID NO: 63771
  CDS (1)..(1254): transl_table=11

SEQ ID NO: 99002 - protein, 417 aa, Photobacterium profundum SS9; identical to SEQ ID NO: 63772

SEQ ID NO: 99003 - DNA, 1332 bp, Photobacterium profundum SS9; identical to SEQ ID NO: 63775
  CDS (1)..(1332): transl_table=11

SEQ ID NO: 99004 - protein, 443 aa, Photobacterium profundum SS9; identical to SEQ ID NO: 63776

SEQ ID NO: 99005 - DNA, 1395 bp, Photobacterium profundum SS9; identical to SEQ ID NO: 63777
  CDS (1)..(1395): transl_table=11

SEQ ID NO: 99006 - protein, 464 aa, Photobacterium profundum SS9; identical to SEQ ID NO: 63778

SEQ ID NO: 99007 - DNA, 1329 bp, Zymomonas mobilis subsp. mobilis ZM4; identical to SEQ ID NO: 63779
  CDS (1)..(1329): transl_table=11

SEQ ID NO: 99008 - protein, 442 aa, Zymomonas mobilis subsp. mobilis ZM4; identical to SEQ ID NO: 63780

SEQ ID NO: 99009 - DNA, 1263 bp, Francisella tularensis subsp. tularensis Schu 4; identical to SEQ ID NO: 63781
  CDS (1)..(1263): transl_table=11

SEQ ID NO: 99010 - protein, 420 aa, Francisella tularensis subsp. tularensis Schu 4; identical to SEQ ID NO: 63782

SEQ ID NO: 99011 - DNA, 1218 bp, Francisella tularensis subsp. tularensis Schu 4; identical to SEQ ID NO: 80031
  CDS (1)..(1218): transl_table=11

SEQ ID NO: 99012 - protein, 405 aa, Francisella tularensis subsp. tularensis Schu 4; identical to SEQ ID NO: 80032

SEQ ID NO: 99013 - DNA, 1224 bp, Francisella tularensis subsp. tularensis Schu 4; identical to SEQ ID NO: 63783
  CDS (1)..(1224): transl_table=11

SEQ ID NO: 99014 - protein, 407 aa, Francisella tularensis subsp. tularensis Schu 4; identical to SEQ ID NO: 63784

SEQ ID NO: 99015 - DNA, 1206 bp, Francisella tularensis subsp. tularensis Schu 4; identical to SEQ ID NO: 80035
  CDS (1)..(1206): transl_table=11

SEQ ID NO: 99016 - protein, 401 aa, Francisella tularensis subsp. tularensis Schu 4; identical to SEQ ID NO: 80036

SEQ ID NO: 99017 - DNA, 1251 bp, Campylobacter jejuni RM1221; identical to SEQ ID NO: 63785
  CDS (1)..(1251): transl_table=11

SEQ ID NO: 99018 - protein, 416 aa, Campylobacter jejuni RM1221; identical to SEQ ID NO: 63786

SEQ ID NO: 99019 - DNA, 1305 bp, Vibrio fischeri ES114; identical to SEQ ID NO: 63711
  CDS (1)..(1305): transl_table=11

SEQ ID NO: 99020 - protein, 434 aa, Vibrio fischeri ES114; identical to SEQ ID NO: 63712

SEQ ID NO: 99021 - DNA, 1167 bp, Vibrio fischeri ES114; identical to SEQ ID NO: 80041
  CDS (1)..(1167): transl_table=11

SEQ ID NO: 99022 - protein, 388 aa, Vibrio fischeri ES114; identical to SEQ ID NO: 80042

SEQ ID NO: 99023 - DNA, 1260 bp, Vibrio fischeri ES114; identical to SEQ ID NO: 63713
  CDS (1)..(1260): transl_table=11

SEQ ID NO: 99024 - protein, 419 aa, Vibrio fischeri ES114; identical to SEQ ID NO: 63714

SEQ ID NO: 99025 - DNA, 1167 bp, Desulfovibrio desulfuricans G20; identical to SEQ ID NO: 80045
  CDS (1)..(1167)

SEQ ID NO: 99026 - protein, 388 aa, Desulfovibrio desulfuricans G20; identical to SEQ ID NO: 80046

SEQ ID NO: 99027 - DNA, 1218 bp, Haemophilus somnus 2336; identical to SEQ ID NO: 80047
  CDS (1)..(1218)

SEQ ID NO: 99028 - protein, 405 aa, Haemophilus somnus 2336; identical to SEQ ID NO: 80048

SEQ ID NO: 99029 - DNA, 1230 bp, Actinobacillus pleuropneumoniae serovar 1 str. 4074; identical to SEQ ID NO: 63789
  CDS (1)..(1230)

SEQ ID NO: 99030 - protein, 409 aa, Actinobacillus pleuropneumoniae serovar 1 str. 4074; identical to SEQ ID NO: 63790

SEQ ID NO: 99031 - DNA, 1218 bp, Actinobacillus pleuropneumoniae serovar 1 str. 4074; identical to SEQ ID NO: 80051
  CDS (1)..(1218)

SEQ ID NO: 99032 - protein, 405 aa, Actinobacillus pleuropneumoniae serovar 1 str. 4074; identical to SEQ ID NO: 80052

SEQ ID NO: 99033 - DNA, 1215 bp, Actinobacillus pleuropneumoniae serovar 1 str. 4074; identical to SEQ ID NO: 80053
  CDS (1)..(1215)

SEQ ID NO: 99034 - protein, 404 aa, Actinobacillus pleuropneumoniae serovar 1 str. 4074; identical to SEQ ID NO: 80054

SEQ ID NO: 99035 - DNA, 1239 bp, Haemophilus influenzae R2846; identical to SEQ ID NO: 80055
  CDS (1)..(1239)

SEQ ID NO: 99036 - protein, 412 aa, Haemophilus influenzae R2846; identical to SEQ ID NO: 80056

SEQ ID NO: 99037 - DNA, 1320 bp, Bacillus cereus G9241; identical to SEQ ID NO: 80057
  CDS (1)..(1320): transl_table=11

SEQ ID NO: 99038 - protein, 439 aa, Bacillus cereus G9241; identical to SEQ ID NO: 80058

SEQ ID NO: 99039 - DNA, 1302 bp, Pseudomonas fluorescens PfO-1; identical to SEQ ID NO: 80059
  CDS (1)..(1302)

SEQ ID NO: 99040 - protein, 433 aa, Pseudomonas fluorescens PfO-1; identical to SEQ ID NO: 80060

SEQ ID NO: 99041 - DNA, 1281 bp, Pseudomonas fluorescens PfO-1; identical to SEQ ID NO: 63791
  CDS (1)..(1281)

SEQ ID NO: 99042 - protein, 426 aa, Pseudomonas fluorescens PfO-1; identical to SEQ ID NO: 63792

SEQ ID NO: 99043 - DNA, 1323 bp, Campylobacter coli RM2228; identical to SEQ ID NO: 80063
  CDS (1)..(1323): transl_table=11

SEQ ID NO: 99044 - protein, 440 aa, Campylobacter coli RM2228; identical to SEQ ID NO: 80064

SEQ ID NO: 99045 - DNA, 1284 bp, Campylobacter lari RM2100; identical to SEQ ID NO: 63793
  CDS (1)..(1284): transl_table=11

SEQ ID NO: 99046 - protein, 427 aa, Campylobacter lari RM2100; identical to SEQ ID NO: 63794

SEQ ID NO: 99047 - DNA, 1311 bp, Campylobacter upsaliensis RM3195; identical to SEQ ID NO: 80067
  CDS (1)..(1311): transl_table=11

SEQ ID NO: 99048 - protein, 436 aa, Campylobacter upsaliensis RM3195; identical to SEQ ID NO: 80068

SEQ ID NO: 99049 - DNA, 1296 bp, Aeromonas salmonicida; identical to SEQ ID NO: 63795
  CDS (1)..(1296): transl_table=11

SEQ ID NO: 99050 - protein, 431 aa, Aeromonas salmonicida; identical to SEQ ID NO: 63796

SEQ ID NO: 99051 - DNA, 1248 bp, Escherichia coli; identical to SEQ ID NO: 80071
  CDS (1)..(1248): transl_table=11

SEQ ID NO: 99052 - protein, 415 aa, Escherichia coli; identical to SEQ ID NO: 80072

SEQ ID NO: 99053 - DNA, 1248 bp, Escherichia coli; identical to SEQ ID NO: 80073
  CDS (1)..(1248): transl_table=11

SEQ ID NO: 99054 - protein, 415 aa, Escherichia coli; identical to SEQ ID NO: 80074

SEQ ID NO: 99055 - DNA, 1299 bp, Citrobacter freundii; identical to SEQ ID NO: 63797
  CDS (1)..(1299): transl_table=11

SEQ ID NO: 99056 - protein, 432 aa, Citrobacter freundii; identical to SEQ ID NO: 63798

SEQ ID NO: 99057 - DNA, 1332 bp, Escherichia coli; identical to SEQ ID NO: 80077
  CDS (1)..(1332): transl_table=11

SEQ ID NO: 99058 - protein, 443 aa, Escherichia coli; identical to SEQ ID NO: 63710

SEQ ID NO: 99059 - DNA, 1332 bp, Escherichia coli; identical to SEQ ID NO: 63805
  CDS (1)..(1332)

SEQ ID NO: 99060 - protein, 443 aa, Escherichia coli; identical to SEQ ID NO: 63806

SEQ ID NO: 99061 - DNA, 1272 bp, Escherichia coli; identical to SEQ ID NO: 63807
  CDS (1)..(1272): transl_table=11

SEQ ID NO: 99062 - protein, 423 aa, Escherichia coli; identical to SEQ ID NO: 63808

SEQ ID NO: 99063 - DNA, 23 bp, Primer
atggaaacgactcaaaccagcac

SEQ ID NO: 99064 - DNA, 25 bp, Primer
ttagctgaacagagagtagaagatt

SEQ ID NO: 99065 - protein, 423 aa, consensus; identical to SEQ ID NO: 80085
  MISC_FEATURE (1)..(423): consensus for the disclosure of xaa see table XV

SEQ ID NO: 99066 - protein, 23 aa, consensus
  MISC_FEATURE (1)..(23): consensus for the disclosure of xaa see table XV
XXXXGXXXGXGXXXXPXXXXXXG

SEQ ID NO: 99067 - protein, 15 aa, consensus
  MISC_FEATURE (1)..(15): consensus for the disclosure of xaa see table XV
XXXXXXXXXXXXXXX

SEQ ID NO: 99068 - DNA, 1332 bp, Escherichia coli; identical to SEQ ID NO: 63709
  CDS (1)..(1332)

SEQ ID NO: 99069 - protein, 443 aa, Escherichia coli; identical to SEQ ID NO: 63710

SEQ ID NO: 99070 - DNA, 1305 bp, Vibrio fischeri ES114; identical to SEQ ID NO: 63711
  CDS (1)..(1305)

SEQ ID NO: 99071 - protein, 434 aa, Vibrio fischeri ES114; identical to SEQ ID NO: 63712

SEQ ID NO: 99072 - DNA, 1260 bp, Vibrio fischeri ES114; identical to SEQ ID NO: 63713
  CDS (1)..(1260)

SEQ ID NO: 99073 - protein, 419 aa, Vibrio fischeri ES114; identical to SEQ ID NO: 63714

SEQ ID NO: 99074 - DNA, 1242 bp, Helicobacter pylori 26695; identical to SEQ ID NO: 63715
  CDS (1)..(1242): transl_table=11

SEQ ID NO: 99075 - protein, 413 aa, Helicobacter pylori 26695; identical to SEQ ID NO: 63716

SEQ ID NO: 99076 - DNA, 1254 bp, Vibrio cholerae O1 biovar eltor str. N16961; identical to SEQ ID NO: 63717
  CDS (1)..(1254): transl_table=11

SEQ ID NO: 99077 - protein, 417 aa, Vibrio cholerae O1 biovar eltor str. N16961; identical to SEQ ID NO: 63718

SEQ ID NO: 99078 - DNA, 1242 bp, Pasteurella multocida subsp. multocida str. Pm70; identical to SEQ ID NO: 63719
  CDS (1)..(1242): transl_table=11

SEQ ID NO: 99079 - protein, 413 aa, Pasteurella multocida subsp. multocida str. Pm70; identical to SEQ ID NO: 63720

SEQ ID NO: 99080 - DNA, 1251 bp, Campylobacter jejuni subsp. jejuni NCTC 11168; identical to SEQ ID NO: 63721
  CDS (1)..(1251): transl_table=11

SEQ ID NO: 99081 - protein, 416 aa, Campylobacter jejuni subsp. jejuni NCTC 11168; identical to SEQ ID NO: 63722

SEQ ID NO: 99082 - DNA, 1332 bp, Salmonella typhimurium LT2; identical to SEQ ID NO: 63723
  CDS (1)..(1332): transl_table=11

SEQ ID NO: 99083 - protein, 443 aa, Salmonella typhimurium LT2; identical to SEQ ID NO: 63724

SEQ ID NO: 99084 - DNA, 1332 bp, Salmonella typhimurium LT2; identical to SEQ ID NO: 63725
  CDS (1)..(1332): transl_table=11

SEQ ID NO: 99085 - protein, 443 aa, Salmonella typhimurium LT2; identical to SEQ ID NO: 63726

SEQ ID NO: 99086 - DNA, 1287 bp, Yersinia pestis KIM; identical to SEQ ID NO: 63727
  CDS (1)..(1287): transl_table=11

SEQ ID NO: 99087 - protein, 428 aa, Yersinia pestis KIM; identical to SEQ ID NO: 63728

SEQ ID NO: 99088 - DNA, 1119 bp, Shigella flexneri 2a str. 301; identical to SEQ ID NO: 63729
  CDS (1)..(1119): transl_table=11

SEQ ID NO: 99089 - protein, 372 aa, Shigella flexneri 2a str. 301; identical to SEQ ID NO: 63730

SEQ ID NO: 99090 - DNA, 1332 bp, Shigella flexneri 2a str. 301; identical to SEQ ID NO: 63731
  CDS (1)..(1332): transl_table=11

SEQ ID NO: 99091 - protein, 443 aa, Shigella flexneri 2a str. 301; identical to SEQ ID NO: 63732

SEQ ID NO: 99092 - DNA, 1332 bp, Shigella flexneri 2a str. 301; identical to SEQ ID NO: 63733
  CDS (1)..(1332): transl_table=11

SEQ ID NO: 99093 - protein, 443 aa, Shigella flexneri 2a str. 301; identical to SEQ ID NO: 63734

SEQ ID NO: 99094 - DNA, 1272 bp, Shigella flexneri 2a str. 301; identical to SEQ ID NO: 63735
  CDS (1)..(1272): transl_table=11

SEQ ID NO: 99095 - protein, 423 aa, Shigella flexneri 2a str. 301; identical to SEQ ID NO: 63736

SEQ ID NO: 99096 - DNA, 1293 bp, Shewanella oneidensis MR-1; identical to SEQ ID NO: 63737
  CDS (1)..(1293): transl_table=11

SEQ ID NO: 99097 - protein, 430 aa, Shewanella oneidensis MR-1; identical to SEQ ID NO: 63738

SEQ ID NO: 99098 - DNA, 1281 bp, Lactobacillus plantarum WCFS1; identical to SEQ ID NO: 63739
  CDS (1)..(1281): transl_table=11

SEQ ID NO: 99099 - protein, 426 aa, Lactobacillus plantarum WCFS1; identical to SEQ ID NO: 63740

SEQ ID NO: 99100 - DNA, 1326 bp, Vibrio parahaemolyticus RIMD 2210633; identical to SEQ ID NO: 63741
  CDS (1)..(1326): transl_table=11

SEQ ID NO: 99101 - protein, 441 aa, Vibrio parahaemolyticus RIMD 2210633; identical to SEQ ID NO: 63742

SEQ ID NO: 99102 - DNA, 1257 bp, Vibrio parahaemolyticus RIMD 2210633; identical to SEQ ID NO: 63743
  CDS (1)..(1257): transl_table=11

SEQ ID NO: 99103 - protein, 418 aa, Vibrio parahaemolyticus RIMD 2210633; identical to SEQ ID NO: 63744

SEQ ID NO: 99104 - DNA, 1230 bp, Salmonella enterica subsp. enterica serovar Typhi Ty2; identical to SEQ ID NO: 63745
  CDS (1)..(1230): transl_table=11

SEQ ID NO: 99105 - protein, 409 aa, Salmonella enterica subsp. enterica serovar Typhi Ty2; identical to SEQ ID NO: 63746

SEQ ID NO: 99106 - DNA, 1320 bp, Bacillus cereus ATCC 14579; identical to SEQ ID NO: 63747
  CDS (1)..(1320): transl_table=11

SEQ ID NO: 99107 - protein, 439 aa, Bacillus cereus ATCC 14579; identical to SEQ ID NO: 63748

SEQ ID NO: 99108 - DNA, 1380 bp, Helicobacter hepaticus ATCC 51449; identical to SEQ ID NO: 63749
  CDS (1)..(1380): transl_table=11

SEQ ID NO: 99109 - protein, 459 aa, Helicobacter hepaticus ATCC 51449; identical to SEQ ID NO: 63750

SEQ ID NO: 99110 - DNA, 1290 bp, Wigglesworthia glossinidia endosymbiont of Glossina brevipalpis; identical to SEQ ID NO: 63751
  CDS (1)..(1290): transl_table=11

SEQ ID NO: 99111 - protein, 429 aa, Wigglesworthia glossinidia endosymbiont of Glossina brevipalpis; identical to SEQ ID NO: 63752

SEQ ID NO: 99112 - DNA, 1299 bp, Chromobacterium violaceum ATCC 12472; identical to SEQ ID NO: 63753
  CDS (1)..(1299): transl_table=11

SEQ ID NO: 99113 - protein, 432 aa, Chromobacterium violaceum ATCC 12472; identical to SEQ ID NO: 63754

SEQ ID NO: 99114 - DNA, 1299 bp, Photorhabdus luminescens subsp. laumondii TTO1; identical to SEQ ID NO: 63755
  CDS (1)..(1299): transl_table=11

SEQ ID NO: 99115 - protein, 432 aa, Photorhabdus luminescens subsp. laumondii TTO1; identical to SEQ ID NO: 63756

SEQ ID NO: 99116 - DNA, 1254 bp, Vibrio vulnificus YJ016; identical to SEQ ID NO: 63757
  CDS (1)..(1254): transl_table=11

SEQ ID NO: 99117 - protein, 417 aa, Vibrio vulnificus YJ016; identical to SEQ ID NO: 63758

SEQ ID NO: 99118 - DNA, 1344 bp, Corynebacterium diphtheriae NCTC 13129; identical to SEQ ID NO: 63759
  CDS (1)..(1344): transl_table=11

SEQ ID NO: 99119 - protein, 447 aa, Corynebacterium diphtheriae NCTC 13129; identical to SEQ ID NO: 63760

SEQ ID NO: 99120 - DNA, 1320 bp, Bacillus thuringiensis serovar konkukian str. 97-27; identical to SEQ ID NO: 63761
  CDS (1)..(1320): transl_table=11

SEQ ID NO: 99121 - protein, 439 aa, Bacillus thuringiensis serovar konkukian str. 97-27; identical to SEQ ID NO: 63762

SEQ ID NO: 99122 - DNA, 1290 bp, Erwinia carotovora subsp. atroseptica SCRI1043; identical to SEQ ID NO: 63763
  CDS (1)..(1290)

SEQ ID NO: 99123 - protein, 429 aa, Erwinia carotovora subsp. atroseptica SCRI1043; identical to SEQ ID NO: 63764

SEQ ID NO: 99124 - DNA, 1416 bp, Propionibacterium acnes KPA171202; identical to SEQ ID NO: 63765
  CDS (1)..(1416): transl_table=11

SEQ ID NO: 99125 - protein, 471 aa, Propionibacterium acnes KPA171202; identical to SEQ ID NO: 63766

SEQ ID NO: 99126 - DNA, 1302 bp, Yersinia pseudotuberculosis IP 32953; identical to SEQ ID NO: 63767
  CDS (1)..(1302): transl_table=11

SEQ ID NO: 99127 - protein, 433 aa, Yersinia pseudotuberculosis IP 32953; identical to SEQ ID NO: 63768

SEQ ID NO: 99128 - DNA, 1296 bp, Legionella pneumophila str. Lens; identical to SEQ ID NO: 63769
  CDS (1)..(1296): transl_table=11

SEQ ID NO: 99129 - protein, 431 aa, Legionella pneumophila str. Lens; identical to SEQ ID NO: 63770

SEQ ID NO: 99130 - DNA, 1254 bp, Photobacterium profundum SS9; identical to SEQ ID NO: 63771
  CDS (1)..(1254): transl_table=11

SEQ ID NO: 99131 - protein, 417 aa, Photobacterium profundum SS9; identical to SEQ ID NO: 63772

SEQ ID NO: 99132 - DNA, 1257 bp, Photobacterium profundum SS9; identical to SEQ ID NO: 63773
  CDS (1)..(1257): transl_table=11

SEQ ID NO: 99133 - protein, 418 aa, Photobacterium profundum SS9; identical to SEQ ID NO: 63774

SEQ ID NO: 99134 - DNA, 1332 bp, Photobacterium profundum SS9; identical to SEQ ID NO: 63775
  CDS (1)..(1332): transl_table=11

SEQ ID NO: 99135 - protein, 443 aa, Photobacterium profundum SS9; identical to SEQ ID NO: 63776

SEQ ID NO: 99136 - DNA, 1395 bp, Photobacterium profundum SS9; identical to SEQ ID NO: 63777
  CDS (1)..(1395): transl_table=11

SEQ ID NO: 99137 - protein, 464 aa, Photobacterium profundum SS9; identical to SEQ ID NO: 63778

SEQ ID NO: 99138 - DNA, 1329 bp, Zymomonas mobilis subsp. mobilis ZM4; identical to SEQ ID NO: 63779
  CDS (1)..(1329): transl_table=11

SEQ ID NO: 99139 - protein, 442 aa, Zymomonas mobilis subsp. mobilis ZM4; identical to SEQ ID NO: 63780

SEQ ID NO: 99140 - DNA, 1263 bp, Francisella tularensis subsp. tularensis Schu 4; identical to SEQ ID NO: 63781
  CDS (1)..(1263): transl_table=11

SEQ ID NO: 99141 - protein, 420 aa, Francisella tularensis subsp. tularensis Schu 4; identical to SEQ ID NO: 63782

SEQ ID NO: 99142 - DNA, 1224 bp, Francisella tularensis subsp. tularensis Schu 4; identical to SEQ ID NO: 63783
  CDS (1)..(1224): transl_table=11

SEQ ID NO: 99143 - protein, 407 aa, Francisella tularensis subsp. tularensis Schu 4; identical to SEQ ID NO: 63784

SEQ ID NO: 99144 - DNA, 1251 bp, Campylobacter jejuni RM1221; identical to SEQ ID NO: 63785
  CDS (1)..(1251): transl_table=11

SEQ ID NO: 99145 - protein, 416 aa, Campylobacter jejuni RM1221; identical to SEQ ID NO: 63786

SEQ ID NO: 99146 - DNA, 1278 bp, Pseudomonas syringae pv. syringae B728a; identical to SEQ ID NO: 63787
  CDS (1)..(1278)

SEQ ID NO: 99147 - protein, 425 aa, Pseudomonas syringae pv. syringae B728a; identical to SEQ ID NO: 63788

SEQ ID NO: 99148 - DNA, 1230 bp, Actinobacillus pleuropneumoniae serovar 1 str. 4074; identical to SEQ ID NO: 63789
  CDS (1)..(1230)

SEQ ID NO: 99149 - protein, 409 aa, Actinobacillus pleuropneumoniae serovar 1 str. 4074; identical to SEQ ID NO: 63790

SEQ ID NO: 99150 - DNA, 1281 bp, Pseudomonas fluorescens PfO-1; identical to SEQ ID NO: 63791
  CDS (1)..(1281)

SEQ ID NO: 99151 - protein, 426 aa, Pseudomonas fluorescens PfO-1; identical to SEQ ID NO: 63792

SEQ ID NO: 99152 - DNA, 1284 bp, Campylobacter lari RM2100; identical to SEQ ID NO: 63793
  CDS (1)..(1284): transl_table=11

SEQ ID NO: 99153 - protein, 427 aa, Campylobacter lari RM2100; identical to SEQ ID NO: 63794

SEQ ID NO: 99154 - DNA, 1296 bp, Aeromonas salmonicida; identical to SEQ ID NO: 63795
  CDS (1)..(1296): transl_table=11

SEQ ID NO: 99155 - protein, 431 aa, Aeromonas salmonicida; identical to SEQ ID NO: 63796

SEQ ID NO: 99156 - DNA, 1299 bp, Citrobacter freundii; identical to SEQ ID NO: 63797
  CDS (1)..(1299): transl_table=11

SEQ ID NO: 99157 - protein, 432 aa, Citrobacter freundii; identical to SEQ ID NO: 63798

SEQ ID NO: 99158 - DNA, 1290 bp, Escherichia coli; identical to SEQ ID NO: 63799
  CDS (1)..(1290): transl_table=11

SEQ ID NO: 99159 - protein, 429 aa, Escherichia coli; identical to SEQ ID NO: 63800

SEQ ID NO: 99160 - DNA, 1239 bp, Haemophilus influenzae; identical to SEQ ID NO: 63801
  CDS (1)..(1239): transl_table=11

SEQ ID NO: 99161 - protein, 412 aa, Haemophilus influenzae; identical to SEQ ID NO: 63802

SEQ ID NO: 99162 - DNA, 1290 bp, Shigella flexneri; identical to SEQ ID NO: 63803
  CDS (1)..(1290)

SEQ ID NO: 99163 - protein, 429 aa, Shigella flexneri; identical to SEQ ID NO: 63804

SEQ ID NO: 99164 - DNA, 1332 bp, Escherichia coli; identical to SEQ ID NO: 63805
  CDS (1)..(1332)

SEQ ID NO: 99165 - protein, 443 aa, Escherichia coli; identical to SEQ ID NO: 63806

SEQ ID NO: 99166 - DNA, 1272 bp, Escherichia coli; identical to SEQ ID NO: 63807
  CDS (1)..(1272): transl_table=11

SEQ ID NO: 99167 - protein, 423 aa, Escherichia coli; identical to SEQ ID NO: 63808

SEQ ID NO: 99168 - DNA, 26 bp, Primer
atgagtacttcagatagcattgtatc

SEQ ID NO: 99169 - DNA, 27 bp, Primer
ttaaaacagtttgtatacgatgttcag

SEQ ID NO: 99170 - protein, 463 aa, consensus; identical to SEQ ID NO: 63811
  MISC_FEATURE (1)..(463): consensus for the disclosure of xaa see table XV

SEQ ID NO: 99171 - protein, 54 aa, consensus; identical to SEQ ID NO: 63812
  MISC_FEATURE (1)..(54): consensus for the disclosure of xaa see table XV

SEQ ID NO: 99172 - protein, 40 aa, consensus; identical to SEQ ID NO: 63813
  MISC_FEATURE (1)..(40): consensus for the disclosure of xaa see table XV

SEQ ID NO: 99173 - protein, 42 aa, consensus; identical to SEQ ID NO: 63814
  MISC_FEATURE (1)..(42): consensus for the disclosure of xaa see table XV

SEQ ID NO: 99174 - protein, 24 aa, consensus
  MISC_FEATURE (1)..(24): consensus for the disclosure of xaa see table XV
XXXXXXXXXXXXXXXXXXXXXXXX

SEQ ID NO: 99175 - protein, 37 aa, consensus; identical to SEQ ID NO: 63816
  MISC_FEATURE (1)..(37): consensus for the disclosure of xaa see table XV

SEQ ID NO: 99176 - protein, 31 aa, consensus; identical to SEQ ID NO: 63817
  MISC_FEATURE (1)..(31): consensus for the disclosure of xaa see table XV

SEQ ID NO: 99177 - protein, 59 aa, consensus; identical to SEQ ID NO: 63818
  MISC_FEATURE (1)..(59): consensus for the disclosure of xaa see table XV

SEQ ID NO: 99178 - DNA, 480 bp, Escherichia coli
  CDS (1)..(480)
atgacacccgcagttaaattactcgaaaaaaacaagatttcgtttcaaatccatacctacgagcacgatccggctgaaaccaattttggcgatgaagtcgtcaaaaaattaggtttgaatccggatcaggtctacaaaacgctgctggtggcagtgaacggtgatatgaaacaccttgccgtggccgttacgccggtcgcaggtcaactggatcttaaaaaagtagcaaaagcgctgggtgccaagaaagttgagatggccgatccgatggtcgcgcagcgttcgacgggatacctggttggggggattagcccactggggcagaaaaaacgtctgccaacgattatcgacgcccccgcacaagaatttgccactatttatgtttccggcggcaagcgcggactggatatcgaactggcggcaggcgatctggcaaagatcctcgatgccaaatttgctgatatcgcccgccgcgattaa

SEQ ID NO: 99179 - protein, 159 aa, Escherichia coli
MTPAVKLLEKNKISFQIHTYEHDPAETNFGDEVVKKLGLNPDQVYKTLLVAVNGDMKHLAVAVTPVAGQLDLKKVAKALGAKKVEMADPMVAQRSTGYLVGGISPLGQKKRLPTIIDAPAQEFATIYVSGGKRGLDIELAAGDLAKILDAKFADIARRD

SEQ ID NO: 99180 - DNA, 477 bp, Pasteurella multocida subsp. multocida str. Pm70
  CDS (1)..(477): transl_table=11
atgacaccagcaattgatttactgaaaaaacataagattgcctttgtgctacatcattatgatcatgatccaaataacacccattttggtgatgaggctgtggagaaattagggattgatcccaaccagtcgtttaaaacactgttagtagcagaaaatggtgatcagaaaaaattagcctgttttgtgttaccgactgcgaatatgctgaatttaaagaaagccgcaaaagcgatcgctgtgaaaaaagtggaaatggcagataaagaatttgcccagaaaagtaccggttatttagtcggtggaatcagcccattaggacaaaagcgtgtcttaaaaaccgtgattgctcagtctgcgctagcctttgaacatatttttgtttctggtggaaaacgaggcttgagtgtggaattagcaccacaagacttagccaaactgctcaatgctgaatttgcggatattgtggacgaataa

SEQ ID NO: 99181 - protein, 158 aa, Pasteurella multocida subsp. multocida str. Pm70
MTPAIDLLKKHKIAFVLHHYDHDPNNTHFGDEAVEKLGIDPNQSFKTLLVAENGDQKKLACFVLPTANMLNLKKAAKAIAVKKVEMADKEFAQKSTGYLVGGISPLGQKRVLKTVIAQSALAFEHIFVSGGKRGLSVELAPQDLAKLLNAEFADIVDE

SEQ ID NO: 99182 - DNA, 480 bp, Neisseria meningitidis MC58
  CDS (1)..(480): transl_table=11
atgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttga

SEQ ID NO: 99183 - protein, 159 aa, Neisseria meningitidis MC58
MSKHTYPITPAVRVLRENGIEFEPFTYAYEEHGGTAQFARLFGKDEHLVIKTIVLQDENGKGLIVLMHGDKQISTRNLARHLGAKHIEPATPVQANKWTGYLVGGTTPFGIRTKLDIYVEQSVMDLETIYINGGKRGFIIGIRPGDLNILNPKTIQAAV

SEQ ID NO: 99184 - DNA, 474 bp, Sinorhizobium meliloti 1021
  CDS (1)..(474): transl_table=11
atgtcgaagacaacccgggcgacgcaggccctcgcaaaggccggcgtcattttcaccgttcacagctatgactacgatcccggcgccgaacgcgtcggactgcaggcggcggaggcgctcggcgaggacccttcccgtgtgctgaagacactgatggccgaggtggacggcaagccggtctgctgcatcgtgccctcggaccgggaggtgagcatgaagaagctcgccgcagccttcggcggcaagtcggcgagcatgatgaaaccggcggacgccgagcggctcaccggctatcacgtcggcggcatcagccccttcgggcaaagaaagacggtcccgactgcgatagaggaagcggcccttgccgaagcgctggttttcatcaatggcgggcagcgcggcctgcaggtgcggcttgcgcccaaggatgcgcaagccgcattgcgtgcggttgccgcatctctgatcgcctga

SEQ ID NO: 99185 - protein, 157 aa, Sinorhizobium meliloti 1021
MSKTTRATQALAKAGVIFTVHSYDYDPGAERVGLQAAEALGEDPSRVLKTLMAEVDGKPVCCIVPSDREVSMKKLAAAFGGKSASMMKPADAERLTGYHVGGISPFGQRKTVPTAIEEAALAEALVFINGGQRGLQVRLAPKDAQAALRAVAASLIA

SEQ ID NO: 99186 - DNA, 480 bp, Bacillus subtilis subsp. subtilis str. 168
  CDS (1)..(480): transl_table=11
atggcgaaaaaaatggcaaaaacaaatgcggttcgtctgatagaacagcagaacatctcttatgaggtattagggtataaaacagacggccagccggtagatggcatctctgttgcggaaaaaatcggttattctttgaaatatgtatataaaacgttggttgcagcagcaggaacaaatcattattatgtctttgttgtacccgttgcagaagagttagatgtaaaaaaggcagcaaaggtgacaggggaaaagaaaatagaaatgattgcaatgaaggagctgttagcggtaactggctatcttcgcggcggctgctcgccaattggcatgaaaaaattgttcccgacctatattgatgcatctgcagaaacgcttgattttattattgtcagtgcagggaaaatcggtatgcagctaaagttggcgccacaagatttagccagatcatgtgatgccgcatttgcagaaattgtatag

SEQ ID NO: 99187 - protein, 159 aa, Bacillus subtilis subsp. subtilis str. 168
MAKKMAKTNAVRLIEQQNISYEVLGYKTDGQPVDGISVAEKIGYSLKYVYKTLVAAAGTNHYYVFVVPVAEELDVKKAAKVTGEKKIEMIAMKELLAVTGYLRGGCSPIGMKKLFPTYIDASAETLDFIIVSAGKIGMQLKLAPQDLARSCDAAFAEIV

SEQ ID NO: 99188 - DNA, 480 bp, Yersinia pestis CO92
  CDS (1)..(480)
atgacacctgccgttgttctactggaaaaacaaaaggttccgtttacattgcatccctatcatcatgatgcagcagaaacgcattttggtgatgaggccgttaaaaagttagggcttaatgctgatcaggtttataaaacattgctggtcgcactcaataacgatgctaaaaatttggctgttgctgtcacgccggtagctacccaacttgatctgaaaaaggttgccagggcgctgggggcaaaaaaagctgagatggctgatccgcagttggcacagcgtacgacaggctatctaattggtggcatcagcccattagggcagaaaaaacgcctacccaccgtgattgacagccaagctcaagagttcgtcactatctttgtttctggcggtaagcgcggcttagatattgaattggccgcagtggatttatgccgcttattacagggtgtttttgcggatattgccaagcgggattga

SEQ ID NO: 99189 - protein, 159 aa, Yersinia pestis CO92
MTPAVVLLEKQKVPFTLHPYHHDAAETHFGDEAVKKLGLNADQVYKTLLVALNNDAKNLAVAVTPVATQLDLKKVARALGAKKAEMADPQLAQRTTGYLIGGISPLGQKKRLPTVIDSQAQEFVTIFVSGGKRGLDIELAAVDLCRLLQGVFADIAKRD

SEQ ID NO: 99190 - DNA, 477 bp, Caulobacter crescentus CB15
  CDS (1)..(477): transl_table=11
atgtccaagagcacccccgctacgatcgccctgaccaaggccggagtcgctttcgatctctatacgtacgattacgaccctggatcagaacgcgtcggcctgcaggccgccgaggccctgggcgaagacccgcgccgggtgctcaagaccctgatcgtgatgctggacggcaagcccgcctgcgcgatcctgccctccgaccaggaggtcagcatgaagaagctggccgccgccctgaaaggcaagtccgccgccatggcccccgtgcccgacgccgagcgcatcaccggctacaaggtcggcggcgtcagcccctttggccagaaaaaacgcctgcccacggtgctggaagccgccgccctggccgagccctatgtgttcctcaacggcggccagcggggtttgcaggtgaagctcgcgccggctgatgcggtgaaggcgctaggcgcggtgacggcggcgatcgtggcggagtag

SEQ ID NO: 99191 - protein, 158 aa, Caulobacter crescentus CB15
MSKSTPATIALTKAGVAFDLYTYDYDPGSERVGLQAAEALGEDPRRVLKTLIVMLDGKPACAILPSDQEVSMKKLAAALKGKSAAMAPVPDAERITGYKVGGVSPFGQKKRLPTVLEAAALAEPYVFLNGGQRGLQVKLAPADAVKALGAVTAAIVAE

SEQ ID NO: 99192 - DNA, 477 bp, Listeria monocytogenes EGD-e
  CDS (1)..(477): transl_table=11
ttgaataaaaagacaaatgcgtgtcggattttagataaacagaaggtaaactatgaattacgtgagtacgcgtggagcgaggattcccttgatgcgcttcacgttgcggaagaaacagggaataatcccgcacagatttttaaaaccttagtcctgactggtgacaaaacaggaaatatcgtcgcgtgcattcctgccgataagactttgcatttaaaacatttggcaaagattagcggtaataaaaaatgtgaattgattgcggtagattcgttagagaaactaactggctatattcgcggtggatgttcaccgattggaatgaagaaattatttccaacgtttattgataacagcgctgaatcgcttgataccatgctgatttcggctggaaaaagaggactacaaatcgaactagcgcctgctgatttgaaaaaggtagttcgtgcggagtttgcgatgattacggaagaataa

SEQ ID NO: 99193 - protein, 158 aa, Listeria monocytogenes EGD-e
MNKKTNACRILDKQKVNYELREYAWSEDSLDALHVAEETGNNPAQIFKTLVLTGDKTGNIVACIPADKTLHLKHLAKISGNKKCELIAVDSLEKLTGYIRGGCSPIGMKKLFPTFIDNSAESLDTMLISAGKRGLQIELAPADLKKVVRAEFAMITEE

SEQ ID NO: 99194 - DNA, 477 bp, Listeria innocua Clip11262
  CDS (1)..(477): transl_table=11
ttgaataaaaaaacaaatgcgtgtcgaattttggataaacagaagattagttaccaattacgtgagtatgaatggagtgaagacgcgcttgatgcacttcatgttgcagaagaaacggggaataatcctgcgcaaatttttaaaacgctcgttcttactggcgataaaacaggaaatatcgtcgcgtgcattccagctgataaaaccttgcatttaaaacacttagcgaagattagcaggaataaaaaatgtgaattaattccagttgatacgttggaaaagctaacaggttatattcgcggtggttgttctcctattggtatgaagaaactatttccaacttttattgataatagtgcagaacagctggatactatcttaatttcagccggaaaaagaggacttcaaatcgaactagccccttttgacttaaaaaaagtagtgcgtgcggagtttgcaatgattaccgaagattaa

SEQ ID NO: 99195 - protein, 158 aa, Listeria innocua Clip11262
MNKKTNACRILDKQKISYQLREYEWSEDALDALHVAEETGNNPAQIFKTLVLTGDKTGNIVACIPADKTLHLKHLAKISRNKKCELIPVDTLEKLTGYIRGGCSPIGMKKLFPTFIDNSAEQLDTILISAGKRGLQIELAPFDLKKVVRAEFAMITED

SEQ ID NO: 99196 - DNA, 471 bp, Nostoc sp. PCC 7120
  CDS (1)..(471): transl_table=11
atgaaaactaatgcggctcgactactggataaactaggcattacctatgaaattctcaactatgaggtagatcctgatgatttggcggctgaaagtacagcccaaaaagttggacttcctccagaacaagtttttaaaaccctagtagtcaggggtgaccaaacaggtatctgttttgctgtcttacctggaaatgctcatttagatttaaaagccttagctcggatttctggaaatcgcaaaattgaaacggttccactgaaggaagtgcagccgctaacaggttatattcgtggtggtgtcacagctttagctagcaaaaaaagctatcccacttatgttgacgagacagcaaccctgtttgagaaaataacggtttctggtgggatgcgaggaatgttaattctgcttaacccatctgattatttatctgcgctcaatggcgttgtgggggctattgcacaagattag

SEQ ID NO: 99197 - protein, 156 aa, Nostoc sp. PCC 7120
MKTNAARLLDKLGITYEILNYEVDPDDLAAESTAQKVGLPPEQVFKTLVVRGDQTGICFAVLPGNAHLDLKALARISGNRKIETVPLKEVQPLTGYIRGGVTALASKKSYPTYVDETATLFEKITVSGGMRGMLILLNPSDYLSALNGVVGAIAQD

SEQ ID NO: 99198 - DNA, 477 bp, Agrobacterium tumefaciens str. C58
  CDS (1)..(477): transl_table=11
atgtccaaaacgacccgcgccacccagatgctgacgaaggccggcattgccttcgccaccgtcacctatgattacgacccgaatgccgaccgcatcggcctgcaggcggccgaggcgatcggtgaggctccgcatcttgtgctgaagacgctgatggcggagctggacggcaagccggtttgcgttgtcgtcccctccgaccgcgaggtgagcatgaagaagcttgccgccgccttcggtggcaaatccgccaacatgatgaaacccgccgatgcggagcgggcgacgggttaccatgtcggcggcatcagccctttcggtcagaagaaacaggtgccgacagccattgaagccgatgccatggtgcatgattacgtctacatgaatggcgggcaacgtggtttgcaggtaaggctttcgccccgtgatgcccagaaagtgcttgatgccattgtcgcaccgctggtcgcggaatga

SEQ ID NO: 99199 - protein, 158 aa, Agrobacterium tumefaciens str. C58
MSKTTRATQMLTKAGIAFATVTYDYDPNADRIGLQAAEAIGEAPHLVLKTLMAELDGKPVCVVVPSDREVSMKKLAAAFGGKSANMMKPADAERATGYHVGGISPFGQKKQVPTAIEADAMVHDYVYMNGGQRGLQVRLSPRDAQKVLDAIVAPLVAE

SEQ ID NO: 99200 - DNA, 486 bp, Clostridium perfringens str. 13
  CDS (1)..(486): transl_table=11
atggcaaaagataagaagattaagacaaatgctatgagaatattagattctaaaaaagtttcatatgaaatgttaagctatgaaagtgaagatggaaagatagatggaatttctgtagctcataaaataggcgtagatgagaagaatgtatttaaaacactagtggctcaaggaacaagtaaagagttatatgtttttgttataccagtagcagaagaattagatttaaagaatgctgctaagatagcaggcgaaaagaaagttgaaatgatagcagttaaggatataatgaaatatactggatatattcgtggtggatgttcccctataggaatgaaaaagaattataaaacctttatacatgagagtgcagaagatttagattttataatatttagtgcaggaaagataggacatcaaataaaaatgaatccaaaagacttattaagtgttgtagaaggggaatttgcatttttaataaaatag

SEQ ID NO: 99201 - protein, 161 aa, Clostridium perfringens str. 13
MAKDKKIKTNAMRILDSKKVSYEMLSYESEDGKIDGISVAHKIGVDEKNVFKTLVAQGTSKELYVFVIPVAEELDLKNAAKIAGEKKVEMIAVKDIMKYTGYIRGGCSPIGMKKNYKTFIHESAEDLDFIIFSAGKIGHQIKMNPKDLLSVVEGEFAFLIK

SEQ ID NO: 99202 - DNA, 489 bp, Fusobacterium nucleatum subsp. nucleatum ATCC 25586
  CDS (1)..(489): transl_table=11
atgaaaaagacaaatgctattagagagttagaaatacataagattgaacatatagttagagaatatgaagttgatgaagaacatttagatgcagtcagtgtagcactaaaaactaataaagatattacaagagtttttaaaactttggttttattaaatgaaaaaagagagatggtggttgcctgtattccaggaatggaaaagcttgatttaaagaagttaggaaaactttcagggcataaaaaacttgaaatgttaccaatgaaagatttattttcaatgacaggatatgtcagaggggggtgttctcctattgggataaaaaaaagacattctatttttattcatgaatctgcattggataataaaacaattttagttagtggtggtttgagaggcttacaaattgagatagagccacaaaaattaattgattatttaaaaataacagttggggatatcattgaagatgtaaatatagaattttaa

SEQ ID NO: 99203 - protein, 162 aa, Fusobacterium nucleatum subsp. nucleatum ATCC 25586
MKKTNAIRELEIHKIEHIVREYEVDEEHLDAVSVALKTNKDITRVFKTLVLLNEKREMVVACIPGMEKLDLKKLGKLSGHKKLEMLPMKDLFSMTGYVRGGCSPIGIKKRHSIFIHESALDNKTILVSGGLRGLQIEIEPQKLIDYLKITVGDIIEDVNIEF

SEQ ID NO: 99204 - DNA, 462 bp, Thermoanaerobacter tengcongensis MB4
  CDS (1)..(462): transl_table=11
atgaaattgtcagtagaggcggttagagatttttttaggtcaagagggataaatttggaggtaaaaatttttgaagataccagcactgtagaaaaagcagcagaatctttaggtgttactcccggtgaaatagcaaagtctatgctttttaagttgaaagataaatacattatggtagtgacagccggtgacaaaaggatagataacaaaaaattcaaagaaacctttaaagctaaggcgaaaatggcttcgccagaagaggtgcttgaagtgacggggcatcctgttggaggagtttgtccatatgggctgaaaaatcctgttgaggtgtattatgatatttcattaaaagaatatgaaattgtgtatcctgctgcaggcgatgtaaatgcagctgtagaagtaaaagtagaagatttagataaaattgtagaaggagaatgggtagatgtatgtcagtga

SEQ ID NO: 99205 - protein, 153 aa, Thermoanaerobacter tengcongensis MB4
MKLSVEAVRDFFRSRGINLEVKIFEDTSTVEKAAESLGVTPGEIAKSMLFKLKDKYIMVVTAGDKRIDNKKFKETFKAKAKMASPEEVLEVTGHPVGGVCPYGLKNPVEVYYDISLKEYEIVYPAAGDVNAAVEVKVEDLDKIVEGEWVDVCQ

SEQ ID NO: 99206 - DNA, 510 bp, Streptomyces coelicolor A3(2)
  CDS (1)..(510)
atggcgaagaagccgagcaaggcgaagaagcagcagccgggcggcacacccgcgacggtggcgctcacggcggccggggtgacgtacacggtccacgcctacgagcacgacccggcccacccgtcctacggcgaggaggcggccgaggcgatgggcgtctcgccggagcgggtgttcaagacgctggtggccgacgtcgacggcgccctcacggtcgcggtggtgccggtggcgggccagctggacctcaaggcgctggcggccgcggtgggcggcaagcgcgcggcgatggccgacccggccctggccgagcgcaccacgggctatgtgcgcggcggcatctccccgctgggccagcgcaagcggctggcgacggtcctggacgcgtcggcctccgggcacgccacgatctgcgtctcggcgggccgccgcggcctggaggtcgagctgtcccccgacgacctggccaggctcacggacgcggttctggcgccgatcgggcgtgcctga

SEQ ID NO: 99207 - protein, 169 aa, Streptomyces coelicolor A3(2)
MAKKPSKAKKQQPGGTPATVALTAAGVTYTVHAYEHDPAHPSYGEEAAEAMGVSPERVFKTLVADVDGALTVAVVPVAGQLDLKALAAAVGGKRAAMADPALAERTTGYVRGGISPLGQRKRLATVLDASASGHATICVSAGRRGLEVELSPDDLARLTDAVLAPIGRA

SEQ ID NO: 99208 - DNA, 474 bp, Xanthomonas campestris pv. campestris str. ATCC 33913
  CDS (1)..(474): transl_table=11
atgagcaaggccacccgcgcaacccgtgcactggatgcggccggcgtggcctatgtgctgcatccttatcagtaccaggccgatgccgacgccaagggcctgcaagctgcgcaggcgctgcaactgccgccgcaccaggtgctcaagaccctgatgacctgggtggacgagcacgcgatctgcgtggtgatcccgtgcgaccgccgcttgtcgttgaagacccttgccagcgcctgcggcggcaagtccgcgcgcatgatggaggtggccgatgccgaacgccgcaccggctacaaggtgggcggcatcagcccgctcgggcagcagcggcccacgccggtgctgatcgaatccagcgtgctcgacgcacctgcgttgtggatcaacgccggccagcgtggcctgctgctggaactggccggcgccgagattgtgcatgtcctcggcgcgcgcgcttacccgctctgcgagtga

SEQ ID NO: 99209 - protein, 157 aa, Xanthomonas campestris pv. campestris str. ATCC 33913
MSKATRATRALDAAGVAYVLHPYQYQADADAKGLQAAQALQLPPHQVLKTLMTWVDEHAICVVIPCDRRLSLKTLASACGGKSARMMEVADAERRTGYKVGGISPLGQQRPTPVLIESSVLDAPALWINAGQRGLLLELAGAEIVHVLGARAYPLCE

SEQ ID NO: 99210 - DNA, 438 bp, Bifidobacterium longum NCC2705
  CDS (1)..(438): transl_table=11
gtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggcgtgaatccacaggacctgctcaaggtcttgaacgccgttgccgcaccaatcggcacgtggtga

SEQ ID NO: 99211 - protein, 145 aa, Bifidobacterium longum NCC2705
MEFHVYEYEHSNDHMDDGYGVEAATKLGFDEHQVFKTLMADTGAERVVGVVPVSGHMDLKALAAAVGAKKASMADPKVAMRESGYVVGGISPLGQKTRHKTVLDESALQFDQILVSGGKRGLSVGVNPQDLLKVLNAVAAPIGTW

SEQ ID NO: 99212 - DNA, 477 bp, Shewanella oneidensis MR-1
  CDS (1)..(477): transl_table=11
atgacacctgccgtacaaatggcaaagaaagccaaaattccctttgaagttttagaatacagtcacgacccacactgcgccgcttacggcgaagaagccgccaatgtgttagggctcgcccccgcgcaggtatttaaaaccttactggtcgcgaccgataaagcccatgcgccccttgcggtcgcgctagtccccgttgatcatcaactcaatttaaaagccgttgccaaatgtttaggccagaaaaaactgcagatggccgatgcagatttagcccaaaagtcttcaggctatttggttggaggtatcagcccattagcgcaaaaaaagctgctgccaacgatcattgatgaaagtgctaagcaatttgacaaaatctatgtcagcgcaggccgccgtgggcttgagatatgtctcacggcaaatgacttagcaaaattgtgccgcggctcatttgcggatattaaaacgctatga

SEQ ID NO: 99213 - protein, 158 aa, Shewanella oneidensis MR-1
MTPAVQMAKKAKIPFEVLEYSHDPHCAAYGEEAANVLGLAPAQVFKTLLVATDKAHAPLAVALVPVDHQLNLKAVAKCLGQKKLQMADADLAQKSSGYLVGGISPLAQKKLLPTIIDESAKQFDKIYVSAGRRGLEICLTANDLAKLCRGSFADIKTL

SEQ ID NO: 99214 - DNA, 498 bp, Corynebacterium efficiens YS-314
  CDS (1)..(498): transl_table=11
atggcaaggaaagtcgacaacagcgccgctacccccgcattgattaagctcactgcggaccagatcccgtatgagttggacatccatgggttcgacacgaaatcagataagggcttcggtctcgatgccgccgagaccatgggcgttgatccagcccgggtgttcaaaaccctcatggcggagatcgatggggaacatgtggtggccattgttccggtcagcaccacgctcaacctcaaggctctggcgaaggccggcgggggcaagcgggccgagatgatggaccgttcccgcgcccaggtggtcactggttatgtgcccggtggaatctcgccgatcgggcagaaacatccccaccgggtgttcctcgatgaatccgccatcctgcaggagactatctatatcagtgcgggccggcgcgggtggtcgctgatcatggctccggatgatgtgctgcgcgccgccggtgggcagtacgcggacatcgctgatcactga

SEQ ID NO: 99215 - protein, 165 aa, Corynebacterium efficiens YS-314
MARKVDNSAATPALIKLTADQIPYELDIHGFDTKSDKGFGLDAAETMGVDPARVFKTLMAEIDGEHVVAIVPVSTTLNLKALAKAGGGKRAEMMDRSRAQVVTGYVPGGISPIGQKHPHRVFLDESAILQETIYISAGRRGWSLIMAPDDVLRAAGGQYADIADH

SEQ ID NO: 99216 - DNA, 471 bp, Pseudomonas putida KT2440
  CDS (1)..(471): transl_table=11
atgacccccgccctagacctgttgaagaagcaccgtgccgagcatcgtgtgcacagttatgaacatgacccgaagtcggcgtcgtatggcctggaggcggcagaaaagctcgggctcgacccgcaacaggtgttcaagacgttgctggcaagcagcgagaaaggggaattgctggtagcggttgtgcctgtggtggggaccttggacctcaaggccctggcccatgctgccggggtaaaaaagtgcgagatggccgacccggcagcggcgcagcgggcgaccggttacctggtgggcggcatcagcccgctggggcagaagaagcgcctgcggacctttattgatgactcggcgcagaattttgcaactatccatgtcagcgccggcaggcgtggcctggaagtggagttggccgcagcggtgctggcggagtatacgcagggcacgtttgccgggattggtcgaggctga

SEQ ID NO: 99217 - protein, 156 aa, Pseudomonas putida KT2440
MTPALDLLKKHRAEHRVHSYEHDPKSASYGLEAAEKLGLDPQQVFKTLLASSEKGELLVAVVPVVGTLDLKALAHAAGVKKCEMADPAAAQRATGYLVGGISPLGQKKRLRTFIDDSAQNFATIHVSAGRRGLEVELAAAVLAEYTQGTFAGIGRG

SEQ ID NO: 99218 - DNA, 483 bp, Staphylococcus epidermidis ATCC 12228
  CDS (1)..(483): transl_table=11
atgtctaaaactaaaaaaacaaatgcaatgcggattttagatagagctaaaattaattatcaaatgaatacttacgaagttactgacaagcatcaacatggagaagagattgcacaactcgtaggtgctaaaatagaagaagtctttaaaacacttgtactagagaattccaatcatgaacactatgtttttgtcattccagttaatgaaaccttagatatgaagaaggcggctcatgttgttaatgaaaagaaattgaatttaatgcctctcgatcaattaaaacaagtaacagggtatgttagaggaggatgttcacctatcggtatgaaacattcctttaaaacgacgattgatgcttccgctaaaaatttagaaaaagtttatattagcggaggtcaaagaggaatgcaaattatcattcatgtgaatgatttaattgacatgacaaaggctcaggtagaatctattacacagaattaa

SEQ ID NO: 99219 - protein, 160 aa, Staphylococcus epidermidis ATCC 12228
MSKTKKTNAMRILDRAKINYQMNTYEVTDKHQHGEEIAQLVGAKIEEVFKTLVLENSNHEHYVFVIPVNETLDMKKAAHVVNEKKLNLMPLDQLKQVTGYVRGGCSPIGMKHSFKTTIDASAKNLEKVYISGGQRGMQIIIHVNDLIDMTKAQVESITQN

SEQ ID NO: 99220 - DNA, 474 bp, Bradyrhizobium japonicum USDA 110
  CDS (1)..(474)
atgtccaaagtcactcccgccacacgcgcgctcgcggccgccgatgtagccttcaccgtccacgcttacgactatgatcccgatgcggagagcatcgggctccaggcggcgtcggccctcggtgagaatccggcgcgcgtgttgaagacgctgatggcgctcgtcgacggcaagccggtctgcgtgatcgttccgtccgaccaggaggtctcgatgaagaagctcgccgccgccgtgagcggaaagtcggcgcagatgatgaagccgctggaggcggagcgcgtcactggcttcaaggtcggcggcatcagcccgttcgggcagcgcaagcccgtgcgcacggtgatcgagcagagcgcgctcgcgcatgactacgtctatctcaatggcggccagcgcggcttgcaggtgcggctcaagcccgccgacgtccgggatgtctcgaaggcggtcgccgcggatgtgctggcgtga

SEQ ID NO: 99221 - protein, 157 aa, Bradyrhizobium japonicum USDA 110
MSKVTPATRALAAADVAFTVHAYDYDPDAESIGLQAASALGENPARVLKTLMALVDGKPVCVIVPSDQEVSMKKLAAAVSGKSAQMMKPLEAERVTGFKVGGISPFGQRKPVRTVIEQSALAHDYVYLNGGQRGLQVRLKPADVRDVSKAVAADVLA

SEQ ID NO: 99222 - DNA, 504 bp, Lactobacillus plantarum WCFS1
  CDS (1)..(504): transl_table=11
atgtcaaaaaagaagaaaaaagatcaattaggtaaaacacttgttgaaaagattttggataaagcaaatatcagctatcaacaatatgaatttccaaccgaagcggaaggcgacgttcaacaattacaagtcgaccacctcggtgttgacgaacatcatatctacaagaccttagcgctgattggtaacaagactggtcccgtcgtcggtgtcttgccgttagatgagcacctcagctataaaaaattggctaagctatccggcaacaaaaaagttggcatgattccattaaaggacttggaacgaactaccggataccaacacggcgccaacacaccagttggtatttgggaaactaagaagtttcccatctacttagacgagaccgctaagcagcaaggtaagattctcgtatcttcgggtaaaatcgggcgttcaattgaaatcgacgctgatgatctacgcaagctcgtgcacggcacttttggtccaataacggagtag

SEQ ID NO: 99223 - protein, 167 aa, Lactobacillus plantarum WCFS1
MSKKKKKDQLGKTLVEKILDKANISYQQYEFPTEAEGDVQQLQVDHLGVDEHHIYKTLALIGNKTGPVVGVLPLDEHLSYKKLAKLSGNKKVGMIPLKDLERTTGYQHGANTPVGIWETKKFPIYLDETAKQQGKILVSSGKIGRSIEIDADDLRKLVHGTFGPITE

SEQ ID NO: 99224 - DNA, 513 bp, Vibrio parahaemolyticus RIMD 2210633
  CDS (1)..(513): transl_table=11
gtgaatggaccatcgcagaattgccttacagccttgatgatgaataatgccattcatactcctttgatgcagtttcttgccgaccaaaacatcacgtttcgtctgcttccgcatcaaagaccagccacaacaattgaggatgccgcgcaacaacgcggcattcgcccttctcaaatggtcaaagcgatattgctgcgagacatgggcaatcaatacgccctcgcctgcgcccctggtgatcgcagtgtggatccaaaaaaggtacgagctttactgcaatgtcgccgcatgacttgtgtcgaccaggccgatgtagaagccatcactggttataaaattggcactgtgacgccgttattactcaaacgacagatgccgattgtgtttgacccaagcttattggaagaacgtgaagtcaccatcagcagtggggaccgcatggcagggctggcgttatccatcgacgatttggttcagctatgccaacccaccgtggccgaaatctgtcgttaa

SEQ ID NO: 99225 - protein, 170 aa, Vibrio parahaemolyticus RIMD 2210633
MNGPSQNCLTALMMNNAIHTPLMQFLADQNITFRLLPHQRPATTIEDAAQQRGIRPSQMVKAILLRDMGNQYALACAPGDRSVDPKKVRALLQCRRMTCVDQADVEAITGYKIGTVTPLLLKRQMPIVFDPSLLEEREVTISSGDRMAGLALSIDDLVQLCQPTVAEICR

SEQ ID NO: 99226 - DNA, 480 bp, Salmonella enterica subsp. enterica serovar Typhi Ty2
  CDS (1)..(480): transl_table=11
atgacacccgcagttaagttactcgaaaagaacaagattccgtttaacattcacacctacgatcacgatccgaatgaaactaactttggcgatgaagtggtgcgtaagctcgggctaaacgccgatcaggtgtataaaacgcttttggttgccgtgaatggcgatatgaagcaactggccgtcgccgtgacgcctgtagccgggcagctggatttgaaaaaagtcgccaaagctctgggcgcgaaaaaggtcgatatggccgacccgatggtggcgcaacgcaccacgggatacctggtcggcgggatcagtccgctgggacagaagaaacggctgcctacgctgattgacgcgccagcccgcacgtttgccactatttatgtttccggtggtaaacgcgggctggatattgaactggcggctgacgatttggccgccatcctgagtgctaaattcgctgatatcgcgcgtcgggattaa

SEQ ID NO: 99227 - protein, 159 aa, Salmonella enterica subsp. enterica serovar Typhi Ty2
MTPAVKLLEKNKIPFNIHTYDHDPNETNFGDEVVRKLGLNADQVYKTLLVAVNGDMKQLAVAVTPVAGQLDLKKVAKALGAKKVDMADPMVAQRTTGYLVGGISPLGQKKRLPTLIDAPARTFATIYVSGGKRGLDIELAADDLAAILSAKFADIARRD

SEQ ID NO: 99228 - DNA, 480 bp, Bacteroides thetaiotaomicron VPI-5482
  CDS (1)..(480): transl_table=11
atgaaaatcaataaaacgaatgcggcgcgtctgctggataaagctaaaatagcttatgaactgattccttatgaagttgacgaaaacgatctgagtgccattcatgtagctgccagcttaggcgagaatatagaacaggtatttaagacactggttcttcacggtgacaaaagcggttattttgtttgcgtcattccgggtgagcacgaagtcgatctgaagctggcagcaaaggcttccggcaataaaaagtgtgatctgataccggtgaaagaacttcttccgctgacgggatatatccggggcggctgttcgcctattggcatgaagaaacattttcctacttatattcatgaaacctgccggcaatttccgtatatttatgtaagtgccggtgtacgggggctgcagataaagcttgcgccgggtgatttaatccgcgaatcgagggcagaaatttgccgtttatttgaggaataa

SEQ ID NO: 99229 - protein, 159 aa, Bacteroides thetaiotaomicron VPI-5482
MKINKTNAARLLDKAKIAYELIPYEVDENDLSAIHVAASLGENIEQVFKTLVLHGDKSGYFVCVIPGEHEVDLKLAAKASGNKKCDLIPVKELLPLTGYIRGGCSPIGMKKHFPTYIHETCRQFPYIYVSAGVRGLQIKLAPGDLIRESRAEICRLFEE

SEQ ID NO: 99230 - DNA, 501 bp, Streptomyces avermitilis MA-4680
  CDS (1)..(501)
atggcgaagaagtcgaagaagcagcagccgggcggcacgcccgcgacggtggccctgacggcggcgggcgtgccgtacacggtccacgcgtacgagcacgaccccgcgcacccctcgtacggcgaggaggcggccgaggcgatgggcgtctcgcccgaccgcgtcttcaagacgctggtggcggacgtggacggcgcgctggtcgtcgccgtggtcccggtcgcgggctcgctggacctgaaggcgctggcgacggcggtgggcggcaagcgcgcggcgatggcggatcccgtgctggcggagcgcacgacgggctatgtccgcggtggcatctcaccgctgggccagcgcaagaagctccgcacggtcctggacgcgtcggccgccgcccacgacacggtctgtgtctcggcgggccgccggggcctcgaagtggagctgtccccggacgacttggcgaagctcacggaagcggtccccgccccgatcgcccgtgcctga

SEQ ID NO: 99231 - protein, 166 aa, Streptomyces avermitilis MA-4680
MAKKSKKQQPGGTPATVALTAAGVPYTVHAYEHDPAHPSYGEEAAEAMGVSPDRVFKTLVADVDGALVVAVVPVAGSLDLKALATAVGGKRAAMADPVLAERTTGYVRGGISPLGQRKKLRTVLDASAAAHDTVCVSAGRRGLEVELSPDDLAKLTEAVPAPIARA

SEQ ID NO: 99232 - DNA, 489 bp, Bordetella pertussis Tohama I
  CDS (1)..(489): transl_table=11
atgagcaagaaccgccacgtttccgaaacgcccgccacccagctgctgcgccagcgcaaggtggcgttcaccgaacatacctacgattacgtcgaccatggcggcgccggcgaggcggcgcgccagctgggcctggatccgcacgccgtggtcaagacgctcatcatggaagacgagggcggccatccgctggtggtgctgatgcacggcgatcgcgaggtgtccaccaagaacctggagcgccaggccggcctgaaaaaggtcgcgccatgccagcccgaggtggcgcagcgccactccggctaccaggtcggcggcacctcgcccttcggcacgcgcaagcgcatgccggtgtgggtcgaggccagcgtgctggattttccgcagatctacgtcaatggcgggcgccgcggctacctggtcggcatcgcgccgcaggcgctggtcgacctgctgggcgcgcgcgccgtgcaggtggccttgccgtaa

SEQ ID NO: 99233 - protein, 162 aa, Bordetella pertussis Tohama I
MSKNRHVSETPATQLLRQRKVAFTEHTYDYVDHGGAGEAARQLGLDPHAVVKTLIMEDEGGHPLVVLMHGDREVSTKNLERQAGLKKVAPCQPEVAQRHSGYQVGGTSPFGTRKRMPVWVEASVLDFPQIYVNGGRRGYLVGIAPQALVDLLGARAVQVALP

SEQ ID NO: 99234 - DNA, 489 bp, Bordetella bronchiseptica RB50
  CDS (1)..(489)
atgagcaagaaccgccacgtttccgaaacgcctgccacccagctgctgcgccagcgcaaggtggcgttcaccgaacatacctacgattacgtcgaccatggcggcgccggcgaggcggcgcgccagctgggcctggatccgcacgccgtggtcaagacgctcatcatggaagacgagggcggccatccgctggtggtgctgatgcacggcgatcgcgaggtgtccaccaagaacctggcgcgccaggccggcctgaaaaaggtcgcgccatgccagcccgaggtggcgcagcgccactccggctaccaggtcggcggcacctcgcccttcggcacgcgcaagcgcatgccggtgtgggtcgaggccagcgtgctggattttccgcagatctacgtcaatggcgggcgccgcggctacctggtcggcatcgcgccgcaggcgctggtcgacctgctgggcgcgcgcgccgtgcaggtggccttgccgtaa

SEQ ID NO: 99235 - protein, 162 aa, Bordetella bronchiseptica RB50
MSKNRHVSETPATQLLRQRKVAFTEHTYDYVDHGGAGEAARQLGLDPHAVVKTLIMEDEGGHPLVVLMHGDREVSTKNLARQAGLKKVAPCQPEVAQRHSGYQVGGTSPFGTRKRMPVWVEASVLDFPQIYVNGGRRGYLVGIAPQALVDLLGARAVQVALP

SEQ ID NO: 99236 - DNA, 480 bp, Chromobacterium violaceum ATCC 12472
  CDS (1)..(480): transl_table=11
atgtccagcaaggctcccgtcacccaggccatccgcgtgctgcgcgagcacaaggtcgattacaccgaacacctgtacaagtacgaggaaaagggcggcaccacggtgtcggcgcgggagctgggcgtcgacgagcacgcggtggtgaaaacgctgatcatggaggacgagaacaagcgtccgctgatcgtgctgatgcacggcgaccgcgaggtcggcaccggcatgctggccaagcagatcggcgccaagaaagtccacccctgcgaccccaagaccgcggacaagcacagcggctatcaggtgggcggcaccagtcccttcggcacccgccacgcgatgccggtgtacatggaggccagcatcgcggaattgccggtcatctacatcaatggcggcaagcgcggcttcctggtcggcgtgagcccgcgggacgtgatccgggtgttgagcccgacgctggtcagcgcggcggcgtag

SEQ ID NO: 99237 - protein, 159 aa, Chromobacterium violaceum ATCC 12472
MSSKAPVTQAIRVLREHKVDYTEHLYKYEEKGGTTVSARELGVDEHAVVKTLIMEDENKRPLIVLMHGDREVGTGMLAKQIGAKKVHPCDPKTADKHSGYQVGGTSPFGTRHAMPVYMEASIAELPVIYINGGKRGFLVGVSPRDVIRVLSPTLVSAAA

SEQ ID NO: 99238 - DNA, 510 bp, Porphyromonas gingivalis W83
  CDS (1)..(510): transl_table=11
atgcccaagaccaatgtggcgcgccttctggatgcggcgcatataacgtacgaactgatcccctacgagccggacgagagagacctctcggccgtccatgtggcagagcagctgggcgaggatgtcaggcaggtgttcaagacgctggtattgcgaggcaataagaccggactgctcgtctgcatcgtaccgggcaatgaggaggtagacctcaagctggcggcacgagcatcggacaacaaaagcgtggaaatgatcagacagagcgagcttcttccgctcacggggtatatccgtggcggctgttcgcccatcgggatgaaaaaggcttatccatcctatatccatcatacttgcatggtattcccttatatatatgtcagcgcgggtgtgcgaggcttacagcttcggatagcaccggccgatctcttggcatacacgggagccgagccggcttgcctctgtggtgctacgacagaagaaaaatcaatcataaatcaaaccctataa

SEQ ID NO: 99239 - protein, 169 aa, Porphyromonas gingivalis W83
MPKTNVARLLDAAHITYELIPYEPDERDLSAVHVAEQLGEDVRQVFKTLVLRGNKTGLLVCIVPGNEEVDLKLAARASDNKSVEMIRQSELLPLTGYIRGGCSPIGMKKAYPSYIHHTCMVFPYIYVSAGVRGLQLRIAPADLLAYTGAEPACLCGATTEEKSIINQTL

SEQ ID NO: 99240 - DNA, 468 bp, Wolinella succinogenes DSM 1740
  CDS (1)..(468): transl_table=11
atgagccaaaagactaacgccgcgcgaatcctcgataaaaagggaatcgcttacgagattatcgattatgaagtggacgaagaggatttgagcgccgtgcatgtagcgcagacgctagggatggatgaggaggagatatacaagacgcttgtctgcgtgagtgagacgggcgaatatctcgtgatctgcctccctgcccctgccacgcttgatctcaaagcgctcgctaggaatgcacaatgcaagcgatgcgagctcattccgaccaaagagctgctcaaagtgacgggctatatccgtgggggatgctctccactagggatgaaaaagcactatcgcacctttatcgattctcgcgctagggagcgggagtgcgtatgtgtgagcgctgggatgcgaggcaaacagatacgcctagcgccagagaaacttaaagaggcatgcgaagcagagtgggtggatctctag

SEQ ID NO: 99241 - protein, 155 aa, Wolinella succinogenes DSM 1740
MSQKTNAARILDKKGIAYEIIDYEVDEEDLSAVHVAQTLGMDEEEIYKTLVCVSETGEYLVICLPAPATLDLKALARNAQCKRCELIPTKELLKVTGYIRGGCSPLGMKKHYRTFIDSRARERECVCVSAGMRGKQIRLAPEKLKEACEAEWVDL

SEQ ID NO: 99242 - DNA, 477 bp, Photorhabdus luminescens subsp. laumondii TTO1
  CDS (1)..(477): transl_table=11
atgacacctgcgatcattttgttagaaaaacagaaagttagcttcgctcttcatgcctatgagcacgacacaaatgaacataattttggtgatgaagcagtgaggaaattaagactccatgccaggcaagtattcaagaccttactggttgcacttaatggtgaggctaaaaatttggtggtagccgtcacccccgtttcaagtgagctggacttaaaaaaggtcgccaaagtttttaaagtcaaaaaagcagaaatggctgatccccaaatcgcccagaaagtaacagggtatctcgtcggcgggatcagtccgctaggacagaaaaaacacttgccaacggttattgataaccaagcgcaacagttctcaactatatttgtctctggtggtaaacgagggttagatattgaattggcgtcggctgatctctgtaggttggtgaaaggcaactttgctgatattgcaaaaacttaa

SEQ ID NO: 99243 - protein, 158 aa, Photorhabdus luminescens subsp. laumondii TTO1
MTPAIILLEKQKVSFALHAYEHDTNEHNFGDEAVRKLRLHARQVFKTLLVALNGEAKNLVVAVTPVSSELDLKKVAKVFKVKKAEMADPQIAQKVTGYLVGGISPLGQKKHLPTVIDNQAQQFSTIFVSGGKRGLDIELASADLCRLVKGNFADIAKT

SEQ ID NO: 99244 - DNA, 504 bp, Corynebacterium diphtheriae NCTC 13129
  CDS (1)..(504): transl_table=11
atgagcaagaaaaagccgtccggtgctacacctgcactcgctgtgttggaagctgcgggtatcgagcattcggtgtctacttttgaaggtggcacagaccattttggtgacgcggcagctgcggcactcgacgtagattcggataggatttttaaaacactggtcatcgatttaactgcgggtaaaggacccaagcgtcaacttgcggtggcttgtattccggtgacctcaaagttgagcctaaaaaaggcggcggctgcgttgagcgcgtcaaaagccacgatggcggaccaacacgatgcggctaagtcgtcaggttatattcctggcggtatttctcctataggtcagaaacacccgctgcccactgtggtagatgagacagccattttgtttgacacgatttttgtttccggcggcaaacgtggtcttgatgtggaactcagtggcgaagatcttattcgcgtcgttgacggaagtttcgcggatttacaggctgaatag

SEQ ID NO: 99245 - protein, 167 aa, Corynebacterium diphtheriae NCTC 13129
MSKKKPSGATPALAVLEAAGIEHSVSTFEGGTDHFGDAAAAALDVDSDRIFKTLVIDLTAGKGPKRQLAVACIPVTSKLSLKKAAAALSASKATMADQHDAAKSSGYIPGGISPIGQKHPLPTVVDETAILFDTIFVSGGKRGLDVELSGEDLIRVVDGSFADLQAE

SEQ ID NO: 99246 - DNA, 660 bp, Rhodopseudomonas palustris CGA009
  CDS (1)..(660): transl_table=11
gtgctggccggacagccgtgccccatggccgcaagagtccgggttcgctcgctggcgcgagtgccccggaatgacggtgcgggggacatgatggcgttgcattgcgtcggcttgcgcgcagtgacaatgtgcgcgccggcgcatgctggtgcgccgtcctgctacctaccccgagtccccgccatgtcgaaatccacccgcgccacccagatgctggaaaagctcggcgtcgcgttcaagctgcacagctacgactacgatccgaacgcggaggcgatcgggctggcggccgctgccgcggtcggggtcgagccgaagcggatgctgaagacgctaatggccgagctcgacggcaagccggtttgcgcggtgatcgcctccgacaaggaggtcagcatgaagaagctggcggccgcgctcggcggcaagagtgccaggatgatgaagccggccgatgccgagcggctgaccggctatcacgtcggcggcatctcgccgttcgggcagaagaagcgcgtgccggtggcgatcgacgacgccgcgctcgccgaaaccacggtgtatctcaacggcggccagcgcggcctgcagatcgaactcgatccgagcgccgcagtcaccgcgctcggtgccgtggcgcgcccgatcgcggccgactga

SEQ ID NO: 99247 - protein, 219 aa, Rhodopseudomonas palustris CGA009
MLAGQPCPMAARVRVRSLARVPRNDGAGDMMALHCVGLRAVTMCAPAHAGAPSCYLPRVPAMSKSTRATQMLEKLGVAFKLHSYDYDPNAEAIGLAAAAAVGVEPKRMLKTLMAELDGKPVCAVIASDKEVSMKKLAAALGGKSARMMKPADAERLTGYHVGGISPFGQKKRVPVAIDDAALAETTVYLNGGQRGLQIELDPSAAVTALGAVARPIAAD

SEQ ID NO: 99248 - DNA, 504 bp, Lactobacillus johnsonii NCC 533
  CDS (1)..(504): transl_table=11
atgtcgaaaaaaaataaaaagaaaaaacttaataaaactttgattgagaagatgctcgaccaacaaaagattccatataaacaattacaattcgccacagttcaaaaaggcgatgttaaacaaatggatacttccattttagacgatgaagaggctttggtctacaaaaccttggtatgtgagggaaataaaaatagtcctgtagttggagttgttcctgttaccgagcacttaagtatgaaaaaacttgctaaagcttctggtaacaaaaaatgtgaattacttccacttaagaagttagtcgcaactactggttatgttcatggggccaacactccaattggaatttaccaaaagcatcattttcctatttatttagatagcagcatgaaagaacacgatcacattgctgtttcaagtggagaagtcggtagaagtatcatgatcaatcctgatgatttacaaaaagtcactaatgccactttcgttgatttattagagtaa

SEQ ID NO: 99249 - protein, 167 aa, Lactobacillus johnsonii NCC 533
MSKKNKKKKLNKTLIEKMLDQQKIPYKQLQFATVQKGDVKQMDTSILDDEEALVYKTLVCEGNKNSPVVGVVPVTEHLSMKKLAKASGNKKCELLPLKKLVATTGYVHGANTPIGIYQKHHFPIYLDSSMKEHDHIAVSSGEVGRSIMINPDDLQKVTNATFVDLLE

SEQ ID NO: 99250 - DNA, 495 bp, Bdellovibrio bacteriovorus HD100
  CDS (1)..(495): transl_table=11
atgagcgacaaagataaattccccgtgactctggctattcgtgaactgcaaaaacatcaggtgcagtacaccggacatctttttccttatgaagaaaaaggtggaactgctcattcctcaaaagagcttggcgtgcccgagcatcatgttatcaaaactctgatcatggaaaatgaaaagaaggaacccctggtcgttctgatgcacggggatctgcaggtctctaccaaacaactggcgcgcgagctgggcgtaaagacgatttcaccctgcaaacctgaagtggcggaccgtcattcgggttatcaggtgggaggcacttcgcccttcggaaccaagcgcgagatgcctgtgtatatggaaaaaaccattttggatctggatattatttacatcaacggtggcaagcgaggatttctggtttccttgaaaccgcaggatgtccaaaggattctgcggcccacgattgtccaggtgggtgttaaagcttcttga

SEQ ID NO: 99251 - protein, 164 aa, Bdellovibrio bacteriovorus HD100
MSDKDKFPVTLAIRELQKHQVQYTGHLFPYEEKGGTAHSSKELGVPEHHVIKTLIMENEKKEPLVVLMHGDLQVSTKQLARELGVKTISPCKPEVADRHSGYQVGGTSPFGTKREMPVYMEKTILDLDIIYINGGKRGFLVSLKPQDVQRILRPTIVQVGVKAS

SEQ ID NO: 99252 - DNA, 477 bp, Bacillus thuringiensis serovar konkukian str. 97-27
  CDS (1)..(477): transl_table=11
atgaaaaaagataaaacaaatgcgatgcgaatattagataaagaaaaaattgaatattcgatgatgacatatgatccagacgatggaaaaattgatggtgtatcagtagccgagaaaattggacgagaagtgagagaagtatataaaacgttaatcgctcaaggaaatagtaaaaattatcatgtgtttattattccggtggatgaggaactaaatttaaaagctgccgcaaaagcagtaagtgaaaagaaaattgaaatgattcctgtaaaagatattacgaaagtgtcaggatatattcgcggtggttgttcaccggtcggaatgaaaaagttattttctacatgtatcgatgcgagtgctcaatcacttgaaacgattattgtaagcggcgggaaaataggtatacaaattgagctgaaagtggatgatttggcaaaagtgacgagagcgcagtttggtgaaataacgaaatga

SEQ ID NO: 99253 - protein, 158 aa, Bacillus thuringiensis serovar konkukian str. 97-27
MKKDKTNAMRILDKEKIEYSMMTYDPDDGKIDGVSVAEKIGREVREVYKTLIAQGNSKNYHVFIIPVDEELNLKAAAKAVSEKKIEMIPVKDITKVSGYIRGGCSPVGMKKLFSTCIDASAQSLETIIVSGGKIGIQIELKVDDLAKVTRAQFGEITK

SEQ ID NO: 99254 - DNA, 468 bp, Acinetobacter sp. ADP1
  CDS (1)..(468): transl_table=11
atgacaccagcttgcaaattacttaaaaccaataagattgaatacagtattcatgaatatgaacatgatccaaatgcaaaaagttttggtcttgaagctgccgaaaagttgaatcttgatgtagaagaagtctttaaaactttgctggtaaccgatgataaaaatcactatgttgcaattttacctgtcaatcatcagcttaatctaaaaaaagtggcgggagcattcggttgtaaaaagctgcatatggctgatccaaaggatgcagaacgacttactggctatctggtgggaggaattagtccacttggtcagaaaaagcgtcttaaaaccgtcattgatgcttcggctgaaagcaaacataaaatatatgtcagtggtggaaaacgtggactcgatattggcgtagcaccacaagcgattgcaaaaatattaggtgcgcagttcgttgatattcttgatcagtga

SEQ ID NO: 99255 - protein, 155 aa, Acinetobacter sp. ADP1
MTPACKLLKTNKIEYSIHEYEHDPNAKSFGLEAAEKLNLDVEEVFKTLLVTDDKNHYVAILPVNHQLNLKKVAGAFGCKKLHMADPKDAERLTGYLVGGISPLGQKKRLKTVIDASAESKHKIYVSGGKRGLDIGVAPQAIAKILGAQFVDILDQ

SEQ ID NO: 99256 - DNA, 480 bp, Erwinia carotovora subsp. atroseptica SCRI1043
  CDS (1)..(480)
atgacacccgcagtcaatttactcgaaaagaataagatcgcctttacgctacacagttaccaccacgacagcgacgaaaccaactttggcgaggaagcggccagaaaactggggctgaataaagaacaggtttataaaacgctgcttgtttctctgaatggtgatgcaaaaaatctcgcagttgccatcacgccggtcgctggaatgttggatctcaagaaagtcgcacgtgcgctgtccgccaaaaaagccgatatggccgatccggtcatcgctcagcgtgtaacgggttatctggtgggagggattagcccacttgggcagaagaaactgctgccgaccgtgattgatgaaccagcgcgccagttcgataccattttcatttccggcggtaaacgtggattggatatcgaattatcggcagatgatctggcgcggctactgcgcgccacctttgctgatatcgccaagcatgattaa

SEQ ID NO: 99257 - protein, 159 aa, Erwinia carotovora subsp. atroseptica SCRI1043
MTPAVNLLEKNKIAFTLHSYHHDSDETNFGEEAARKLGLNKEQVYKTLLVSLNGDAKNLAVAITPVAGMLDLKKVARALSAKKADMADPVIAQRVTGYLVGGISPLGQKKLLPTVIDEPARQFDTIFISGGKRGLDIELSADDLARLLRATFADIAKHD

SEQ ID NO: 99258 - DNA, 489 bp, Propionibacterium acnes KPA171202
  CDS (1)..(489): transl_table=11
atgcctgcgtctgactctgcatctgcggcaaccaaagcccttgccaaggccaagatcccgcatgtcctgcacagctacgaccacgatccgtccaaccatcatttcggcgatgaaggggccgcgaagcttgggttcgacccatccatcatgctcaaaaccctggtcgtcgagttggtcccctcgggcaagcttgccgtcgccgtcgttccggtgagccgccagcttgatcttaaggcttttgcctcagccgtaggtgcgaaaaaagtcgctatggctgacccagcggcagcagagcgcgccacggggtacatcgtcgggggaatttctcccttggggcagaaaaagcggctacccatctgcatcgacgagtcggtgctagggcagccgcgggtgctggtttcaggcgggcgtcgaggtctgtcggtggaattgtcaccatcggacctggtgactgtcaccggagcggtgacggcaaaaatctcctgctaa

SEQ ID NO: 99259 - protein, 162 aa, Propionibacterium acnes KPA171202
MPASDSASAATKALAKAKIPHVLHSYDHDPSNHHFGDEGAAKLGFDPSIMLKTLVVELVPSGKLAVAVVPVSRQLDLKAFASAVGAKKVAMADPAAAERATGYIVGGISPLGQKKRLPICIDESVLGQPRVLVSGGRRGLSVELSPSDLVTVTGAVTAKISC

SEQ ID NO: 99260 - DNA, 513 bp, Desulfotalea psychrophila LSv54
  CDS (1)..(513): transl_table=11
ttgagttctctttgctttttttttgtacagaggataattatgactccaggtgtgaaacaggtaaaaaaagcggggatgagctataaactccatgagtataagcatgatgtgcgagcagaatcctacgggcttgaggcagcagaaaaacttggggttgctgtggagagggtttttaagactctggtggtggaggatggggatggcaatatggccgttgccattattcctgtctcttgttcccttaacttgaaaaaaatggccatggctctgggtgttaaaaaaataaatatggccgacaaggttcgggtacaaaagacaacgggttatgttctgggtggggtaagtcctttgggacaaaaaaagcgtctgccaaccgtactggagagttcagcccgggagattgccaccatctatgtcagtgccggtaagcgtggccttgatattgagcttgccccggatgtacttgtaactctgcttggggcagcctttgcagacctctcgtctagctcttag

SEQ ID NO: 99261 - protein, 170 aa, Desulfotalea psychrophila LSv54
MSSLCFFFVQRIIMTPGVKQVKKAGMSYKLHEYKHDVRAESYGLEAAEKLGVAVERVFKTLVVEDGDGNMAVAIIPVSCSLNLKKMAMALGVKKINMADKVRVQKTTGYVLGGVSPLGQKKRLPTVLESSAREIATIYVSAGKRGLDIELAPDVLVTLLGAAFADLSSSS

SEQ ID NO: 99262 - DNA, 468 bp, Symbiobacterium thermophilum IAM 14863
  CDS (1)..(468): transl_table=11
gtgaagaccatcgccgcccgcatgctcgaccagatgaagatcccctacgagatccggacgtatgagtggagcgaggaggagatggacgccgtctcggttgcccgcaagatcggcctgccgcccgagcaggtcttcaagaccctggtcgtccggggcgaccggaccggcgtgttggtggcgtcgatccccggtaacgccgaactggacctgaagcggctggccgccgtcagcggcaacaagaaggtcgagatggtgcatgtgcgggaactccaggggctcaccgggtacatccggggcggcgtgtcgcccctggggatgaaaaagccgtatccctactacctcgacgagacggcccagatcatcgaacagctggccgtgagcgcggggcagcgggggctgcagctgatcctgagcgggccggacctgatccgcgcgaccggagcgaagctggcggacatcgcccggtag

SEQ ID NO: 99263 - protein, 155 aa, Symbiobacterium thermophilum IAM 14863
MKTIAARMLDQMKIPYEIRTYEWSEEEMDAVSVARKIGLPPEQVFKTLVVRGDRTGVLVASIPGNAELDLKRLAAVSGNKKVEMVHVRELQGLTGYIRGGVSPLGMKKPYPYYLDETAQIIEQLAVSAGQRGLQLILSGPDLIRATGAKLADIAR

SEQ ID NO: 99264 - DNA, 480 bp, Bacteroides fragilis YCH46
  CDS (1)..(480): transl_table=11
atgaaaatcaataagaccaatgccgcccgtctactggataaggccaagattgcctatgaacttattccttacgaggtagacgaaagcgatctgagtgccgtgcatgtagcggcaagtttgggagagaatattaatcaggtttttaaaaccctcgtacttcacggtgataaaacgggatattttgtttgtgtaattccaggagatcaggaagtgaacctgaagcttgctgctaaagtgtccggcaataaaagttgcgatatgatccctatgaaagagcttctgtccgtcaccggatatatccggggtgcctgttcgcccatcggaatgaaaaagcattttcctacctatattcatgaaacctgtctgggctttccgtatatttatgtaagtgcagggcagagaggattgcagataaaaatagaccctaaagagctaataaacgaggttcgggcggaagtttgtgtattatatactgtttaa

SEQ ID NO: 99265 - protein, 159 aa, Bacteroides fragilis YCH46
MKINKTNAARLLDKAKIAYELIPYEVDESDLSAVHVAASLGENINQVFKTLVLHGDKTGYFVCVIPGDQEVNLKLAAKVSGNKSCDMIPMKELLSVTGYIRGACSPIGMKKHFPTYIHETCLGFPYIYVSAGQRGLQIKIDPKELINEVRAEVCVLYTV

SEQ ID NO: 99266 - DNA, 492 bp, Nocardia farcinica IFM 10152
  CDS (1)..(492): transl_table=11
atggcaggcgcgtcgactcccgcgatccgcacgctgaccaaggccggtgtggcccatcgcgtgcactcctacaagcacgatccgcgcgcggagtccttcggcaccgaggcggtggacgcgctggccgccgacctcggcgtcgagcccgcgcagatcttcaagaccctggtcctcgaactgtccaccggaacgctcgcggtggccgtgctcccggtgccgcagaccctctcgctcaaggccgcggccgccgcgttgggggcaccgaaggcgagcatggccgaccgggccaaggccgagcgcggcaccggctacgtgctgggcggcatctccccgctcggccagcgcaaggccctgccgaccgtgatcgacgagtccgcgctgcggtgggaccgggtgctgtgcagcgcgggcaggcgcggcctggagatcgaactggcacccgccgagctggtgcgtctcaccgaggcggtgaccgcgccggtcaccgcctga

SEQ ID NO: 99267 - protein, 163 aa, Nocardia farcinica IFM 10152
MAGASTPAIRTLTKAGVAHRVHSYKHDPRAESFGTEAVDALAADLGVEPAQIFKTLVLELSTGTLAVAVLPVPQTLSLKAAAAALGAPKASMADRAKAERGTGYVLGGISPLGQRKALPTVIDESALRWDRVLCSAGRRGLEIELAPAELVRLTEAVTAPVTA

SEQ ID NO: 99268 - DNA, 507 bp, Photobacterium profundum SS9
  CDS (1)..(507): transl_table=11
ttgtcatttaccataagggagtcagcgataatgacaccagcaataaagctagctaaaaagaaaggggttcactttaatgttcatcaatatgagcatgatcctgccaatactaactttggtttagaagctgctgaagtgctaggtcaaaatccgaatcttgtcttcaaaacattactcttttcgcttaatggcgatccaaaaaagttggcggtagccattgttcctgtgtctggcatgttggatttaaaagcagcagcaaaagcagcgggtggaaagaaagctgaaatggctgatccgcagattgcagagaaaacaacaggctatatcgttggtggaattagtccattagggcaaaagaagcgattacctacttttttagattcatcagcccagcggttagaaaccatttgtgtgagcgcggggcgtcgcggcttagaaattgaactcgcacctaacgatttattgtcgctaacgtctggtcagtttgctttgattgcaaaagagtag

SEQ ID NO: 99269 - protein, 168 aa, Photobacterium profundum SS9
MSFTIRESAIMTPAIKLAKKKGVHFNVHQYEHDPANTNFGLEAAEVLGQNPNLVFKTLLFSLNGDPKKLAVAIVPVSGMLDLKAAAKAAGGKKAEMADPQIAEKTTGYIVGGISPLGQKKRLPTFLDSSAQRLETICVSAGRRGLEIELAPNDLLSLTSGQFALIAKE

SEQ ID NO: 99270 - DNA, 462 bp, Photobacterium profundum SS9
  CDS (1)..(462): transl_table=11
atgcaaacctctgttatacattttctggataatgagggggtcgattaccgtctactcccgcattcaaaacctgcaaaaacaatagaagaagcagccaaagagcgaggcgtagcaccagaacaaatggtgaaatcgatcttgctacgcgatatgagtggctttcatgttttagcgtgtgttcctgggcctgcacaagtcgatcccaccaaggtacgcgctatatttgggtgccgtcgtatgacctgcgcagacgcagccgatgtcgaaaagatcaccggattagtcattggtacggttgcccctgtcggattgaaacaaccactaccgttgatctttgatcattcaatcaaagctcatgaaagagtcaacattagcagtggtgatcgaatggctggtatcgaattagaaaccgatgatcttttactgctttgcgatcctatgtttgccgacatttgtcgctaa

SEQ ID NO: 99271 - protein, 153 aa, Photobacterium profundum SS9
MQTSVIHFLDNEGVDYRLLPHSKPAKTIEEAAKERGVAPEQMVKSILLRDMSGFHVLACVPGPAQVDPTKVRAIFGCRRMTCADAADVEKITGLVIGTVAPVGLKQPLPLIFDHSIKAHERVNISSGDRMAGIELETDDLLLLCDPMFADICR

SEQ ID NO: 99272 - DNA, 474 bp, Streptococcus thermophilus LMG 18311
  CDS (1)..(474): transl_table=11
atggctaaaaaaagcaaagtcaagaaaactttggtcgaccaaattcttgataaggctaaaatagaccatgatagcttatccttcaacggtttagaaggagagcttccagaggatgtggcgcgtgagagcatctataaaaccctggcccttaaaggggataagacaggaccagtcattggtattatccctatcactgagcatctatccgaaaagaaattagctaaaatttcaggcaacaagaaagttcaaatgattccacaaaaggatctccaaaaaacaactggctatgtacacggggctaacaatcctgtgggaattcgtcaaaaacacaattttcccatttatatcgatcagtctgcccaggaagcaggttttcttattgtctcagctggagagattgggcgttctatccgcatcaacagtcaagaacttgctgatttcgttaatgccgagtttgctgatattaaggagtaa

SEQ ID NO: 99273 - protein, 157 aa, Streptococcus thermophilus LMG 18311
MAKKSKVKKTLVDQILDKAKIDHDSLSFNGLEGELPEDVARESIYKTLALKGDKTGPVIGIIPITEHLSEKKLAKISGNKKVQMIPQKDLQKTTGYVHGANNPVGIRQKHNFPIYIDQSAQEAGFLIVSAGEIGRSIRINSQELADFVNAEFADIKE

SEQ ID NO: 99274 - DNA, 465 bp, Idiomarina loihiensis L2TR
  CDS (1)..(465): transl_table=11
atgactcctgcaattgatgtagcgaaagagaatgaaatttcttttaaagtacacgaatattctcatgacccggccagtgaatcttatgggggcgaagccgccgagaagttgggcgttccgcaggaacaagtattcaaaaccttagttgtcagtcttgacggtaaagaattggctgtaggtatcattccggttttgtcacggctaagccttaaattgatagcaaaagctctgggtgccaagaaggctgccatggcaaccggaagcgatgtcgaacgtactacgggttatgttctgggaggcgttagtccgcttggccagaaaaagcagctcagaaccataattgatacctctgcaacttataaccccactgtatttataagcgccgggcgtaggggggtagatatggaattaacccctgaagatttaaaaacgctggtgaggggggaatttgttaatattacttaa

SEQ ID NO: 99275 - protein, 154 aa, Idiomarina loihiensis L2TR
MTPAIDVAKENEISFKVHEYSHDPASESYGGEAAEKLGVPQEQVFKTLVVSLDGKELAVGIIPVLSRLSLKLIAKALGAKKAAMATGSDVERTTGYVLGGVSPLGQKKQLRTIIDTSATYNPTVFISAGRRGVDMELTPEDLKTLVRGEFVNIT

SEQ ID NO: 99276 - DNA, 489 bp, Azoarcus sp. EbN1
  CDS (1)..(489): transl_table=11
gtgagcagaaccgaacatcacgcgccggaaacgccggccacccgtttcctgaagcagcatcgcgtggcctataccacgcattcctacgcctacgaacctcatggcggaacaaaagtgtccgcccgggaactggacgtcgacgaacatgcgatcgtcaagacgctggtaatggaagatgaaagcggcgcgccgttgatcgtattgatgcacggcgaccgaaaagtatcgacgaaggaacttgcacggcaagccggccggaaacgcatcgagccctgcactccggaagtcgcaaatcgccattcaggttatctcgtcggcggcacttctcctttcggcacgcgaaaacgcctgccggtattcatggaaaactcgatcgtcgatcttccactcgtctatatcaacggtggccggcgaggattcctgctcgggatatctccccgggaaattctgcgagtattgcaaccccggcttgtcagcgccggaatctag

SEQ ID NO: 99277 - protein, 162 aa, Azoarcus sp. EbN1
MSRTEHHAPETPATRFLKQHRVAYTTHSYAYEPHGGTKVSARELDVDEHAIVKTLVMEDESGAPLIVLMHGDRKVSTKELARQAGRKRIEPCTPEVANRHSGYLVGGTSPFGTRKRLPVFMENSIVDLPLVYINGGRRGFLLGISPREILRVLQPRLVSAGI

SEQ ID NO: 99278 - DNA, 474 bp, Zymomonas mobilis subsp. mobilis ZM4
  CDS (1)..(474): transl_table=11
atgactaagaaaacacgcggaaccgcttttcttgaaaaagcaggcattgcttttaccgttcatccctatgactacgatcccaaggcaccagccgctggattacaagccgccgaagccctccagcaacccgccgagatcgtctataaaactctaatgactgaagtcgatggcaagccggtttgcgtcgtagtgcaggtcaatcacgaagtctcgatgaaaaaattggctgccgccgcagggggaaaatcagccaatatgattaaacctgtcgatgcagaacggatgaccggctatcatgttggtgggattagcccttttggtcagaagaaacgcgttccggtcatctttgatgaatctgcatttcaggctgaaaaaatctttatcaatggcggtcagcgcggggtattagtcgctcttgcccccgaagatgctcgtcgcgctgttgatggcaaaatcgcatcggtcgccaattaa

SEQ ID NO: 99279 - protein, 157 aa, Zymomonas mobilis subsp. mobilis ZM4
MTKKTRGTAFLEKAGIAFTVHPYDYDPKAPAAGLQAAEALQQPAEIVYKTLMTEVDGKPVCVVVQVNHEVSMKKLAAAAGGKSANMIKPVDAERMTGYHVGGISPFGQKKRVPVIFDESAFQAEKIFINGGQRGVLVALAPEDARRAVDGKIASVAN

SEQ ID NO: 99280 - DNA, 477 bp, Bacillus clausii KSM-K16
  CDS (1)..(477): transl_table=11
atgaaacaaactaaaacgaatgcgattcgcttgttagaacaacataagaaaccttataccttgttttcctatccggtttcagatggcaagattgatggccaatcggtcgcgcaaaagatcaataaaccggaacacgttgtttataaaactcttgttgcccaaggaaaaagcggtgctatttacgttgcgctcattcctgtgaacgaagagcttcatttaaaaaagctgcaaaaagtgactgcggagaaaaaagttaacatgctcttggcgaaacagctccatgatgtgaccaattatgtccgtggcgggtgttcgccaatcggcatgaagaagccatacccgacttttatcgattcccaagcagcacagctagatgccattgtcgtaaacgccggaaaagttggcttgcagatggaacttcggttaagtgatttggtcgaagccgccaacgctcagtttgcagatctaacaatctag

SEQ ID NO: 99281 - protein, 158 aa, Bacillus clausii KSM-K16
MKQTKTNAIRLLEQHKKPYTLFSYPVSDGKIDGQSVAQKINKPEHVVYKTLVAQGKSGAIYVALIPVNEELHLKKLQKVTAEKKVNMLLAKQLHDVTNYVRGGCSPIGMKKPYPTFIDSQAAQLDAIVVNAGKVGLQMELRLSDLVEAANAQFADLTI

SEQ ID NO: 99282 - DNA, 477 bp, Gluconobacter oxydans 621H
  CDS (1)..(477): transl_table=11
gtgcaggacacatccgcgaccctgacactggacgctctcggcatttcctacgaacgccatgtctatgattacgatccctcggccggaaaactcggtgtggccgctgccgcagcactcggcctgtcgccggatcacgtcctcaagaccctgatggtgcagatcgacggccgccccgcctgcgtcgtgctgcccgcagaccgcgaactggatttcgcccgcgtggcgcaggccttcggcggccgcaaagccaagatgctctcccgccccgatgccgaacagcgcacaggctaccgcatcggcggcgtcagtcccttcggacagcgcagcaccgtccccaccgccttcgaacaatgcggcatggacggcccgcccgtcgtcatcaatggaggcagccagggactcctgatcgagctttcaccccaagacgccctgaccgccacgaacggcatcacggccgatctcgtcaaaccgctttga

SEQ ID NO: 99283 - protein, 158 aa, Gluconobacter oxydans 621H
MQDTSATLTLDALGISYERHVYDYDPSAGKLGVAAAAALGLSPDHVLKTLMVQIDGRPACVVLPADRELDFARVAQAFGGRKAKMLSRPDAEQRTGYRIGGVSPFGQRSTVPTAFEQCGMDGPPVVINGGSQGLLIELSPQDALTATNGITADLVKPL

SEQ ID NO: 99284 - DNA, 471 bp, Vibrio fischeri ES114
  CDS (1)..(471): transl_table=11
atgacaccagcaacaaagttattaaaaaaagcaaaaattgaacatcaggtgcttgagtatcatcatgatcctaaagctcaagcatatggtcttgaggcagcggaaaagttgggattagatcaaaaagaagtatttaaaacattagttgtacaagtggatgaaaaagagctcgttgtaggtattattccagttgcagagcaacttagtatgaagctaattgcaaaagcggttaaaggtaaaaaagcaaaaatggctgatcctgctgtggttcaaaagacaactggctatgtgcttggaggtgtcagtcctcttggtcaaaagaagcgcttaaaaacagtcattgatattacagctgaatctctggaaagcatttatgttagtggtggtaaaagaggtttagatattggtcttgcgccaaaagatttacaacaagtgctaaatgcgcagtttttggatattaaagctgagtaa

SEQ ID NO: 99285 - protein, 156 aa, Vibrio fischeri ES114
MTPATKLLKKAKIEHQVLEYHHDPKAQAYGLEAAEKLGLDQKEVFKTLVVQVDEKELVVGIIPVAEQLSMKLIAKAVKGKKAKMADPAVVQKTTGYVLGGVSPLGQKKRLKTVIDITAESLESIYVSGGKRGLDIGLAPKDLQQVLNAQFLDIKAE

SEQ ID NO: 99286 - DNA, 480 bp, Neisseria gonorrhoeae FA 1090
  CDS (1)..(480): transl_table=11
atgagtaaacacacttatccgataacacctgccgtacgcgttttgcgtgaaaacggcatcgaatttgaaccttttacctatgcctatgaggaacacggcggcacggcgcagtttgcccgactgttcggcaaagacgaacacttggtcattaaaaccattgttttgcaagatgaaaacggtaaggggccgattgtcttgatgcacggcgacaaacagatttcaacccgcaatctggcgcggcatttgggtgcgaaacacatcgaacccgccgcgcctgcgcaggcaaacaagtggacgggctatctggtcggcggcacaacgccgttcggcatccggacaaaattggatatttacgtcgaacagtcggtgatggatttggaaaccatctatatcaatggcggaaaacgcgggttcattatcggtatccgccccgatgatttaaatattttgaacccgaaaacaatacaggcagcggtttga

SEQ ID NO: 99287 - protein, 159 aa, Neisseria gonorrhoeae FA 1090
MSKHTYPITPAVRVLRENGIEFEPFTYAYEEHGGTAQFARLFGKDEHLVIKTIVLQDENGKGPIVLMHGDKQISTRNLARHLGAKHIEPAAPAQANKWTGYLVGGTTPFGIRTKLDIYVEQSVMDLETIYINGGKRGFIIGIRPDDLNILNPKTIQAAV

SEQ ID NO: 99288 - DNA, 474 bp, Magnetospirillum magnetotacticum MS-1
  CDS (1)..(474)
atgtccaagacgacgcgggcaacccaagccctggacaaggcaggcgttgcctatgaaacatgcacctatgcctatgatccggatgccgacaaaataggcatgcaggctgcccagtccctgggcgtcagcccttccatggtgctgaagaccctgatggtcctggccgattccaagcccgcctgcgtggtggtgccctccgattgcgaggtctccatgaagaaactggccgccgccctggcggccaaatcggcccagatgatgaaacccgccgatgccgagcgcctgaccggcttcgtggtgggcggcatctcgcccttcggccagaagcgcgccgttcccactgtgatggaacaagccgccctggcccatccccaagtgttcatcaatggcggccagcggggcttgcaggtcaagctggctcccgccgatgccctgaaggccctgggcgccaaggctgccgccgtggtggcgtga

SEQ ID NO: 99289 - protein, 157 aa, Magnetospirillum magnetotacticum MS-1
MSKTTRATQALDKAGVAYETCTYAYDPDADKIGMQAAQSLGVSPSMVLKTLMVLADSKPACVVVPSDCEVSMKKLAAALAAKSAQMMKPADAERLTGFVVGGISPFGQKRAVPTVMEQAALAHPQVFINGGQRGLQVKLAPADALKALGAKAAAVVA

SEQ ID NO: 99290 - DNA, 480 bp, Desulfitobacterium hafniense DCB-2
  CDS (1)..(480)
atggctcaaaaaaccaacgccgcccgcatcctcgatcaagccggtatagcctatgaattaatcccctatgaggtggatgaagcggatctttccgccactaccgtcgcccaaaaggtaaacatgcctcctgaattgatctacaaaaccctggtaacccgaggagataaaacaggcattctgatcgcctgcatccctgcccattatgagctgaaccttaaagccctcgcccaagtgagcggcaacaagaaaatggaagtggttcctctcaaagaagttcagcccctgaccggttatatacggggaggggtctctcctttaggaactaaaaaaaaataccccgtctattttcaggaagatatgctccagcacgagaaaattgccgtaagtgccgggacgcgaggcttgcagatccttgctctgtctcaggacctgctcaggatcacccagggcaaggttgggcccatcgctcatcctgcctga

SEQ ID NO: 99291 - protein, 159 aa, Desulfitobacterium hafniense DCB-2
MAQKTNAARILDQAGIAYELIPYEVDEADLSATTVAQKVNMPPELIYKTLVTRGDKTGILIACIPAHYELNLKALAQVSGNKKMEVVPLKEVQPLTGYIRGGVSPLGTKKKYPVYFQEDMLQHEKIAVSAGTRGLQILALSQDLLRITQGKVGPIAHPA

SEQ ID NO: 99292 - DNA, 510 bp, Bifidobacterium longum DJO10A
  CDS (1)..(510)
atggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggcgtgaatccacaggacctgctcaaggtcttgaacgccgttgccgcaccaatcggcacgtggtga

SEQ ID NO: 99293 - protein, 169 aa, Bifidobacterium longum DJO10A
MAKKSKHDKGAGSTPATVQLEKAGVEFHVYEYEHSNDHMDDGYGVEAATKLGFDEHQVFKTLMADTGAERVVGVVPVSGHMDLKALAAAVGAKKASMADPKVAMRESGYVVGGISPLGQKTRHKTVLDESALQFDQILVSGGKRGLSVGVNPQDLLKVLNAVAAPIGTW

SEQ ID NO: 99294 - DNA, 477 bp, Actinobacillus pleuropneumoniae serovar 1 str. 4074
  CDS (1)..(477)
atgaccccggcaataaatttattgaaaaagcaaaaaattgcacataggcttcatccttacgaacacgatccgaataacaccaatttcgggcaagaagcggtagaaaaattaggtattgatgccaatcagacatttaagaccttattagtcgcagaaaacggcgatcagaaaaaattagccgtgatggtggtgccggtttcgcataccttgaatttaaaacgagcggcaagtgcgctcggcgtgaaaaaagtggaaatggcggataaagatatcgcccaaaaaacaaccggctatttattagggggaatcagcccgctcggacagaaaaaacgtttaaccactgtgattgacagctccgcacaacaattttccacgatgtttgtttccggcggtaaacgagggttggacgtagagcttgcaccgcaagatttggcaagtttgctcaatgcaacttttgccgatattaaggaggaataa

SEQ ID NO: 99295 - protein, 158 aa, Actinobacillus pleuropneumoniae serovar 1 str. 4074
MTPAINLLKKQKIAHRLHPYEHDPNNTNFGQEAVEKLGIDANQTFKTLLVAENGDQKKLAVMVVPVSHTLNLKRAASALGVKKVEMADKDIAQKTTGYLLGGISPLGQKKRLTTVIDSSAQQFSTMFVSGGKRGLDVELAPQDLASLLNATFADIKEE

SEQ ID NO: 99296 - DNA, 489 bp, Psychrobacter sp. 273-4
  CDS (1)..(489)
atgacgccagctatcaatctcgccaaacaacgtggtcttgattatcgattacacgaatatactcacgacagtaatgccgcctcatttggtttggaagcggccgaaaagttgggtgttgacgtgacacgagtctttaaaaccttagtcgtattgaccgatacagaagtgctcgccgttgctatcttgccagtggataaaaccttaaactttaaaaaaatggctaaggcgctatctgttaataaaatactggcctgcaaaaaagtccaaatggcagatcctaaacaggtcgaacgtagtactggttatgtattgggcggtgtcagtccattgggccaaaaaaagcgcttagtaaccattatagatgagtcagcgcaaacacattcaaccatctatgtgagcggtggtcgacgaggcttagagattgaattgccgccagcacaattagcgacgacacttacggctcgctttgcctctcttaccgatgattga

SEQ ID NO: 99297 - protein, 162 aa, Psychrobacter sp. 273-4
MTPAINLAKQRGLDYRLHEYTHDSNAASFGLEAAEKLGVDVTRVFKTLVVLTDTEVLAVAILPVDKTLNFKKMAKALSVNKILACKKVQMADPKQVERSTGYVLGGVSPLGQKKRLVTIIDESAQTHSTIYVSGGRRGLEIELPPAQLATTLTARFASLTDD

SEQ ID NO: 99298 - DNA, 492 bp, Dechloromonas aromatica RCB
  CDS (1)..(492)
atgagcaaagccgaacacgcccccgaaacccaggccaccaagttcctcaaggcgaacaaggtgcccttctccacgcacctgtacgcttacgaagagcacggcgggaccaaggtttccgcccgcgagctgaatgtggatgaacatgcggtcgtcaaaacgctggttttcgaagatgaaaacgccaagccgctgatcgtgctgatgcacggcgactgcaaggtatcgaccaaggaactggcccggcagatcaattgcaagaaggtcgagccgtgcaagccggaagtcgccaatcgccacaccggcttcctggtcggcggcaccagcccgttcgggacaaagaaggcgatgccggtgcatgttgaaaagaccatcctcgacctgccgctgatctacatcaacggcggccggcgcggctttctggtcggcatccatccgcacgacatcctgcgcgtcctgcaccccaaagtcgtcgaggcggcgctcaaggcttga

SEQ ID NO: 99299 - protein, 163 aa, Dechloromonas aromatica RCB
MSKAEHAPETQATKFLKANKVPFSTHLYAYEEHGGTKVSARELNVDEHAVVKTLVFEDENAKPLIVLMHGDCKVSTKELARQINCKKVEPCKPEVANRHTGFLVGGTSPFGTKKAMPVHVEKTILDLPLIYINGGRRGFLVGIHPHDILRVLHPKVVEAALKA

SEQ ID NO: 99300 - DNA, 492 bp, Methylobacillus flagellatus KT
  CDS (1)..(492)
atgacttcactcgcctctcccgtcaccgacctcctgaacgcccactccatcccgttcaccgtcattgaaatcccgttgagtgaggacaagaaaccggttcgcaacctggaagagcttttggaaagccagggactggaccctaaatcggtagtgcgcagcgtgctgttccgcaccggttcggaccagttcatcctgcttgccgtggctggcggcggtcgtgccgactgggcgatcctgcgcaaccacctcaacgagcgcaaactgcgcatggcggaatatgacgaagtgcccgaggcgacaggctacgtggtcggcgccgtgccgccggtcgccctgccagaaggactcaaggtgttggtggacaacagcgtgaaggattatgaaaccgtagtgatcggcagcggcgtactgggttatgccctggcgctgaaagggacggatttgctgaaattattaggcgatgcggaacaaggcagctttgccaaggtttga

SEQ ID NO: 99301 - protein, 163 aa, Methylobacillus flagellatus KT
MTSLASPVTDLLNAHSIPFTVIEIPLSEDKKPVRNLEELLESQGLDPKSVVRSVLFRTGSDQFILLAVAGGGRADWAILRNHLNERKLRMAEYDEVPEATGYVVGAVPPVALPEGLKVLVDNSVKDYETVVIGSGVLGYALALKGTDLLKLLGDAEQGSFAKV

SEQ ID NO: 99302 - DNA, 522 bp, Burkholderia cepacia R1808
  CDS (1)..(522)
atgaccgaataccccgtcttcaacgggctgtgcgagctgctgaccagcaacggtgcgcggttccgcgtgctcgagcaccccgcagagggcaaatccgacgtgatcgccgcgattcgcggcacgcgtcccgaacagggcgcgaaggcgatgctctgcacgttcaaggatggcggcgatgcgaccgcgctggcagtgatccccggtcatctgaagatcgacttccgcaaggtcgccgacgcgctcggccgtcgcaaggcgacgctggcgccgccggagcgcgcggccgccgtcaccggctgcgtgatgggcgccgtgccgccgttcgtgttcgacgcgagcgtgacgctcgtcgtcgatccggcgctggtcgaacgcaacgacgcgatcgcgttcaacgccggacgcctcgaccgctcgatcgtgctcgacgcgtccgattacgtgcggatcgcccgaccgctgctcgccgacatcacgcgtcccgagaccaccgacgcacctgcgctcgaagccgcgcgatga

SEQ ID NO: 99303 - protein, 173 aa, Burkholderia cepacia R1808
MTEYPVFNGLCELLTSNGARFRVLEHPAEGKSDVIAAIRGTRPEQGAKAMLCTFKDGGDATALAVIPGHLKIDFRKVADALGRRKATLAPPERAAAVTGCVMGAVPPFVFDASVTLVVDPALVERNDAIAFNAGRLDRSIVLDASDYVRIARPLLADITRPETTDAPALEAAR

SEQ ID NO: 99304 - DNA, 486 bp, Rubrivivax gelatinosus PM1
  CDS (1)..(486)
atgagccgcagagaccacgccagcgagacgccggccaccgcgctgctgaagcgcgcgaagctggcctacaccgagcacctgtatgactacgtggaacgtggcggcaccgccgagtcggcgcgccagctcggtgtcgaggagcaccacgtcgtcaagacactggtgatgcaggacgaacaggccaagccgctgatcgtgctgatgcatggtgatcgccaggtcagcctgaaggcgctggcgcgcgagatcggctgcaagcgggtcgagccgtgtccgcccgaggtcgcgcagcgccacagcggctacctggtgggcggcacctcacccttcggcacgcgcaagcccatgccggtctacgtggaggccggcgtgctggagctgccgaagatctacctcaacggcggccggcgcggctacctggtcgggctggatccgcggcgcgcggctgaacttctgggggccgtgccggtgcgttgcgccgggtga

SEQ ID NO: 99305 - protein, 161 aa, Rubrivivax gelatinosus PM1
MSRRDHASETPATALLKRAKLAYTEHLYDYVERGGTAESARQLGVEEHHVVKTLVMQDEQAKPLIVLMHGDRQVSLKALAREIGCKRVEPCPPEVAQRHSGYLVGGTSPFGTRKPMPVYVEAGVLELPKIYLNGGRRGYLVGLDPRRAAELLGAVPVRCAG

SEQ ID NO: 99306 - DNA, 471 bp, Pseudomonas fluorescens PfO-1
  CDS (1)..(471)
atgacccctgcgttggacttgttgaaaaaagttcgtgccgaacatcacgtgcacagttacgaacatgacccgaaggccgcgtcatatggcctggaggccgcggagaaactggggctcgatccggcgcaggtattcaagacgctgctggcggccagcgagaagggtgagttgctggtggcagtggtgccggtcgtcggaagtctcgacctcaaggggctcgcccacgccgccggcgtgaaaaaagtcgagatggccgacccggccgccgcgcaacgctccaccggttatctgttgggcggcatcagtccgctggggcagaaaaaacgcctgcgtaccttcatcgataattcggcccagccttttgcgaccatttatgtcagtgccggccggcgagggctggaagtggaactggcgccggcagtattggcagaacacacccaggcgaaatttgccgacatcggtcgcccttga

SEQ ID NO: 99307 - protein, 156 aa, Pseudomonas fluorescens PfO-1
MTPALDLLKKVRAEHHVHSYEHDPKAASYGLEAAEKLGLDPAQVFKTLLAASEKGELLVAVVPVVGSLDLKGLAHAAGVKKVEMADPAAAQRSTGYLLGGISPLGQKKRLRTFIDNSAQPFATIYVSAGRRGLEVELAPAVLAEHTQAKFADIGRP

SEQ ID NO: 99308 - DNA, 474 bp, Rhodospirillum rubrum
  CDS (1)..(474)
atgtccaagaccacccgcgccacccaggcgcttgatcgcgcccatgtcgttcacgaggtggtgagctatgagtacgatcccgatgcgccgagcatcgggcttcaggccgcccaggccatcggcgaacacccccgccgggtgctgaaaaccctgatggccgaggtcgacggcaaggcggtctgcgccgtcgtgccctccgaccgcgaggtcagcatgaaaaagctggccgccgtgttcggcggcaaggcggcccatatgatgaagcccgccgacgccgaacggctgaccggctttcatgtgggcggcatcagcccctttggccagaagcgcaccgtgccgacggtggtcgaggaaagcgccctggccgaggagcgggtctatatgaacggcggccagcgcggccttcaggtgcgcttggcgccggccgatgccgtcgccgcccttggcgcccgggtggcctcgatcgtggcctaa

SEQ ID NO: 99309 - protein, 157 aa, Rhodospirillum rubrum
MSKTTRATQALDRAHVVHEVVSYEYDPDAPSIGLQAAQAIGEHPRRVLKTLMAEVDGKAVCAVVPSDREVSMKKLAAVFGGKAAHMMKPADAERLTGFHVGGISPFGQKRTVPTVVEESALAEERVYMNGGQRGLQVRLAPADAVAALGARVASIVA

SEQ ID NO: 99310 - DNA, 492 bp, Ralstonia metallidurans CH34
  CDS (1)..(492)
atgagcaagagcaagcacgtctccgaaacccccgccacgcaaatgctgcgcaagcacggcgtcacgttcggcgagcacacctacgactacgtcgaccacggcggcacgggcgaatcgtcacgtcagctcggcgtgcccgagcacgacgtggtcaagacactggtaatggaagacgaagcggccaagccgctgatcgtgctgatgcatggcgactgctcggtgtcgaccaagaatctcgcacggcagatcggcgccaagagcgtgcagccatgcaagcccgacgtggcgcagcgccacagcggctatatggttggcggcacgtcgcccttcggcacgaagaagaaaatgccggtctatgtcgaggcgtcgatattgacgctggacaagatctacatcaatggcggccgccgtggatacctggtcagcgtcgcgccggcggtactggaggcgctggttgacgccaagccggtggaatgcgcgctgccggactaa

SEQ ID NO: 99311 - protein, 163 aa, Ralstonia metallidurans CH34
MSKSKHVSETPATQMLRKHGVTFGEHTYDYVDHGGTGESSRQLGVPEHDVVKTLVMEDEAAKPLIVLMHGDCSVSTKNLARQIGAKSVQPCKPDVAQRHSGYMVGGTSPFGTKKKMPVYVEASILTLDKIYINGGRRGYLVSVAPAVLEALVDAKPVECALPD

SEQ ID NO: 99312 - DNA, 447 bp, Enterococcus faecium
  CDS (1)..(447)
atggtcgaacaaaaaaagattccctatacagagcacgaatatgagtgggacgaaagccacctaagtgcgtcatcggtcgctgaacagcttccagaaagccaatctcgtatatttaaaacactggttgctgtgggcaatgtgacggggcctcttgttgctgtgataccgggagaagccgaattgaatctaaaaaaattagcaaaagtttcagggaataaaaaagtagaaatgctccatttaaaagatttggaagcaacgaccggatacatacgtggtggctgctcgcctataggtatgaaaaaactatttcctacttatttagatcaaattgcagaaagctatgaacaaatcattgtctcggctggcagaagagggctacagatggagttagcacctcaagatatctgtgcattaacgagcggacaatttgcagatataaaacaataa

SEQ ID NO: 99313 - protein, 148 aa, Enterococcus faecium
MVEQKKIPYTEHEYEWDESHLSASSVAEQLPESQSRIFKTLVAVGNVTGPLVAVIPGEAELNLKKLAKVSGNKKVEMLHLKDLEATTGYIRGGCSPIGMKKLFPTYLDQIAESYEQIIVSAGRRGLQMELAPQDICALTSGQFADIKQ

SEQ ID NO: 99314 - DNA, 486 bp, Geobacter metallireducens GS-15
  CDS (1)..(486)
atggctaaggagagcaaagcgccggtcacggctgcggtgcgggcgttgcgcgccgcgaaggtcccattcaccgaccacctctatgcctatgaggaaaagggggggaccgccgtctcctcccgggagctggaggtggacgagcacgccgttgtgaagactctcatcatggaggacgaggcgaaaaatccgctaatcgtcctgatgcacggggaccgccaggtttccaccaaggagttggcccgggttctgggggtgaagggggtttctccctgctcccccgacacggcccagaagcatacgggatacctcgtgggggggacctctcctttcgggacccgccggcagatgccggtctgcatggaagaaacgatccttgacttgccctgcatctacatcaacggcggcaagcggggatatctcgtggggattgatccccgtgacgtggtgaagcttctcaatccgaccctggttcgggtcgccatctga

SEQ ID NO: 99315 - protein, 161 aa, Geobacter metallireducens GS-15
MAKESKAPVTAAVRALRAAKVPFTDHLYAYEEKGGTAVSSRELEVDEHAVVKTLIMEDEAKNPLIVLMHGDRQVSTKELARVLGVKGVSPCSPDTAQKHTGYLVGGTSPFGTRRQMPVCMEETILDLPCIYINGGKRGYLVGIDPRDVVKLLNPTLVRVAI

SEQ ID NO: 99316 - DNA, 477 bp, Novosphingobium aromaticivorans DSM 12444
  CDS (1)..(477)
atggcgcatgcgacccgcgcgacgaaggctctggaacaggccggcattcctttcgaactccgcagctacgattacgatccggatgccgacagcatcgggctggcggcggcgcaggcgctgggcgtggatccggggcaggtgttcaagaccctgatgatccttgccgatggcaagccggcctgcgtcatcgcgcccagcgacggggaggtttcgctgaagcgcgcggcggcggcgttgggggccaaggcggcggagatgatgcggcccgccgaggcggagcggatcgcgggctacaaggtgggcgggatcagcccattcgggcagatgcgcaaggtgccggtggtcatcgacgagacggcgctgttgtgggacgcgatcttcatcaacggtggacagcggggcctgcaggtccttgtcgcgggagaggcggcagcggggctgctgggcgcggtcgtggcggacatcgccacagggtga

SEQ ID NO: 99317 - protein, 158 aa, Novosphingobium aromaticivorans DSM 12444
MAHATRATKALEQAGIPFELRSYDYDPDADSIGLAAAQALGVDPGQVFKTLMILADGKPACVIAPSDGEVSLKRAAAALGAKAAEMMRPAEAERIAGYKVGGISPFGQMRKVPVVIDETALLWDAIFINGGQRGLQVLVAGEAAAGLLGAVVADIATG

SEQ ID NO: 99318 - DNA, 510 bp, Oenococcus oeni PSU-1
  CDS (1)..(510)
atgagcaaaagaacaaagattaaaaaaacacaagttgaacaacttttggataaaaataagattccttaccaatcattagaacttaatgttttaaatcaaagcagcacagaaattaaaaaaaatttgtcaaaggcgggtatcccccgagagtctttgatttataaaacgctggcctcaaatggtgacaaaagcggcccggtgattgccgttttaccagtcacaaaacatttggacgagaaaaaactggcagctgtttccggaaacaagcgtacagaaatgattcccttaaaagaactgcaaaaaacgactggatacattcatggggcaaacaatcctgtcggtatctggcataatcatcatggtaagtttccaatatatttcgacaaaacgtccttaagcgatgaattgatttatgtttctgccggagaactgaacagaagcgatttaattaatgcaaaacaggttgccgaactaatcggtgcttcctttgccgatttgttagccgattga

SEQ ID NO: 99319 - protein, 169 aa, Oenococcus oeni PSU-1
MSKRTKIKKTQVEQLLDKNKIPYQSLELNVLNQSSTEIKKNLSKAGIPRESLIYKTLASNGDKSGPVIAVLPVTKHLDEKKLAAVSGNKRTEMIPLKELQKTTGYIHGANNPVGIWHNHHGKFPIYFDKTSLSDELIYVSAGELNRSDLINAKQVAELIGASFADLLAD

SEQ ID NO: 99320 - DNA, 501 bp, Pediococcus pentosaceus ATCC 25745
  CDS (1)..(501)
atgggtaaaaagaagaaagaaaaagtctctaaaacccttgttgaacagattttagacaaaaacaaaattgaatacaagcaatttatttttccgacatttcaagatggtgatgttaagcaattaaacgttgatcacatcggtgttgatgatcacctcatttataaaactttagcattaattggaaataaaactggccccattgttggagttttaccagttgatgaacatctaagttacaaaaaacttgctaaaatttcgggtaataaaaaagttggtatgattccattaaaggatttaattgccaccacgggttacgaacatggggctaatactcctattggaatttatgaaactaagcactttcctatttacatttcagatgttgccaaagaacaaggcacaatcatcgtatcttcaggaaaaattggtcgatctgttcaattaaaggcggaggatttagctcaactagttcacgggactttcggtgacattattgaatag

SEQ ID NO: 99321 - protein, 166 aa, Pediococcus pentosaceus ATCC 25745
MGKKKKEKVSKTLVEQILDKNKIEYKQFIFPTFQDGDVKQLNVDHIGVDDHLIYKTLALIGNKTGPIVGVLPVDEHLSYKKLAKISGNKKVGMIPLKDLIATTGYEHGANTPIGIYETKHFPIYISDVAKEQGTIIVSSGKIGRSVQLKAEDLAQLVHGTFGDIIE

SEQ ID NO: 99322 - DNA, 501 bp, Leuconostoc mesenteroides subsp. mesenteroides ATCC 8293
  CDS (1)..(501)
atgagtaaaaagaaaatgaaaaaaacgttgcccgaacaagtcatggacaaacacaaagtgaaatatgaaccacttgaactaaatatcttggataaaacgccagttcagcgtgatgcaatcctggaaacgtttcacgtgaaacatgatgacatttataaaacactcgccgcacatggggataaaactgggcccattgtagcagtgttacctatcacaaaacatctgtcactaaaaaagttagcagctgcatcaggtaataaaaaagtggccatgttacctcttaaagaattacaaaggacgactggttatattcacggcgctaataaccctgttggaatctggcagaacaagcatttccctatttattttgatctcagcgctgctgagcaacctttcattcttgtcagtggcggcgagttaagtcgttcagataaaatcaatccgcgtgatgttgcatcattagttggtgccgaatttgtagatttattagagcatgactga

SEQ ID NO: 99323 - protein, 166 aa, Leuconostoc mesenteroides subsp. mesenteroides ATCC 8293
MSKKKMKKTLPEQVMDKHKVKYEPLELNILDKTPVQRDAILETFHVKHDDIYKTLAAHGDKTGPIVAVLPITKHLSLKKLAAASGNKKVAMLPLKELQRTTGYIHGANNPVGIWQNKHFPIYFDLSAAEQPFILVSGGELSRSDKINPRDVASLVGAEFVDLLEHD

SEQ ID NO: 99324 - DNA, 459 bp, Chloroflexus aurantiacus
  CDS (1)..(459)
atgcgtcttcttgaacgtcatcacatcgcgtacactgtgcatgagtacgaatacaacgatgcatacgacgcgcaaacaattgcccggatgatcggggtgccggcaagtcaggtattcaagaccctcgttgttggtggtgccggtgtgcgaccaattctggcaatggttccggctgacgcacaactgtcactgaagcgcctggcagcgctgatcggcgtcaaatcgcttgatctactcccgcgcgccgacgtcgagcgtctgaccggcttacaaattggcgggattggtgcgttggcgttaaccgcaaaagggtggacatcgtacctcgatgagtctgcactgcaatatccggtcgtgtatgtcaatgccggaaagcggggcatacttctcggattagcaccaaccgaactggtgcgcgtggtaggggcaaaggttggtgcaattgctgaacgaggatag

SEQ ID NO: 99325 - protein, 152 aa, Chloroflexus aurantiacus
MRLLERHHIAYTVHEYEYNDAYDAQTIARMIGVPASQVFKTLVVGGAGVRPILAMVPADAQLSLKRLAALIGVKSLDLLPRADVERLTGLQIGGIGALALTAKGWTSYLDESALQYPVVYVNAGKRGILLGLAPTELVRVVGAKVGAIAERG

SEQ ID NO: 99326 - DNA, 450 bp, Polaromonas sp. JS666
  CDS (1)..(450)
atgctcaaggcccatcatgtggctttcaccgagcatccctacgactacgtggagcacggcggggcgcagcacagtgccgaggtgctggacctggaccccttcaccgtggtcaagacgctggtcatgcaggaccaggacggcaagcccctgctggtgctgatgcatggcaaccgcaaggtctcgaccaaaaatcttgcgcgccagatcggcgccaaatcggtcgagccctgcaagcctgaagtggcgaatcgccacagcggctacctggtgggcggtacctcacccttcggaacgcgaaagcccatgcctgtctacatcgaggaaaccattctggctttgccgcggatcgccatcaacgggggccggcgcggttatctggtcggcatcgatccgcaggtgtgcgttacgctgctgggtgcaaaatcggtgcagtgcgcacttagcgaatag

SEQ ID NO: 99327 - protein, 149 aa, Polaromonas sp. JS666
MLKAHHVAFTEHPYDYVEHGGAQHSAEVLDLDPFTVVKTLVMQDQDGKPLLVLMHGNRKVSTKNLARQIGAKSVEPCKPEVANRHSGYLVGGTSPFGTRKPMPVYIEETILALPRIAINGGRRGYLVGIDPQVCVTLLGAKSVQCALSE

SEQ ID NO: 99328 - DNA, 501 bp, Corynebacterium glutamicum
  CDS (1)..(501): transl_table=11
atggctaagaaagtagacacctcgaacgctacccccgctctagcccttcttacggagaggcagattccttttgagctggatgttcatgatgtagatccaaaatcatcaaagggctttgcattggatgcctctgaagtaatgggtgtggagccggaagtggtgtttaaaacgctcatggcagatattgatggtgaacacgtggtcgcgattgttccagccagcagaacgttgaatctcaagcagttggctaaggctggaaaaggtaagcatgcaaacatgatggatcgcagccgtgcacaggtagttacggggtatgtccctggtggaatctcaccgatagggcagaagaacaagcaccgcgtgtttttggatgagtctgcaattctccaggagcgaatctacgtcagcgcagggcgacgcgggtggtccctgattatcgccccggatgatgttcttctggctaccgatggtgtttacgcggatattgctgatcattcataa

SEQ ID NO: 99329 - protein, 166 aa, Corynebacterium glutamicum
MAKKVDTSNATPALALLTERQIPFELDVHDVDPKSSKGFALDASEVMGVEPEVVFKTLMADIDGEHVVAIVPASRTLNLKQLAKAGKGKHANMMDRSRAQVVTGYVPGGISPIGQKNKHRVFLDESAILQERIYVSAGRRGWSLIIAPDDVLLATDGVYADIADHS

SEQ ID NO: 99330 - DNA, 558 bp, Mycobacterium smegmatis
  CDS (1)..(558): transl_table=11
atgcacgctgtgagatcccgggccggcccgaaaacgaacccgggcgccctgtctaggcttttccgcgtggcacgcgcagcaacacccgcgatcgcggcactggtcgccgcaggcatccaacacgacgtggtgcggtatcaccacgatccccgcaacgactccttcggcgaggaggcagccgcccaactggccgccgacggctacgtcgccgagcaggtgttcaagaccctcgtgatcgcgctgccgaaaggcctggcggtcgccgtggtcccggtgcccaccaagttgtcgctcaaggccgcggccgccgcgctcggcgtggccagggccgagatggccgatccggccgccgcacagcgctcgaccggttacgtcgtccggggaatctccccgctggggcagcgcaagccgctgccgaccgtgatcgatgcctcggcgctgcgattcgacagggtgttgtgcagcgcgggcaagcgcggactggacatcgtgctggccccggccgacctgatccgcgcgaccgacgcggtcaccgccgagatcgccgtgggcgcctag

SEQ ID NO: 99331 - protein, 185 aa, Mycobacterium smegmatis
MHAVRSRAGPKTNPGALSRLFRVARAATPAIAALVAAGIQHDVVRYHHDPRNDSFGEEAAAQLAADGYVAEQVFKTLVIALPKGLAVAVVPVPTKLSLKAAAAALGVARAEMADPAAAQRSTGYVVRGISPLGQRKPLPTVIDASALRFDRVLCSAGKRGLDIVLAPADLIRATDAVTAEIAVGA

SEQ ID NO: 99332 - DNA, 495 bp, Enterococcus faecalis
  CDS (1)..(495)
atggcaaagaaaaaaacacaacaaaaaacgaatgcgatgcgcatggtggaacaacataaagtaccatataaagaatatgaattcgcttggagtgaagatcatttaagtgcagaaagtgtcgctgaaagtttaggtattgaaaaaggacgaatttttaaaaccttggttacagtaggtaataaaacaggtccagtcgtggctgtcattcctggtaatcaagaattagatttgaaaaaattagcgaaagctagtggcaacaaaaaggtagaaatgcttcacttaaaagatttagaagcaaccacaggctatattcgtgggggctgttcaccaattgggatgaaaaaacaatttcccacctatttggctgaagaagctcaacaatattctgcaattattgtttctgcaggcaaacgtggcatgcaaattgaattagcgcctgaagcaatcctttcgctaaccaatgggcaatttgcggaaataacgacaaaagaataa

SEQ ID NO: 99333 - protein, 164 aa, Enterococcus faecalis
MAKKKTQQKTNAMRMVEQHKVPYKEYEFAWSEDHLSAESVAESLGIEKGRIFKTLVTVGNKTGPVVAVIPGNQELDLKKLAKASGNKKVEMLHLKDLEATTGYIRGGCSPIGMKKQFPTYLAEEAQQYSAIIVSAGKRGMQIELAPEAILSLTNGQFAEITTKE

SEQ ID NO: 99334 - DNA, 477 bp, Haemophilus influenzae
  CDS (1)..(477): transl_table=11
atgacacccgcaattgatttacttaaaaaacaaaaaattccttttatcttgcacacttatgatcatgatccgaataatcaacattttggtgatgaggcagccgaaaaattaggcattgatcctaaccgctcttttaaaaccttacttgtggcggaaaatggcgatcagaaaaaacttgcttgttttgtgcttgcaacggccaatatgctgaatttaaagaaagcagcaaaatctatcggtgtgaaaaaagtggaaatggcggataaagatgcagcacaaaaaagtacaggctatcttgtaggtggaattagcccgctaggtcaaaagaaacgcgtgaaaaccgtgataaattcaaccgcacttgagtttgaaacgatttatgtttcaggcggaaaacgtgggctaagcgtagaaattgcgccacaagatttagcaaaagtattaggtgcagaatttactgatattgttgatgaatag

SEQ ID NO: 99335 - protein, 158 aa, Haemophilus influenzae
MTPAIDLLKKQKIPFILHTYDHDPNNQHFGDEAAEKLGIDPNRSFKTLLVAENGDQKKLACFVLATANMLNLKKAAKSIGVKKVEMADKDAAQKSTGYLVGGISPLGQKKRVKTVINSTALEFETIYVSGGKRGLSVEIAPQDLAKVLGAEFTDIVDE

SEQ ID NO: 99336 - DNA, 22 bp, Primer
atgacacccgcagttaaattac

SEQ ID NO: 99337 - DNA, 22 bp, Primer
ttaatcgcggcgggcgatatca

SEQ ID NO: 99338 - protein, 152 aa, consensus
  MISC_FEATURE (1)..(152): consensus for the disclosure of xaa see table XV
TXXXXXLXXXXXXXXXXXXXXXXXXXXXXXXXXXXXXXXXXXXXXXXXXXKTLXXXXXXXXXXXXXXXXXXXXXXXXXXXKXXAXXXXXXXXXXXKXXXXXXXXXXXXXTGYXXGGXSPXXXXXGXXXXXXXXXXXXXXXXXXXXXXXGXRG

SEQ ID NO: 99339 - protein, 109 aa, consensus
  MISC_FEATURE (1)..(109): consensus for the disclosure of xaa see table XV
XXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXGXXXXXXXX

SEQ ID NO: 99340 - DNA, 660 bp, Escherichia coli; identical to SEQ ID NO: 58632
  CDS (1)..(660)

SEQ ID NO: 99341 - protein, 219 aa, Escherichia coli; identical to SEQ ID NO: 58633

SEQ ID NO: 99342 - DNA, 977 bp, Cryptococcus neoformans var. neoformans JEC21; identical to SEQ ID NO: 58634
  CDS (27)..(878)

SEQ ID NO: 99343 - protein, 283 aa, Cryptococcus neoformans var. neoformans JEC21; identical to SEQ ID NO: 58635

SEQ ID NO: 99344 - DNA, 663 bp, Azoarcus sp. EbN1; identical to SEQ ID NO: 58636
  CDS (1)..(663)

SEQ ID NO: 99345 - protein, 220 aa, Azoarcus sp. EbN1; identical to SEQ ID NO: 58637

SEQ ID NO: 99346 - DNA, 705 bp, Ehrlichia ruminantium str. Welgevonden; identical to SEQ ID NO: 58638
  CDS (1)..(705)

SEQ ID NO: 99347 - protein, 234 aa, Ehrlichia ruminantium str. Welgevonden; identical to SEQ ID NO: 58639

SEQ ID NO: 99348 - DNA, 723 bp, Wolbachia endosymbiont strain TRS of Brugia malayi; identical to SEQ ID NO: 58640
  CDS (1)..(723)

SEQ ID NO: 99349 - protein, 240 aa, Wolbachia endosymbiont strain TRS of Brugia malayi; identical to SEQ ID NO: 58641

SEQ ID NO: 99350 - DNA, 663 bp, Vibrio fischeri ES114; identical to SEQ ID NO: 58642
  CDS (1)..(663)

SEQ ID NO: 99351 - protein, 220 aa, Vibrio fischeri ES114; identical to SEQ ID NO: 58643

SEQ ID NO: 99352 - DNA, 684 bp, Neisseria gonorrhoeae FA 1090; identical to SEQ ID NO: 58644
  CDS (1)..(684)

SEQ ID NO: 99353 - protein, 227 aa, Neisseria gonorrhoeae FA 1090; identical to SEQ ID NO: 58645

SEQ ID NO: 99354 - DNA, 708 bp, Xenopus tropicalis; identical to SEQ ID NO: 58646
  CDS (1)..(708)

SEQ ID NO: 99355 - protein, 235 aa, Xenopus tropicalis; identical to SEQ ID NO: 58647

SEQ ID NO: 99356 - DNA, 714 bp, Sus scrofa; identical to SEQ ID NO: 58648
  CDS (1)..(714)

SEQ ID NO: 99357 - protein, 237 aa, Sus scrofa; identical to SEQ ID NO: 58649

SEQ ID NO: 99358 - DNA, 975 bp, Danio rerio; identical to SEQ ID NO: 58650
  CDS (1)..(975)

SEQ ID NO: 99359 - protein, 324 aa, Danio rerio; identical to SEQ ID NO: 58651

SEQ ID NO: 99360 - DNA, 1116 bp, Homo sapiens; identical to SEQ ID NO: 58652
  CDS (1)..(1116)

SEQ ID NO: 99361 - protein, 371 aa, Homo sapiens; identical to SEQ ID NO: 58653

SEQ ID NO: 99362 - DNA, 714 bp, Mus musculus; identical to SEQ ID NO: 58654
  CDS (1)..(714)

SEQ ID NO: 99363 - protein, 237 aa, Mus musculus; identical to SEQ ID NO: 58655

SEQ ID NO: 99364 - DNA, 774 bp, Mesorhizobium loti MAFF303099; identical to SEQ ID NO: 58656
  CDS (1)..(774): transl_table=11

SEQ ID NO: 99365 - protein, 257 aa, Mesorhizobium loti MAFF303099; identical to SEQ ID NO: 58657

SEQ ID NO: 99366 - DNA, 744 bp, Arabidopsis thaliana; identical to SEQ ID NO: 58658
  CDS (1)..(744)

SEQ ID NO: 99367 - protein, 247 aa, Arabidopsis thaliana; identical to SEQ ID NO: 58659

SEQ ID NO: 99368 - DNA, 720 bp, Arabidopsis thaliana; identical to SEQ ID NO: 58660
  CDS (1)..(720)

SEQ ID NO: 99369 - protein, 239 aa, Arabidopsis thaliana; identical to SEQ ID NO: 58661

SEQ ID NO: 99370 - DNA, 747 bp, Arabidopsis thaliana; identical to SEQ ID NO: 58662
  CDS (1)..(747)

SEQ ID NO: 99371 - protein, 248 aa, Arabidopsis thaliana; identical to SEQ ID NO: 58663

SEQ ID NO: 99372 - DNA, 708 bp, Arabidopsis thaliana; identical to SEQ ID NO: 58664
  CDS (1)..(708)

SEQ ID NO: 99373 - protein, 235 aa, Arabidopsis thaliana; identical to SEQ ID NO: 58665

SEQ ID NO: 99374 - DNA, 744 bp, Arabidopsis thaliana; identical to SEQ ID NO: 58666
  CDS (1)..(744)

SEQ ID NO: 99375 - protein, 247 aa, Arabidopsis thaliana; identical to SEQ ID NO: 58667

SEQ ID NO: 99376 - DNA, 714 bp, Lactococcus lactis subsp. lactis Il1403; identical to SEQ ID NO: 58668
  CDS (1)..(714): transl_table=11

SEQ ID NO: 99377 - protein, 237 aa, Lactococcus lactis subsp. lactis Il1403; identical to SEQ ID NO: 58669

SEQ ID NO: 99378 - DNA, 705 bp, Escherichia coli O157:H7; identical to SEQ ID NO: 58670
  CDS (1)..(705): transl_table=11

SEQ ID NO: 99379 - protein, 234 aa, Escherichia coli O157:H7; identical to SEQ ID NO: 58671

SEQ ID NO: 99380 - DNA, 696 bp, Clostridium acetobutylicum ATCC 824; identical to SEQ ID NO: 58672
  CDS (1)..(696): transl_table=11

SEQ ID NO: 99381 - protein, 231 aa, Clostridium acetobutylicum ATCC 824; identical to SEQ ID NO: 58673

SEQ ID NO: 99382 - DNA, 708 bp, Streptococcus pneumoniae R6; identical to SEQ ID NO: 58674
  CDS (1)..(708): transl_table=11

SEQ ID NO: 99383 - protein, 235 aa, Streptococcus pneumoniae R6; identical to SEQ ID NO: 58675

SEQ ID NO: 99384 - DNA, 738 bp, Sinorhizobium meliloti 1021; identical to SEQ ID NO: 58676
  CDS (1)..(738): transl_table=11

SEQ ID NO: 99385 - protein, 245 aa, Sinorhizobium meliloti 1021; identical to SEQ ID NO: 58677

SEQ ID NO: 99386 - DNA, 645 bp, Bacillus subtilis subsp. subtilis str. 168; identical to SEQ ID NO: 58678
  CDS (1)..(645): transl_table=11

SEQ ID NO: 99387 - protein, 214 aa, Bacillus subtilis subsp. subtilis str. 168; identical to SEQ ID NO: 58679

SEQ ID NO: 99388 - DNA, 705 bp, Salmonella typhimurium LT2; identical to SEQ ID NO: 58680
  CDS (1)..(705): transl_table=11

SEQ ID NO: 99389 - protein, 234 aa, Salmonella typhimurium LT2; identical to SEQ ID NO: 58681

SEQ ID NO: 99390 - DNA, 660 bp, Salmonella typhimurium LT2; identical to SEQ ID NO: 58682
  CDS (1)..(660): transl_table=11

SEQ ID NO: 99391 - protein, 219 aa, Salmonella typhimurium LT2; identical to SEQ ID NO: 58683

SEQ ID NO: 99392 - DNA, 678 bp, Listeria innocua Clip11262; identical to SEQ ID NO: 58684
  CDS (1)..(678): transl_table=11

SEQ ID NO: 99393 - protein, 225 aa, Listeria innocua Clip11262; identical to SEQ ID NO: 58685

SEQ ID NO: 99394 - DNA, 702 bp, Ralstonia solanacearum GMI1000; identical to SEQ ID NO: 58686
  CDS (1)..(702): transl_table=11

SEQ ID NO: 99395 - protein, 233 aa, Ralstonia solanacearum GMI1000; identical to SEQ ID NO: 58687

SEQ ID NO: 99396 - DNA, 783 bp, Agrobacterium tumefaciens str. C58; identical to SEQ ID NO: 58688
  CDS (1)..(783): transl_table=11

SEQ ID NO: 99397 - protein, 260 aa, Agrobacterium tumefaciens str. C58; identical to SEQ ID NO: 58689

SEQ ID NO: 99398 - DNA, 771 bp, Arabidopsis thaliana; identical to SEQ ID NO: 58690
  CDS (1)..(771)

SEQ ID NO: 99399 - protein, 256 aa, Arabidopsis thaliana; identical to SEQ ID NO: 58691

SEQ ID NO: 99400 - DNA, 714 bp, Camelpox virus; identical to SEQ ID NO: 58692
  CDS (1)..(714)

SEQ ID NO: 99401 - protein, 237 aa, Camelpox virus; identical to SEQ ID NO: 58693

SEQ ID NO: 99402 - DNA, 690 bp, Streptococcus pyogenes MGAS8232; identical to SEQ ID NO: 58694
  CDS (1)..(690): transl_table=11

SEQ ID NO: 99403 - protein, 229 aa, Streptococcus pyogenes MGAS8232; identical to SEQ ID NO: 58695

SEQ ID NO: 99404 - DNA, 795 bp, Drosophila melanogaster; identical to SEQ ID NO: 58696
  CDS (1)..(795)

SEQ ID NO: 99405 - protein, 264 aa, Drosophila melanogaster; identical to SEQ ID NO: 58697

SEQ ID NO: 99406 - DNA, 711 bp, Yersinia pestis KIM; identical to SEQ ID NO: 58698
  CDS (1)..(711): transl_table=11

SEQ ID NO: 99407 - protein, 236 aa, Yersinia pestis KIM; identical to SEQ ID NO: 58699

SEQ ID NO: 99408 - DNA, 690 bp, Streptococcus agalactiae 2603V/R; identical to SEQ ID NO: 58700
  CDS (1)..(690): transl_table=11

SEQ ID NO: 99409 - protein, 229 aa, Streptococcus agalactiae 2603V/R; identical to SEQ ID NO: 58701

SEQ ID NO: 99410 - DNA, 900 bp, Bifidobacterium longum NCC2705; identical to SEQ ID NO: 58702
  CDS (1)..(900): transl_table=11

SEQ ID NO: 99411 - protein, 299 aa, Bifidobacterium longum NCC2705; identical to SEQ ID NO: 58703

SEQ ID NO: 99412 - DNA, 738 bp, Brucella suis 1330; identical to SEQ ID NO: 58704
  CDS (1)..(738): transl_table=11

SEQ ID NO: 99413 - protein, 245 aa, Brucella suis 1330; identical to SEQ ID NO: 58705

SEQ ID NO: 99414 - DNA, 870 bp, Plasmodium falciparum 3D7; identical to SEQ ID NO: 58706
  CDS (1)..(870)

SEQ ID NO: 99415 - protein, 289 aa, Plasmodium falciparum 3D7; identical to SEQ ID NO: 58707

SEQ ID NO: 99416 - DNA, 705 bp, Shigella flexneri 2a str. 301; identical to SEQ ID NO: 58708
  CDS (1)..(705): transl_table=11

SEQ ID NO: 99417 - protein, 234 aa, Shigella flexneri 2a str. 301; identical to SEQ ID NO: 58709

SEQ ID NO: 99418 - DNA, 660 bp, Shewanella oneidensis MR-1; identical to SEQ ID NO: 58710
  CDS (1)..(660): transl_table=11

SEQ ID NO: 99419 - protein, 219 aa, Shewanella oneidensis MR-1; identical to SEQ ID NO: 58711

SEQ ID NO: 99420 - DNA, 825 bp, Drosophila melanogaster; identical to SEQ ID NO: 58712
  CDS (1)..(825)

SEQ ID NO: 99421 - protein, 274 aa, Drosophila melanogaster; identical to SEQ ID NO: 58713

SEQ ID NO: 99422 - DNA, 714 bp, Drosophila melanogaster; identical to SEQ ID NO: 58714
  CDS (1)..(714)

SEQ ID NO: 99423 - protein, 237 aa, Drosophila melanogaster; identical to SEQ ID NO: 58715

SEQ ID NO: 99424 - DNA, 672 bp, Pseudomonas putida KT2440; identical to SEQ ID NO: 58716
  CDS (1)..(672): transl_table=11

SEQ ID NO: 99425 - protein, 223 aa, Pseudomonas putida KT2440; identical to SEQ ID NO: 58717

SEQ ID NO: 99426 - DNA, 663 bp, Vibrio vulnificus CMCP6; identical to SEQ ID NO: 58718
  CDS (1)..(663): transl_table=11

SEQ ID NO: 99427 - protein, 220 aa, Vibrio vulnificus CMCP6; identical to SEQ ID NO: 58719

SEQ ID NO: 99428 - DNA, 837 bp, Bradyrhizobium japonicum USDA 110; identical to SEQ ID NO: 58720
  CDS (1)..(837)

SEQ ID NO: 99429 - protein, 278 aa, Bradyrhizobium japonicum USDA 110; identical to SEQ ID NO: 58721

SEQ ID NO: 99430 - DNA, 699 bp, Bradyrhizobium japonicum USDA 110; identical to SEQ ID NO: 58722
  CDS (1)..(699)

SEQ ID NO: 99431 - protein, 232 aa, Bradyrhizobium japonicum USDA 110; identical to SEQ ID NO: 58723

SEQ ID NO: 99432 - DNA, 690 bp, Streptococcus pyogenes SSI-1; identical to SEQ ID NO: 58724
  CDS (1)..(690): transl_table=11

SEQ ID NO: 99433 - protein, 229 aa, Streptococcus pyogenes SSI-1; identical to SEQ ID NO: 58725

SEQ ID NO: 99434 - DNA, 687 bp, Enterococcus faecalis V583; identical to SEQ ID NO: 58726
  CDS (1)..(687): transl_table=11

SEQ ID NO: 99435 - protein, 228 aa, Enterococcus faecalis V583; identical to SEQ ID NO: 58727

SEQ ID NO: 99436 - DNA, 720 bp, Coxiella burnetii RSA 493; identical to SEQ ID NO: 58728
  CDS (1)..(720): transl_table=11

SEQ ID NO: 99437 - protein, 239 aa, Coxiella burnetii RSA 493; identical to SEQ ID NO: 58729

SEQ ID NO: 99438 - DNA, 696 bp, Nitrosomonas europaea ATCC 19718; identical to SEQ ID NO: 58730
  CDS (1)..(696): transl_table=11

SEQ ID NO: 99439 - protein, 231 aa, Nitrosomonas europaea ATCC 19718; identical to SEQ ID NO: 58731

SEQ ID NO: 99440 - DNA, 693 bp, Helicobacter hepaticus ATCC 51449; identical to SEQ ID NO: 58732
  CDS (1)..(693): transl_table=11

SEQ ID NO: 99441 - protein, 230 aa, Helicobacter hepaticus ATCC 51449; identical to SEQ ID NO: 58733

SEQ ID NO: 99442 - DNA, 660 bp, Wigglesworthia glossinidia endosymbiont of Glossina brevipalpis; identical to SEQ ID NO: 58734
  CDS (1)..(660): transl_table=11

SEQ ID NO: 99443 - protein, 219 aa, Wigglesworthia glossinidia endosymbiont of Glossina brevipalpis; identical to SEQ ID NO: 58735

SEQ ID NO: 99444 - DNA, 711 bp, Candidatus Blochmannia floridanus; identical to SEQ ID NO: 58736
  CDS (1)..(711): transl_table=11

SEQ ID NO: 99445 - protein, 236 aa, Candidatus Blochmannia floridanus; identical to SEQ ID NO: 58737

SEQ ID NO: 99446 - DNA, 711 bp, Bordetella bronchiseptica RB50; identical to SEQ ID NO: 58738
  CDS (1)..(711): transl_table=11

SEQ ID NO: 99447 - protein, 236 aa, Bordetella bronchiseptica RB50; identical to SEQ ID NO: 58739

SEQ ID NO: 99448 - DNA, 690 bp, Chromobacterium violaceum ATCC 12472; identical to SEQ ID NO: 58740
  CDS (1)..(690): transl_table=11

SEQ ID NO: 99449 - protein, 229 aa, Chromobacterium violaceum ATCC 12472; identical to SEQ ID NO: 58741

SEQ ID NO: 99450 - DNA, 717 bp, Wolinella succinogenes DSM 1740; identical to SEQ ID NO: 58742
  CDS (1)..(717): transl_table=11

SEQ ID NO: 99451 - protein, 238 aa, Wolinella succinogenes DSM 1740; identical to SEQ ID NO: 58743

SEQ ID NO: 99452 - DNA, 711 bp, Photorhabdus luminescens subsp. laumondii TTO1; identical to SEQ ID NO: 58744
  CDS (1)..(711): transl_table=11

SEQ ID NO: 99453 - protein, 236 aa, Photorhabdus luminescens subsp. laumondii TTO1; identical to SEQ ID NO: 58745

SEQ ID NO: 99454 - DNA, 669 bp, Vibrio vulnificus YJ016; identical to SEQ ID NO: 58746
  CDS (1)..(669): transl_table=11

SEQ ID NO: 99455 - protein, 222 aa, Vibrio vulnificus YJ016; identical to SEQ ID NO: 58747

SEQ ID NO: 99456 - DNA, 792 bp, Rhodopseudomonas palustris CGA009; identical to SEQ ID NO: 58748
  CDS (1)..(792): transl_table=11

SEQ ID NO: 99457 - protein, 263 aa, Rhodopseudomonas palustris CGA009; identical to SEQ ID NO: 58749

SEQ ID NO: 99458 - DNA, 714 bp, Lactobacillus johnsonii NCC 533; identical to SEQ ID NO: 58750
  CDS (1)..(714): transl_table=11

SEQ ID NO: 99459 - protein, 237 aa, Lactobacillus johnsonii NCC 533; identical to SEQ ID NO: 58751

SEQ ID NO: 99460 - DNA, 723 bp, Wolbachia endosymbiont of Drosophila melanogaster; identical to SEQ ID NO: 58752
  CDS (1)..(723): transl_table=11

SEQ ID NO: 99461 - protein, 240 aa, Wolbachia endosymbiont of Drosophila melanogaster; identical to SEQ ID NO: 58753

SEQ ID NO: 99462 - DNA, 864 bp, Neurospora crassa; identical to SEQ ID NO: 58754
  CDS (1)..(864)

SEQ ID NO: 99463 - protein, 287 aa, Neurospora crassa; identical to SEQ ID NO: 58755

SEQ ID NO: 99464 - DNA, 849 bp, Magnaporthe grisea 70-15; identical to SEQ ID NO: 58756
  CDS (1)..(849)

SEQ ID NO: 99465 - protein, 282 aa, Magnaporthe grisea 70-15; identical to SEQ ID NO: 58757

SEQ ID NO: 99466 - DNA, 831 bp, Gibberella zeae PH-1; identical to SEQ ID NO: 58758
  CDS (1)..(831)

SEQ ID NO: 99467 - protein, 276 aa, Gibberella zeae PH-1; identical to SEQ ID NO: 58759

SEQ ID NO: 99468 - DNA, 822 bp, Ustilago maydis 521; identical to SEQ ID NO: 58760
  CDS (1)..(822)

SEQ ID NO: 99469 - protein, 273 aa, Ustilago maydis 521; identical to SEQ ID NO: 58761

SEQ ID NO: 99470 - DNA, 813 bp, Aspergillus nidulans FGSC A4; identical to SEQ ID NO: 58762
  CDS (1)..(813)

SEQ ID NO: 99471 - protein, 270 aa, Aspergillus nidulans FGSC A4; identical to SEQ ID NO: 58763

SEQ ID NO: 99472 - DNA, 555 bp, Oryza sativa (japonica cultivar-group); identical to SEQ ID NO: 58764
  CDS (1)..(555)

SEQ ID NO: 99473 - protein, 184 aa, Oryza sativa (japonica cultivar-group); identical to SEQ ID NO: 58765

SEQ ID NO: 99474 - DNA, 690 bp, Oryza sativa (japonica cultivar-group); identical to SEQ ID NO: 58766
  CDS (1)..(690)

SEQ ID NO: 99475 - protein, 229 aa, Oryza sativa (japonica cultivar-group); identical to SEQ ID NO: 58767

SEQ ID NO: 99476 - DNA, 672 bp, Oryza sativa (japonica cultivar-group); identical to SEQ ID NO: 58768
  CDS (1)..(672)

SEQ ID NO: 99477 - protein, 223 aa, Oryza sativa (japonica cultivar-group); identical to SEQ ID NO: 58769

SEQ ID NO: 99478 - DNA, 735 bp, Oryza sativa (japonica cultivar-group); identical to SEQ ID NO: 58770
  CDS (1)..(735)

SEQ ID NO: 99479 - protein, 244 aa, Oryza sativa (japonica cultivar-group); identical to SEQ ID NO: 58771

SEQ ID NO: 99480 - DNA, 786 bp, Yarrowia lipolytica CLIB99; identical to SEQ ID NO: 58772
  CDS (1)..(786)

SEQ ID NO: 99481 - protein, 261 aa, Yarrowia lipolytica CLIB99; identical to SEQ ID NO: 58773

SEQ ID NO: 99482 - DNA, 657 bp, Pan troglodytes; identical to SEQ ID NO: 58774
  CDS (1)..(657)

SEQ ID NO: 99483 - protein, 218 aa, Pan troglodytes; identical to SEQ ID NO: 58775

SEQ ID NO: 99484 - DNA, 702 bp, Desulfovibrio vulgaris subsp. vulgaris str. Hildenborough; identical to SEQ ID NO: 58776
  CDS (1)..(702): transl_table=11

SEQ ID NO: 99485 - protein, 233 aa, Desulfovibrio vulgaris subsp. vulgaris str. Hildenborough; identical to SEQ ID NO: 58777

SEQ ID NO: 99486 - DNA, 774 bp, Bartonella quintana str. Toulouse; identical to SEQ ID NO: 58778
  CDS (1)..(774): transl_table=11

SEQ ID NO: 99487 - protein, 257 aa, Bartonella quintana str. Toulouse; identical to SEQ ID NO: 58779

SEQ ID NO: 99488 - DNA, 774 bp, Bartonella henselae str. Houston-1; identical to SEQ ID NO: 58780
  CDS (1)..(774): transl_table=11

SEQ ID NO: 99489 - protein, 257 aa, Bartonella henselae str. Houston-1; identical to SEQ ID NO: 58781

SEQ ID NO: 99490 - DNA, 660 bp, Erwinia carotovora subsp. atroseptica SCRI1043; identical to SEQ ID NO: 58782
  CDS (1)..(660)

SEQ ID NO: 99491 - protein, 219 aa, Erwinia carotovora subsp. atroseptica SCRI1043; identical to SEQ ID NO: 58783

SEQ ID NO: 99492 - DNA, 708 bp, Erwinia carotovora subsp. atroseptica SCRI1043; identical to SEQ ID NO: 58784
  CDS (1)..(708)

SEQ ID NO: 99493 - protein, 235 aa, Erwinia carotovora subsp. atroseptica SCRI1043; identical to SEQ ID NO: 58785

SEQ ID NO: 99494 - DNA, 723 bp, Desulfotalea psychrophila LSv54; identical to SEQ ID NO: 58786
  CDS (1)..(723): transl_table=11

SEQ ID NO: 99495 - protein, 240 aa, Desulfotalea psychrophila LSv54; identical to SEQ ID NO: 58787

SEQ ID NO: 99496 - DNA, 711 bp, Yersinia pseudotuberculosis IP 32953; identical to SEQ ID NO: 58788
  CDS (1)..(711): transl_table=11

SEQ ID NO: 99497 - protein, 236 aa, Yersinia pseudotuberculosis IP 32953; identical to SEQ ID NO: 58789

SEQ ID NO: 99498 - DNA, 699 bp, Borrelia garinii PBi; identical to SEQ ID NO: 58790
  CDS (1)..(699): transl_table=11

SEQ ID NO: 99499 - protein, 232 aa, Borrelia garinii PBi; identical to SEQ ID NO: 58791

SEQ ID NO: 99500 - DNA, 672 bp, Mannheimia succiniciproducens MBEL55E; identical to SEQ ID NO: 58792
  CDS (1)..(672): transl_table=11

SEQ ID NO: 99501 - protein, 223 aa, Mannheimia succiniciproducens MBEL55E; identical to SEQ ID NO: 58793

SEQ ID NO: 99502 - DNA, 675 bp, Legionella pneumophila subsp. pneumophila str. Philadelphia 1; identical to SEQ ID NO: 58794
  CDS (1)..(675): transl_table=11

SEQ ID NO: 99503 - protein, 224 aa, Legionella pneumophila subsp. pneumophila str. Philadelphia 1; identical to SEQ ID NO: 58795

SEQ ID NO: 99504 - DNA, 714 bp, Burkholderia pseudomallei K96243; identical to SEQ ID NO: 58796
  CDS (1)..(714): transl_table=11

SEQ ID NO: 99505 - protein, 237 aa, Burkholderia pseudomallei K96243; identical to SEQ ID NO: 58797

SEQ ID NO: 99506 - DNA, 678 bp, Methylococcus capsulatus str. Bath; identical to SEQ ID NO: 58798
  CDS (1)..(678): transl_table=11

SEQ ID NO: 99507 - protein, 225 aa, Methylococcus capsulatus str. Bath; identical to SEQ ID NO: 58799

SEQ ID NO: 99508 - DNA, 666 bp, Photobacterium profundum SS9; identical to SEQ ID NO: 58800
  CDS (1)..(666): transl_table=11

SEQ ID NO: 99509 - protein, 221 aa, Photobacterium profundum SS9; identical to SEQ ID NO: 58801

SEQ ID NO: 99510 - DNA, 690 bp, Streptococcus thermophilus CNRZ1066; identical to SEQ ID NO: 58802
  CDS (1)..(690): transl_table=11

SEQ ID NO: 99511 - protein, 229 aa, Streptococcus thermophilus CNRZ1066; identical to SEQ ID NO: 58803

SEQ ID NO: 99512 - DNA, 639 bp, Geobacillus kaustophilus HTA426; identical to SEQ ID NO: 58804
  CDS (1)..(639): transl_table=11

SEQ ID NO: 99513 - protein, 212 aa, Geobacillus kaustophilus HTA426; identical to SEQ ID NO: 58805

SEQ ID NO: 99514 - DNA, 705 bp, Salmonella enterica subsp. enterica serovar Paratypi A str. ATCC; identical to SEQ ID NO: 58806
  CDS (1)..(705): transl_table=11

SEQ ID NO: 99515 - protein, 234 aa, Salmonella enterica subsp. enterica serovar Paratypi A str. ATCC; identical to SEQ ID NO: 58807

SEQ ID NO: 99516 - DNA, 702 bp, Anaplasma marginale str. St. Maries; identical to SEQ ID NO: 58808
  CDS (1)..(702): transl_table=11

SEQ ID NO: 99517 - protein, 233 aa, Anaplasma marginale str. St. Maries; identical to SEQ ID NO: 58809

SEQ ID NO: 99518 - DNA, 669 bp, Idiomarina loihiensis L2TR; identical to SEQ ID NO: 58810
  CDS (1)..(669): transl_table=11

SEQ ID NO: 99519 - protein, 222 aa, Idiomarina loihiensis L2TR; identical to SEQ ID NO: 58811

SEQ ID NO: 99520 - DNA, 666 bp, Azoarcus sp. EbN1; identical to SEQ ID NO: 58812
  CDS (1)..(666): transl_table=11

SEQ ID NO: 99521 - protein, 221 aa, Azoarcus sp. EbN1; identical to SEQ ID NO: 58813

SEQ ID NO: 99522 - DNA, 705 bp, Zymomonas mobilis subsp. mobilis ZM4; identical to SEQ ID NO: 58814
  CDS (1)..(705): transl_table=11

SEQ ID NO: 99523 - protein, 234 aa, Zymomonas mobilis subsp. mobilis ZM4; identical to SEQ ID NO: 58815

SEQ ID NO: 99524 - DNA, 687 bp, Francisella tularensis subsp. tularensis Schu 4; identical to SEQ ID NO: 58816
  CDS (1)..(687): transl_table=11

SEQ ID NO: 99525 - protein, 228 aa, Francisella tularensis subsp. tularensis Schu 4; identical to SEQ ID NO: 58817

SEQ ID NO: 99526 - DNA, 705 bp, Ehrlichia ruminantium str. Welgevonden; identical to SEQ ID NO: 58818
  CDS (1)..(705): transl_table=11

SEQ ID NO: 99527 - protein, 234 aa, Ehrlichia ruminantium str. Welgevonden; identical to SEQ ID NO: 58819

SEQ ID NO: 99528 - DNA, 714 bp, Rhodobacter sphaeroides 2.4.1; identical to SEQ ID NO: 58820
  CDS (1)..(714)

SEQ ID NO: 99529 - protein, 237 aa, Rhodobacter sphaeroides 2.4.1; identical to SEQ ID NO: 58821

SEQ ID NO: 99530 - DNA, 732 bp, Lactobacillus gasseri; identical to SEQ ID NO: 58822
  CDS (1)..(732)

SEQ ID NO: 99531 - protein, 243 aa, Lactobacillus gasseri; identical to SEQ ID NO: 58823

SEQ ID NO: 99532 - DNA, 768 bp, Magnetospirillum magnetotacticum MS-1; identical to SEQ ID NO: 58824
  CDS (1)..(768)

SEQ ID NO: 99533 - protein, 255 aa, Magnetospirillum magnetotacticum MS-1; identical to SEQ ID NO: 58825

SEQ ID NO: 99534 - DNA, 696 bp, Magnetospirillum magnetotacticum MS-1; identical to SEQ ID NO: 58826
  CDS (1)..(696)

SEQ ID NO: 99535 - protein, 231 aa, Magnetospirillum magnetotacticum MS-1; identical to SEQ ID NO: 58827

SEQ ID NO: 99536 - DNA, 720 bp, Leuconostoc mesenteroides subsp. mesenteroides ATCC 8293; identical to SEQ ID NO: 58828
  CDS (1)..(720)

SEQ ID NO: 99537 - protein, 239 aa, Leuconostoc mesenteroides subsp. mesenteroides ATCC 8293; identical to SEQ ID NO: 58829

SEQ ID NO: 99538 - DNA, 672 bp, Azotobacter vinelandii; identical to SEQ ID NO: 58830
  CDS (1)..(672)

SEQ ID NO: 99539 - protein, 223 aa, Azotobacter vinelandii; identical to SEQ ID NO: 58831

SEQ ID NO: 99540 - DNA, 702 bp, Desulfovibrio desulfuricans G20; identical to SEQ ID NO: 58832
  CDS (1)..(702)

SEQ ID NO: 99541 - protein, 233 aa, Desulfovibrio desulfuricans G20; identical to SEQ ID NO: 58833

SEQ ID NO: 99542 - DNA, 711 bp, Rickettsia sibirica 246; identical to SEQ ID NO: 58834
  CDS (1)..(711): transl_table=11

SEQ ID NO: 99543 - protein, 236 aa, Rickettsia sibirica 246; identical to SEQ ID NO: 58835

SEQ ID NO: 99544 - DNA, 693 bp, Dechloromonas aromatica RCB; identical to SEQ ID NO: 58836
  CDS (1)..(693)

SEQ ID NO: 99545 - protein, 230 aa, Dechloromonas aromatica RCB; identical to SEQ ID NO: 58837

SEQ ID NO: 99546 - DNA, 711 bp, Rickettsia rickettsii; identical to SEQ ID NO: 58838
  CDS (1)..(711)

SEQ ID NO: 99547 - protein, 236 aa, Rickettsia rickettsii; identical to SEQ ID NO: 58839

SEQ ID NO: 99548 - DNA, 702 bp, Ralstonia eutropha JMP134; identical to SEQ ID NO: 58840
  CDS (1)..(702)

SEQ ID NO: 99549 - protein, 233 aa, Ralstonia eutropha JMP134; identical to SEQ ID NO: 58841

SEQ ID NO: 99550 - DNA, 606 bp, Methylobacillus flagellatus KT; identical to SEQ ID NO: 58842
  CDS (1)..(606)

SEQ ID NO: 99551 - protein, 201 aa, Methylobacillus flagellatus KT; identical to SEQ ID NO: 58843

SEQ ID NO: 99552 - DNA, 645 bp, Exiguobacterium sp. 255-15; identical to SEQ ID NO: 58844
  CDS (1)..(645)

SEQ ID NO: 99553 - protein, 214 aa, Exiguobacterium sp. 255-15; identical to SEQ ID NO: 58845

SEQ ID NO: 99554 - DNA, 705 bp, Ehrlichia canis str. Jake; identical to SEQ ID NO: 58846
  CDS (1)..(705)

SEQ ID NO: 99555 - protein, 234 aa, Ehrlichia canis str. Jake; identical to SEQ ID NO: 58847

SEQ ID NO: 99556 - DNA, 699 bp, Burkholderia cepacia R18194; identical to SEQ ID NO: 58848
  CDS (1)..(699)

SEQ ID NO: 99557 - protein, 232 aa, Burkholderia cepacia R18194; identical to SEQ ID NO: 58849

SEQ ID NO: 99558 - DNA, 831 bp, Burkholderia cepacia R1808; identical to SEQ ID NO: 58850
  CDS (1)..(831)

SEQ ID NO: 99559 - protein, 276 aa, Burkholderia cepacia R1808; identical to SEQ ID NO: 58851

SEQ ID NO: 99560 - DNA, 696 bp, Rubrivivax gelatinosus PM1; identical to SEQ ID NO: 58852
  CDS (1)..(696)

SEQ ID NO: 99561 - protein, 231 aa, Rubrivivax gelatinosus PM1; identical to SEQ ID NO: 58853

SEQ ID NO: 99562 - DNA, 609 bp, Rubrivivax gelatinosus PM1; identical to SEQ ID NO: 58854
  CDS (1)..(609)

SEQ ID NO: 99563 - protein, 202 aa, Rubrivivax gelatinosus PM1; identical to SEQ ID NO: 58855

SEQ ID NO: 99564 - DNA, 753 bp, Rhodospirillum rubrum; identical to SEQ ID NO: 58856
  CDS (1)..(753)

SEQ ID NO: 99565 - protein, 250 aa, Rhodospirillum rubrum; identical to SEQ ID NO: 58857

SEQ ID NO: 99566 - DNA, 708 bp, Ralstonia metallidurans CH34; identical to SEQ ID NO: 58858
  CDS (1)..(708)

SEQ ID NO: 99567 - protein, 235 aa, Ralstonia metallidurans CH34; identical to SEQ ID NO: 58859

SEQ ID NO: 99568 - DNA, 699 bp, Burkholderia fungorum LB400; identical to SEQ ID NO: 58860
  CDS (1)..(699)

SEQ ID NO: 99569 - protein, 232 aa, Burkholderia fungorum LB400; identical to SEQ ID NO: 58861

SEQ ID NO: 99570 - DNA, 705 bp, Magnetococcus sp. MC-1; identical to SEQ ID NO: 58862
  CDS (1)..(705)

SEQ ID NO: 99571 - protein, 234 aa, Magnetococcus sp. MC-1; identical to SEQ ID NO: 58863

SEQ ID NO: 99572 - DNA, 744 bp, Novosphingobium aromaticivorans DSM 12444; identical to SEQ ID NO: 58864
  CDS (1)..(744)

SEQ ID NO: 99573 - protein, 247 aa, Novosphingobium aromaticivorans DSM 12444; identical to SEQ ID NO: 58865

SEQ ID NO: 99574 - DNA, 627 bp, Microbulbifer degradans 2-40; identical to SEQ ID NO: 58866
  CDS (1)..(627)

SEQ ID NO: 99575 - protein, 208 aa, Microbulbifer degradans 2-40; identical to SEQ ID NO: 58867

SEQ ID NO: 99576 - DNA, 639 bp, Pediococcus pentosaceus ATCC 25745; identical to SEQ ID NO: 58868
  CDS (1)..(639)

SEQ ID NO: 99577 - protein, 212 aa, Pediococcus pentosaceus ATCC 25745; identical to SEQ ID NO: 58869

SEQ ID NO: 99578 - DNA, 666 bp, Thiobacillus denitrificans ATCC 25259; identical to SEQ ID NO: 58870
  CDS (1)..(666)

SEQ ID NO: 99579 - protein, 221 aa, Thiobacillus denitrificans ATCC 25259; identical to SEQ ID NO: 58871

SEQ ID NO: 99580 - DNA, 711 bp, Rickettsia akari str. Hartford; identical to SEQ ID NO: 58872
  CDS (1)..(711)

SEQ ID NO: 99581 - protein, 236 aa, Rickettsia akari str. Hartford; identical to SEQ ID NO: 58873

SEQ ID NO: 99582 - DNA, 690 bp, Polaromonas sp. JS666; identical to SEQ ID NO: 58874
  CDS (1)..(690)

SEQ ID NO: 99583 - protein, 229 aa, Polaromonas sp. JS666; identical to SEQ ID NO: 58875

SEQ ID NO: 99584 - DNA, 702 bp, Campylobacter lari RM2100; identical to SEQ ID NO: 58876
  CDS (1)..(702): transl_table=11

SEQ ID NO: 99585 - protein, 233 aa, Campylobacter lari RM2100; identical to SEQ ID NO: 58877

SEQ ID NO: 99586 - DNA, 633 bp, Cowpox virus; identical to SEQ ID NO: 58878
  CDS (1)..(633)

SEQ ID NO: 99587 - protein, 210 aa, Cowpox virus; identical to SEQ ID NO: 58879

SEQ ID NO: 99588 - DNA, 711 bp, Brachydanio rerio; identical to SEQ ID NO: 58880
  CDS (1)..(711)

SEQ ID NO: 99589 - protein, 236 aa, Brachydanio rerio; identical to SEQ ID NO: 58881

SEQ ID NO: 99590 - DNA, 1008 bp, Xenopus laevis; identical to SEQ ID NO: 58882
  CDS (1)..(1008)

SEQ ID NO: 99591 - protein, 335 aa, Xenopus laevis; identical to SEQ ID NO: 58883

SEQ ID NO: 99592 - DNA, 795 bp, Oryza sativa; identical to SEQ ID NO: 58884
  CDS (1)..(795)

SEQ ID NO: 99593 - protein, 264 aa, Oryza sativa; identical to SEQ ID NO: 58885

SEQ ID NO: 99594 - DNA, 714 bp, Xenopus laevis; identical to SEQ ID NO: 58886
  CDS (1)..(714)

SEQ ID NO: 99595 - protein, 237 aa, Xenopus laevis; identical to SEQ ID NO: 58887

SEQ ID NO: 99596 - DNA, 726 bp, Oryza sativa; identical to SEQ ID NO: 58888
  CDS (1)..(726)

SEQ ID NO: 99597 - protein, 241 aa, Oryza sativa; identical to SEQ ID NO: 58889

SEQ ID NO: 99598 - DNA, 747 bp, Chlamydomonas reinhardtii; identical to SEQ ID NO: 58890
  CDS (1)..(747)

SEQ ID NO: 99599 - protein, 248 aa, Chlamydomonas reinhardtii; identical to SEQ ID NO: 58891

SEQ ID NO: 99600 - DNA, 747 bp, Lycopersicon esculentum; identical to SEQ ID NO: 58892
  CDS (1)..(747)

SEQ ID NO: 99601 - protein, 248 aa, Lycopersicon esculentum; identical to SEQ ID NO: 58893

SEQ ID NO: 99602 - DNA, 744 bp, Brassica oleracea; identical to SEQ ID NO: 58894
  CDS (1)..(744)

SEQ ID NO: 99603 - protein, 247 aa, Brassica oleracea; identical to SEQ ID NO: 58895

SEQ ID NO: 99604 - DNA, 741 bp, Cryptosporidium parvum; identical to SEQ ID NO: 58896
  CDS (1)..(741)

SEQ ID NO: 99605 - protein, 246 aa, Cryptosporidium parvum; identical to SEQ ID NO: 58897

SEQ ID NO: 99606 - DNA, 714 bp, Xenopus laevis; identical to SEQ ID NO: 58898
  CDS (1)..(714)

SEQ ID NO: 99607 - protein, 237 aa, Xenopus laevis; identical to SEQ ID NO: 58899

SEQ ID NO: 99608 - DNA, 660 bp, Schistosoma japonicum; identical to SEQ ID NO: 58900
  CDS (1)..(660)

SEQ ID NO: 99609 - protein, 219 aa, Schistosoma japonicum; identical to SEQ ID NO: 58901

SEQ ID NO: 99610 - DNA, 744 bp, Arabidopsis thaliana; identical to SEQ ID NO: 58902
  CDS (1)..(744)

SEQ ID NO: 99611 - protein, 247 aa, Arabidopsis thaliana; identical to SEQ ID NO: 58903

SEQ ID NO: 99612 - DNA, 714 bp, Camelpox virus; identical to SEQ ID NO: 58904
  CDS (1)..(714)

SEQ ID NO: 99613 - protein, 237 aa, Camelpox virus; identical to SEQ ID NO: 58905

SEQ ID NO: 99614 - DNA, 741 bp, Brassica oleracea; identical to SEQ ID NO: 58906
  CDS (1)..(741)

SEQ ID NO: 99615 - protein, 246 aa, Brassica oleracea; identical to SEQ ID NO: 58907

SEQ ID NO: 99616 - DNA, 750 bp, Nicotiana tabacum; identical to SEQ ID NO: 58908
  CDS (1)..(750)

SEQ ID NO: 99617 - protein, 249 aa, Nicotiana tabacum; identical to SEQ ID NO: 58909

SEQ ID NO: 99618 - DNA, 744 bp, Hordeum vulgare; identical to SEQ ID NO: 58910
  CDS (1)..(744)

SEQ ID NO: 99619 - protein, 247 aa, Hordeum vulgare; identical to SEQ ID NO: 58911

SEQ ID NO: 99620 - DNA, 744 bp, Arabidopsis thaliana; identical to SEQ ID NO: 58912
  CDS (1)..(744)

SEQ ID NO: 99621 - protein, 247 aa, Arabidopsis thaliana; identical to SEQ ID NO: 58913

SEQ ID NO: 99622 - DNA, 750 bp, Oryza sativa; identical to SEQ ID NO: 58914
  CDS (1)..(750)

SEQ ID NO: 99623 - protein, 249 aa, Oryza sativa; identical to SEQ ID NO: 58915

SEQ ID NO: 99624 - DNA, 714 bp, Paralichthys olivaceus; identical to SEQ ID NO: 58916
  CDS (1)..(714): n means a or g or c or t/u

SEQ ID NO: 99625 - protein, 237 aa, Paralichthys olivaceus; identical to SEQ ID NO: 58917
  misc_feature (187)..(187): Xaa can be Cys or Phe or Ser or Tyr

SEQ ID NO: 99626 - DNA, 663 bp, Haemophilus influenzae; identical to SEQ ID NO: 58918
  CDS (1)..(663): transl_table=11

SEQ ID NO: 99627 - protein, 220 aa, Haemophilus influenzae; identical to SEQ ID NO: 58919

SEQ ID NO: 99628 - DNA, 672 bp, Vibrio cholerae; identical to SEQ ID NO: 58920
  CDS (1)..(672): transl_table=11

SEQ ID NO: 99629 - protein, 223 aa, Vibrio cholerae; identical to SEQ ID NO: 58921

SEQ ID NO: 99630 - DNA, 711 bp, Rickettsia prowazekii; identical to SEQ ID NO: 58922
  CDS (1)..(711): transl_table=11

SEQ ID NO: 99631 - protein, 236 aa, Rickettsia prowazekii; identical to SEQ ID NO: 58923

SEQ ID NO: 99632 - DNA, 696 bp, Campylobacter jejuni; identical to SEQ ID NO: 58924
  CDS (1)..(696): transl_table=11

SEQ ID NO: 99633 - protein, 231 aa, Campylobacter jejuni; identical to SEQ ID NO: 58925

SEQ ID NO: 99634 - DNA, 669 bp, Pseudomonas aeruginosa; identical to SEQ ID NO: 58926
  CDS (1)..(669): transl_table=11

SEQ ID NO: 99635 - protein, 222 aa, Pseudomonas aeruginosa; identical to SEQ ID NO: 58927

SEQ ID NO: 99636 - DNA, 663 bp, Pasteurella multocida; identical to SEQ ID NO: 58928
  CDS (1)..(663): transl_table=11

SEQ ID NO: 99637 - protein, 220 aa, Pasteurella multocida; identical to SEQ ID NO: 58929

SEQ ID NO: 99638 - DNA, 699 bp, Borrelia burgdorferi; identical to SEQ ID NO: 58930
  CDS (1)..(699): transl_table=11

SEQ ID NO: 99639 - protein, 232 aa, Borrelia burgdorferi; identical to SEQ ID NO: 58931

SEQ ID NO: 99640 - DNA, 696 bp, Deinococcus radiodurans; identical to SEQ ID NO: 58932
  CDS (1)..(696): transl_table=11

SEQ ID NO: 99641 - protein, 231 aa, Deinococcus radiodurans; identical to SEQ ID NO: 58933

SEQ ID NO: 99642 - DNA, 693 bp, Helicobacter pylori J99; identical to SEQ ID NO: 58934
  CDS (1)..(693): transl_table=11

SEQ ID NO: 99643 - protein, 230 aa, Helicobacter pylori J99; identical to SEQ ID NO: 58935

SEQ ID NO: 99644 - DNA, 705 bp, Escherichia coli; identical to SEQ ID NO: 58936
  CDS (1)..(705): transl_table=11

SEQ ID NO: 99645 - protein, 234 aa, Escherichia coli; identical to SEQ ID NO: 58937

SEQ ID NO: 99646 - DNA, 705 bp, Lactococcus lactis; identical to SEQ ID NO: 58938
  CDS (1)..(705)

SEQ ID NO: 99647 - protein, 234 aa, Lactococcus lactis; identical to SEQ ID NO: 58939

SEQ ID NO: 99648 - DNA, 809 bp, Mus musculus; identical to SEQ ID NO: 58940
  CDS (22)..(738)

SEQ ID NO: 99649 - protein, 238 aa, Mus musculus; identical to SEQ ID NO: 58941

SEQ ID NO: 99650 - DNA, 25 bp, Primer
atggatcgtattgttagttcttcac

SEQ ID NO: 99651 - DNA, 22 bp, Primer
ttaatcgcggctagcgaagccc

SEQ ID NO: 99652 - protein, 228 aa, consensus; identical to SEQ ID NO: 58944
  MISC_FEATURE (1)..(228): consensus for the disclosure of xaa see table XV

SEQ ID NO: 99653 - DNA, 351 bp, Escherichia coli; identical to SEQ ID NO: 59829
  CDS (1)..(351)

SEQ ID NO: 99654 - protein, 116 aa, Escherichia coli; identical to SEQ ID NO: 59830

SEQ ID NO: 99655 - DNA, 372 bp, Lactobacillus acidophilus NCFM; identical to SEQ ID NO: 59831
  CDS (1)..(372)

SEQ ID NO: 99656 - protein, 123 aa, Lactobacillus acidophilus NCFM; identical to SEQ ID NO: 59832

SEQ ID NO: 99657 - DNA, 348 bp, Borrelia burgdorferi B31; identical to SEQ ID NO: 59833
  CDS (1)..(348): transl_table=11

SEQ ID NO: 99658 - protein, 115 aa, Borrelia burgdorferi B31; identical to SEQ ID NO: 59834

SEQ ID NO: 99659 - DNA, 333 bp, Bacillus halodurans C-125; identical to SEQ ID NO: 59835
  CDS (1)..(333): transl_table=11

SEQ ID NO: 99660 - protein, 110 aa, Bacillus halodurans C-125; identical to SEQ ID NO: 59836

SEQ ID NO: 99661 - DNA, 330 bp, Bacillus halodurans C-125; identical to SEQ ID NO: 59837
  CDS (1)..(330): transl_table=11

SEQ ID NO: 99662 - protein, 109 aa, Bacillus halodurans C-125; identical to SEQ ID NO: 59838

SEQ ID NO: 99663 - DNA, 351 bp, Lactococcus lactis subsp. lactis Il1403; identical to SEQ ID NO: 59839
  CDS (1)..(351): transl_table=11

SEQ ID NO: 99664 - protein, 116 aa, Lactococcus lactis subsp. lactis Il1403; identical to SEQ ID NO: 59840

SEQ ID NO: 99665 - DNA, 336 bp, Streptococcus pyogenes M1 GAS; identical to SEQ ID NO: 59841
  CDS (1)..(336): transl_table=11

SEQ ID NO: 99666 - protein, 111 aa, Streptococcus pyogenes M1 GAS; identical to SEQ ID NO: 59842

SEQ ID NO: 99667 - DNA, 318 bp, Streptococcus pyogenes M1 GAS; identical to SEQ ID NO: 59843
  CDS (1)..(318): transl_table=11

SEQ ID NO: 99668 - protein, 105 aa, Streptococcus pyogenes M1 GAS; identical to SEQ ID NO: 59844

SEQ ID NO: 99669 - DNA, 321 bp, Streptococcus pyogenes M1 GAS; identical to SEQ ID NO: 59845
  CDS (1)..(321): transl_table=11

SEQ ID NO: 99670 - protein, 106 aa, Streptococcus pyogenes M1 GAS; identical to SEQ ID NO: 59846

SEQ ID NO: 99671 - DNA, 321 bp, Streptococcus pneumoniae TIGR4; identical to SEQ ID NO: 59847
  CDS (1)..(321): transl_table=11

SEQ ID NO: 99672 - protein, 106 aa, Streptococcus pneumoniae TIGR4; identical to SEQ ID NO: 59848

SEQ ID NO: 99673 - DNA, 315 bp, Streptococcus pneumoniae TIGR4; identical to SEQ ID NO: 59849
  CDS (1)..(315): transl_table=11

SEQ ID NO: 99674 - protein, 104 aa, Streptococcus pneumoniae TIGR4; identical to SEQ ID NO: 59850

SEQ ID NO: 99675 - DNA, 345 bp, Streptococcus pneumoniae TIGR4; identical to SEQ ID NO: 59851
  CDS (1)..(345): transl_table=11

SEQ ID NO: 99676 - protein, 114 aa, Streptococcus pneumoniae TIGR4; identical to SEQ ID NO: 59852

SEQ ID NO: 99677 - DNA, 327 bp, Streptococcus pneumoniae TIGR4; identical to SEQ ID NO: 59853
  CDS (1)..(327): transl_table=11

SEQ ID NO: 99678 - protein, 108 aa, Streptococcus pneumoniae TIGR4; identical to SEQ ID NO: 59854

SEQ ID NO: 99679 - DNA, 321 bp, Clostridium acetobutylicum ATCC 824; identical to SEQ ID NO: 59855
  CDS (1)..(321): transl_table=11

SEQ ID NO: 99680 - protein, 106 aa, Clostridium acetobutylicum ATCC 824; identical to SEQ ID NO: 59856

SEQ ID NO: 99681 - DNA, 315 bp, Clostridium acetobutylicum ATCC 824; identical to SEQ ID NO: 59857
  CDS (1)..(315): transl_table=11

SEQ ID NO: 99682 - protein, 104 aa, Clostridium acetobutylicum ATCC 824; identical to SEQ ID NO: 59858

SEQ ID NO: 99683 - DNA, 318 bp, Streptococcus pneumoniae R6; identical to SEQ ID NO: 59859
  CDS (1)..(318): transl_table=11

SEQ ID NO: 99684 - protein, 105 aa, Streptococcus pneumoniae R6; identical to SEQ ID NO: 59860

SEQ ID NO: 99685 - DNA, 333 bp, Bacillus subtilis subsp. subtilis str. 168; identical to SEQ ID NO: 59861
  CDS (1)..(333): transl_table=11

SEQ ID NO: 99686 - protein, 110 aa, Bacillus subtilis subsp. subtilis str. 168; identical to SEQ ID NO: 59862

SEQ ID NO: 99687 - DNA, 348 bp, Salmonella typhimurium LT2; identical to SEQ ID NO: 59863
  CDS (1)..(348): transl_table=11

SEQ ID NO: 99688 - protein, 115 aa, Salmonella typhimurium LT2; identical to SEQ ID NO: 59864

SEQ ID NO: 99689 - DNA, 330 bp, Listeria monocytogenes EGD-e; identical to SEQ ID NO: 59865
  CDS (1)..(330): transl_table=11

SEQ ID NO: 99690 - protein, 109 aa, Listeria monocytogenes EGD-e; identical to SEQ ID NO: 59866

SEQ ID NO: 99691 - DNA, 303 bp, Listeria monocytogenes EGD-e; identical to SEQ ID NO: 59867
  CDS (1)..(303): transl_table=11

SEQ ID NO: 99692 - protein, 100 aa, Listeria monocytogenes EGD-e; identical to SEQ ID NO: 59868

SEQ ID NO: 99693 - DNA, 303 bp, Listeria monocytogenes EGD-e; identical to SEQ ID NO: 59869
  CDS (1)..(303): transl_table=11

SEQ ID NO: 99694 - protein, 100 aa, Listeria monocytogenes EGD-e; identical to SEQ ID NO: 59870

SEQ ID NO: 99695 - DNA, 309 bp, Listeria monocytogenes EGD-e; identical to SEQ ID NO: 59871
  CDS (1)..(309): transl_table=11

SEQ ID NO: 99696 - protein, 102 aa, Listeria monocytogenes EGD-e; identical to SEQ ID NO: 59872

SEQ ID NO: 99697 - DNA, 354 bp, Listeria innocua Clip11262; identical to SEQ ID NO: 59873
  CDS (1)..(354): transl_table=11

SEQ ID NO: 99698 - protein, 117 aa, Listeria innocua Clip11262; identical to SEQ ID NO: 59874

SEQ ID NO: 99699 - DNA, 315 bp, Listeria innocua Clip11262; identical to SEQ ID NO: 59875
  CDS (1)..(315): transl_table=11

SEQ ID NO: 99700 - protein, 104 aa, Listeria innocua Clip11262; identical to SEQ ID NO: 59876

SEQ ID NO: 99701 - DNA, 312 bp, Clostridium perfringens str. 13; identical to SEQ ID NO: 59877
  CDS (1)..(312): transl_table=11

SEQ ID NO: 99702 - protein, 103 aa, Clostridium perfringens str. 13; identical to SEQ ID NO: 59878

SEQ ID NO: 99703 - DNA, 336 bp, Streptococcus pyogenes MGAS8232; identical to SEQ ID NO: 59879
  CDS (1)..(336): transl_table=11

SEQ ID NO: 99704 - protein, 111 aa, Streptococcus pyogenes MGAS8232; identical to SEQ ID NO: 59880

SEQ ID NO: 99705 - DNA, 333 bp, Thermoanaerobacter tengcongensis MB4; identical to SEQ ID NO: 59881
  CDS (1)..(333): transl_table=11

SEQ ID NO: 99706 - protein, 110 aa, Thermoanaerobacter tengcongensis MB4; identical to SEQ ID NO: 59882

SEQ ID NO: 99707 - DNA, 318 bp, Thermoanaerobacter tengcongensis MB4; identical to SEQ ID NO: 59883
  CDS (1)..(318): transl_table=11

SEQ ID NO: 99708 - protein, 105 aa, Thermoanaerobacter tengcongensis MB4; identical to SEQ ID NO: 59884

SEQ ID NO: 99709 - DNA, 348 bp, Yersinia pestis KIM; identical to SEQ ID NO: 59885
  CDS (1)..(348): transl_table=11

SEQ ID NO: 99710 - protein, 115 aa, Yersinia pestis KIM; identical to SEQ ID NO: 59886

SEQ ID NO: 99711 - DNA, 324 bp, Streptococcus agalactiae 2603V/R; identical to SEQ ID NO: 59887
  CDS (1)..(324): transl_table=11

SEQ ID NO: 99712 - protein, 107 aa, Streptococcus agalactiae 2603V/R; identical to SEQ ID NO: 59888

SEQ ID NO: 99713 - DNA, 336 bp, Oceanobacillus iheyensis HTE831; identical to SEQ ID NO: 59889
  CDS (1)..(336): transl_table=11

SEQ ID NO: 99714 - protein, 111 aa, Oceanobacillus iheyensis HTE831; identical to SEQ ID NO: 59890

SEQ ID NO: 99715 - DNA, 312 bp, Oceanobacillus iheyensis HTE831; identical to SEQ ID NO: 59891
  CDS (1)..(312): transl_table=11

SEQ ID NO: 99716 - protein, 103 aa, Oceanobacillus iheyensis HTE831; identical to SEQ ID NO: 59892

SEQ ID NO: 99717 - DNA, 312 bp, Streptococcus mutans UA159; identical to SEQ ID NO: 59893
  CDS (1)..(312): transl_table=11

SEQ ID NO: 99718 - protein, 103 aa, Streptococcus mutans UA159; identical to SEQ ID NO: 59894

SEQ ID NO: 99719 - DNA, 309 bp, Vibrio vulnificus CMCP6; identical to SEQ ID NO: 59895
  CDS (1)..(309): transl_table=11

SEQ ID NO: 99720 - protein, 102 aa, Vibrio vulnificus CMCP6; identical to SEQ ID NO: 59896

SEQ ID NO: 99721 - DNA, 315 bp, Staphylococcus epidermidis ATCC 12228; identical to SEQ ID NO: 59897
  CDS (1)..(315): transl_table=11

SEQ ID NO: 99722 - protein, 104 aa, Staphylococcus epidermidis ATCC 12228; identical to SEQ ID NO: 59898

SEQ ID NO: 99723 - DNA, 339 bp, Lactobacillus plantarum WCFS1; identical to SEQ ID NO: 59899
  CDS (1)..(339): transl_table=11

SEQ ID NO: 99724 - protein, 112 aa, Lactobacillus plantarum WCFS1; identical to SEQ ID NO: 59900

SEQ ID NO: 99725 - DNA, 348 bp, Lactobacillus plantarum WCFS1; identical to SEQ ID NO: 59901
  CDS (1)..(348): transl_table=11

SEQ ID NO: 99726 - protein, 115 aa, Lactobacillus plantarum WCFS1; identical to SEQ ID NO: 59902

SEQ ID NO: 99727 - DNA, 312 bp, Vibrio parahaemolyticus RIMD 2210633; identical to SEQ ID NO: 59903
  CDS (1)..(312): transl_table=11

SEQ ID NO: 99728 - protein, 103 aa, Vibrio parahaemolyticus RIMD 2210633; identical to SEQ ID NO: 59904

SEQ ID NO: 99729 - DNA, 336 bp, Streptococcus pyogenes SSI-1; identical to SEQ ID NO: 59905
  CDS (1)..(336): transl_table=11

SEQ ID NO: 99730 - protein, 111 aa, Streptococcus pyogenes SSI-1; identical to SEQ ID NO: 59906

SEQ ID NO: 99731 - DNA, 321 bp, Enterococcus faecalis V583; identical to SEQ ID NO: 59907
  CDS (1)..(321): transl_table=11

SEQ ID NO: 99732 - protein, 106 aa, Enterococcus faecalis V583; identical to SEQ ID NO: 59908

SEQ ID NO: 99733 - DNA, 324 bp, Bacillus cereus ATCC 14579; identical to SEQ ID NO: 59909
  CDS (1)..(324): transl_table=11

SEQ ID NO: 99734 - protein, 107 aa, Bacillus cereus ATCC 14579; identical to SEQ ID NO: 59910

SEQ ID NO: 99735 - DNA, 318 bp, Bacillus cereus ATCC 14579; identical to SEQ ID NO: 59911
  CDS (1)..(318): transl_table=11

SEQ ID NO: 99736 - protein, 105 aa, Bacillus cereus ATCC 14579; identical to SEQ ID NO: 59912

SEQ ID NO: 99737 - DNA, 360 bp, Photorhabdus luminescens subsp. laumondii TTO1; identical to SEQ ID NO: 59913
  CDS (1)..(360): transl_table=11

SEQ ID NO: 99738 - protein, 119 aa, Photorhabdus luminescens subsp. laumondii TTO1; identical to SEQ ID NO: 59914

SEQ ID NO: 99739 - DNA, 327 bp, Lactobacillus johnsonii NCC 533; identical to SEQ ID NO: 59915
  CDS (1)..(327): transl_table=11

SEQ ID NO: 99740 - protein, 108 aa, Lactobacillus johnsonii NCC 533; identical to SEQ ID NO: 59916

SEQ ID NO: 99741 - DNA, 321 bp, Bacillus cereus ATCC 10987; identical to SEQ ID NO: 59917
  CDS (1)..(321): transl_table=11

SEQ ID NO: 99742 - protein, 106 aa, Bacillus cereus ATCC 10987; identical to SEQ ID NO: 59918

SEQ ID NO: 99743 - DNA, 351 bp, Listeria monocytogenes str. 4b F2365; identical to SEQ ID NO: 59919
  CDS (1)..(351): transl_table=11

SEQ ID NO: 99744 - protein, 116 aa, Listeria monocytogenes str. 4b F2365; identical to SEQ ID NO: 59920

SEQ ID NO: 99745 - DNA, 351 bp, Listeria monocytogenes str. 4b F2365; identical to SEQ ID NO: 59921
  CDS (1)..(351): transl_table=11

SEQ ID NO: 99746 - protein, 116 aa, Listeria monocytogenes str. 4b F2365; identical to SEQ ID NO: 59922

SEQ ID NO: 99747 - DNA, 309 bp, Listeria monocytogenes str. 4b F2365; identical to SEQ ID NO: 59923
  CDS (1)..(309): transl_table=11

SEQ ID NO: 99748 - protein, 102 aa, Listeria monocytogenes str. 4b F2365; identical to SEQ ID NO: 59924

SEQ ID NO: 99749 - DNA, 309 bp, Listeria monocytogenes str. 4b F2365; identical to SEQ ID NO: 59925
  CDS (1)..(309): transl_table=11

SEQ ID NO: 99750 - protein, 102 aa, Listeria monocytogenes str. 4b F2365; identical to SEQ ID NO: 59926

SEQ ID NO: 99751 - DNA, 321 bp, Bacillus thuringiensis serovar konkukian str. 97-27; identical to SEQ ID NO: 59927
  CDS (1)..(321): transl_table=11

SEQ ID NO: 99752 - protein, 106 aa, Bacillus thuringiensis serovar konkukian str. 97-27; identical to SEQ ID NO: 59928

SEQ ID NO: 99753 - DNA, 309 bp, Erwinia carotovora subsp. atroseptica SCRI1043; identical to SEQ ID NO: 59929
  CDS (1)..(309)

SEQ ID NO: 99754 - protein, 102 aa, Erwinia carotovora subsp. atroseptica SCRI1043; identical to SEQ ID NO: 59930

SEQ ID NO: 99755 - DNA, 324 bp, Erwinia carotovora subsp. atroseptica SCRI1043; identical to SEQ ID NO: 59931
  CDS (1)..(324)

SEQ ID NO: 99756 - protein, 107 aa, Erwinia carotovora subsp. atroseptica SCRI1043; identical to SEQ ID NO: 59932

SEQ ID NO: 99757 - DNA, 345 bp, Erwinia carotovora subsp. atroseptica SCRI1043; identical to SEQ ID NO: 59933
  CDS (1)..(345)

SEQ ID NO: 99758 - protein, 114 aa, Erwinia carotovora subsp. atroseptica SCRI1043; identical to SEQ ID NO: 59934

SEQ ID NO: 99759 - DNA, 348 bp, Erwinia carotovora subsp. atroseptica SCRI1043; identical to SEQ ID NO: 59935
  CDS (1)..(348)

SEQ ID NO: 99760 - protein, 115 aa, Erwinia carotovora subsp. atroseptica SCRI1043; identical to SEQ ID NO: 59936

SEQ ID NO: 99761 - DNA, 321 bp, Propionibacterium acnes KPA171202; identical to SEQ ID NO: 59937
  CDS (1)..(321): transl_table=11

SEQ ID NO: 99762 - protein, 106 aa, Propionibacterium acnes KPA171202; identical to SEQ ID NO: 59938

SEQ ID NO: 99763 - DNA, 348 bp, Borrelia garinii PBi; identical to SEQ ID NO: 59939
  CDS (1)..(348): transl_table=11

SEQ ID NO: 99764 - protein, 115 aa, Borrelia garinii PBi; identical to SEQ ID NO: 59940

SEQ ID NO: 99765 - DNA, 348 bp, Symbiobacterium thermophilum IAM 14863; identical to SEQ ID NO: 59941
  CDS (1)..(348): transl_table=11

SEQ ID NO: 99766 - protein, 115 aa, Symbiobacterium thermophilum IAM 14863; identical to SEQ ID NO: 59942

SEQ ID NO: 99767 - DNA, 342 bp, Bacillus licheniformis ATCC 14580; identical to SEQ ID NO: 59943
  CDS (1)..(342): transl_table=11

SEQ ID NO: 99768 - protein, 113 aa, Bacillus licheniformis ATCC 14580; identical to SEQ ID NO: 59944

SEQ ID NO: 99769 - DNA, 324 bp, Bacillus cereus ZK; identical to SEQ ID NO: 59945
  CDS (1)..(324): transl_table=11

SEQ ID NO: 99770 - protein, 107 aa, Bacillus cereus ZK; identical to SEQ ID NO: 59946

SEQ ID NO: 99771 - DNA, 333 bp, Bacillus licheniformis ATCC 14580; identical to SEQ ID NO: 59947
  CDS (1)..(333): transl_table=11

SEQ ID NO: 99772 - protein, 110 aa, Bacillus licheniformis ATCC 14580; identical to SEQ ID NO: 59948

SEQ ID NO: 99773 - DNA, 330 bp, Bacillus licheniformis ATCC 14580; identical to SEQ ID NO: 59949
  CDS (1)..(330): transl_table=11

SEQ ID NO: 99774 - protein, 109 aa, Bacillus licheniformis ATCC 14580; identical to SEQ ID NO: 59950

SEQ ID NO: 99775 - DNA, 339 bp, Photobacterium profundum SS9; identical to SEQ ID NO: 59951
  CDS (1)..(339): transl_table=11

SEQ ID NO: 99776 - protein, 112 aa, Photobacterium profundum SS9; identical to SEQ ID NO: 59952

SEQ ID NO: 99777 - DNA, 312 bp, Photobacterium profundum SS9; identical to SEQ ID NO: 59953
  CDS (1)..(312): transl_table=11

SEQ ID NO: 99778 - protein, 103 aa, Photobacterium profundum SS9; identical to SEQ ID NO: 59954

SEQ ID NO: 99779 - DNA, 333 bp, Geobacillus kaustophilus HTA426; identical to SEQ ID NO: 59955
  CDS (1)..(333): transl_table=11

SEQ ID NO: 99780 - protein, 110 aa, Geobacillus kaustophilus HTA426; identical to SEQ ID NO: 59956

SEQ ID NO: 99781 - DNA, 336 bp, Bacillus clausii KSM-K16; identical to SEQ ID NO: 59957
  CDS (1)..(336): transl_table=11

SEQ ID NO: 99782 - protein, 111 aa, Bacillus clausii KSM-K16; identical to SEQ ID NO: 59958

SEQ ID NO: 99783 - DNA, 357 bp, Lactobacillus gasseri; identical to SEQ ID NO: 59959
  CDS (1)..(357)

SEQ ID NO: 99784 - protein, 118 aa, Lactobacillus gasseri; identical to SEQ ID NO: 59960

SEQ ID NO: 99785 - DNA, 360 bp, Lactobacillus gasseri; identical to SEQ ID NO: 59961
  CDS (1)..(360)

SEQ ID NO: 99786 - protein, 119 aa, Lactobacillus gasseri; identical to SEQ ID NO: 59962

SEQ ID NO: 99787 - DNA, 336 bp, Leuconostoc mesenteroides subsp. mesenteroides ATCC 8293; identical to SEQ ID NO: 59963
  CDS (1)..(336)

SEQ ID NO: 99788 - protein, 111 aa, Leuconostoc mesenteroides subsp. mesenteroides ATCC 8293; identical to SEQ ID NO: 59964

SEQ ID NO: 99789 - DNA, 360 bp, Leuconostoc mesenteroides subsp. mesenteroides ATCC 8293; identical to SEQ ID NO: 59965
  CDS (1)..(360)

SEQ ID NO: 99790 - protein, 119 aa, Leuconostoc mesenteroides subsp. mesenteroides ATCC 8293; identical to SEQ ID NO: 59966

SEQ ID NO: 99791 - DNA, 309 bp, Haemophilus somnus 2336; identical to SEQ ID NO: 59967
  CDS (1)..(309)

SEQ ID NO: 99792 - protein, 102 aa, Haemophilus somnus 2336; identical to SEQ ID NO: 59968

SEQ ID NO: 99793 - DNA, 315 bp, Listeria monocytogenes str. 1/2a F6854; identical to SEQ ID NO: 59969
  CDS (1)..(315): transl_table=11

SEQ ID NO: 99794 - protein, 104 aa, Listeria monocytogenes str. 1/2a F6854; identical to SEQ ID NO: 59970

SEQ ID NO: 99795 - DNA, 321 bp, Bacillus cereus G9241; identical to SEQ ID NO: 59971
  CDS (1)..(321): transl_table=11

SEQ ID NO: 99796 - protein, 106 aa, Bacillus cereus G9241; identical to SEQ ID NO: 59972

SEQ ID NO: 99797 - DNA, 324 bp, Bacillus cereus G9241; identical to SEQ ID NO: 59973
  CDS (1)..(324): transl_table=11

SEQ ID NO: 99798 - protein, 107 aa, Bacillus cereus G9241; identical to SEQ ID NO: 59974

SEQ ID NO: 99799 - DNA, 333 bp, Enterococcus faecium; identical to SEQ ID NO: 59975
  CDS (1)..(333)

SEQ ID NO: 99800 - protein, 110 aa, Enterococcus faecium; identical to SEQ ID NO: 59976

SEQ ID NO: 99801 - DNA, 318 bp, Enterococcus faecium; identical to SEQ ID NO: 59977
  CDS (1)..(318)

SEQ ID NO: 99802 - protein, 105 aa, Enterococcus faecium; identical to SEQ ID NO: 59978

SEQ ID NO: 99803 - DNA, 441 bp, Enterococcus faecium; identical to SEQ ID NO: 59979
  CDS (121)..(441)

SEQ ID NO: 99804 - protein, 106 aa, Enterococcus faecium; identical to SEQ ID NO: 59980

SEQ ID NO: 99805 - DNA, 327 bp, Enterococcus faecium; identical to SEQ ID NO: 59981
  CDS (1)..(327)

SEQ ID NO: 99806 - protein, 108 aa, Enterococcus faecium; identical to SEQ ID NO: 59982

SEQ ID NO: 99807 - DNA, 312 bp, Enterococcus faecium; identical to SEQ ID NO: 59983
  CDS (1)..(312)

SEQ ID NO: 99808 - protein, 103 aa, Enterococcus faecium; identical to SEQ ID NO: 59984

SEQ ID NO: 99809 - DNA, 336 bp, Oenococcus oeni PSU-1; identical to SEQ ID NO: 59985
  CDS (1)..(336)

SEQ ID NO: 99810 - protein, 111 aa, Oenococcus oeni PSU-1; identical to SEQ ID NO: 59986

SEQ ID NO: 99811 - DNA, 324 bp, Oenococcus oeni PSU-1; identical to SEQ ID NO: 59987
  CDS (1)..(324)

SEQ ID NO: 99812 - protein, 107 aa, Oenococcus oeni PSU-1; identical to SEQ ID NO: 59988

SEQ ID NO: 99813 - DNA, 351 bp, Pediococcus pentosaceus ATCC 25745; identical to SEQ ID NO: 59989
  CDS (1)..(351)

SEQ ID NO: 99814 - protein, 116 aa, Pediococcus pentosaceus ATCC 25745; identical to SEQ ID NO: 59990

SEQ ID NO: 99815 - DNA, 324 bp, Pediococcus pentosaceus ATCC 25745; identical to SEQ ID NO: 59991
  CDS (1)..(324)

SEQ ID NO: 99816 - protein, 107 aa, Pediococcus pentosaceus ATCC 25745; identical to SEQ ID NO: 59992

SEQ ID NO: 99817 - DNA, 315 bp, Streptococcus suis 89/1591; identical to SEQ ID NO: 59993
  CDS (1)..(315)

SEQ ID NO: 99818 - protein, 104 aa, Streptococcus suis 89/1591; identical to SEQ ID NO: 59994

SEQ ID NO: 99819 - DNA, 315 bp, Streptococcus suis 89/1591; identical to SEQ ID NO: 59995
  CDS (1)..(315)

SEQ ID NO: 99820 - protein, 104 aa, Streptococcus suis 89/1591; identical to SEQ ID NO: 59996

SEQ ID NO: 99821 - DNA, 324 bp, Streptococcus suis 89/1591; identical to SEQ ID NO: 59997
  CDS (1)..(324)

SEQ ID NO: 99822 - protein, 107 aa, Streptococcus suis 89/1591; identical to SEQ ID NO: 59998

SEQ ID NO: 99823 - DNA, 318 bp, Streptococcus suis 89/1591; identical to SEQ ID NO: 59999
  CDS (1)..(318)

SEQ ID NO: 99824 - protein, 105 aa, Streptococcus suis 89/1591; identical to SEQ ID NO: 60000

SEQ ID NO: 99825 - DNA, 336 bp, Streptococcus pyogenes M49 591; identical to SEQ ID NO: 60001
  CDS (1)..(336)

SEQ ID NO: 99826 - protein, 111 aa, Streptococcus pyogenes M49 591; identical to SEQ ID NO: 60002

SEQ ID NO: 99827 - DNA, 327 bp, Pectobacterium carotovorum; identical to SEQ ID NO: 60003
  CDS (1)..(327): transl_table=11

SEQ ID NO: 99828 - protein, 108 aa, Pectobacterium carotovorum; identical to SEQ ID NO: 60004

SEQ ID NO: 99829 - DNA, 333 bp, Bacillus pumilus; identical to SEQ ID NO: 60005
  CDS (1)..(333): transl_table=11

SEQ ID NO: 99830 - protein, 110 aa, Bacillus pumilus; identical to SEQ ID NO: 60006

SEQ ID NO: 99831 - DNA, 327 bp, Bacillus stearothermophilus; identical to SEQ ID NO: 60007
  CDS (1)..(327): transl_table=11

SEQ ID NO: 99832 - protein, 108 aa, Bacillus stearothermophilus; identical to SEQ ID NO: 60008

SEQ ID NO: 99833 - DNA, 333 bp, Bacillus subtilis; identical to SEQ ID NO: 60009
  CDS (1)..(333): transl_table=11

SEQ ID NO: 99834 - protein, 110 aa, Bacillus subtilis; identical to SEQ ID NO: 60010

SEQ ID NO: 99835 - DNA, 339 bp, Lactobacillus casei; identical to SEQ ID NO: 60011
  CDS (1)..(339): transl_table=11

SEQ ID NO: 99836 - protein, 112 aa, Lactobacillus casei; identical to SEQ ID NO: 60012

SEQ ID NO: 99837 - DNA, 318 bp, Lactococcus lactis; identical to SEQ ID NO: 60013
  CDS (1)..(318): transl_table=11

SEQ ID NO: 99838 - protein, 105 aa, Lactococcus lactis; identical to SEQ ID NO: 60014

SEQ ID NO: 99839 - DNA, 312 bp, Staphylococcus aureus; identical to SEQ ID NO: 60015
  CDS (1)..(312): transl_table=11

SEQ ID NO: 99840 - protein, 103 aa, Staphylococcus aureus; identical to SEQ ID NO: 60016

SEQ ID NO: 99841 - DNA, 315 bp, Streptococcus mutans; identical to SEQ ID NO: 60017
  CDS (1)..(315): transl_table=11

SEQ ID NO: 99842 - protein, 104 aa, Streptococcus mutans; identical to SEQ ID NO: 60018

SEQ ID NO: 99843 - DNA, 24 bp, Primer
atgatggatctcgataacattccc

SEQ ID NO: 99844 - DNA, 25 bp, Primer
ttatgccttcagtttttcatgaagc

SEQ ID NO: 99845 - protein, 68 aa, consensus; identical to SEQ ID NO: 60021
  MISC_FEATURE (1)..(68): consensus for the disclosure of xaa see table XV

SEQ ID NO: 99846 - protein, 88 aa, consensus; identical to SEQ ID NO: 60022
  MISC_FEATURE (1)..(88): consensus for the disclosure of xaa see table XV

SEQ ID NO: 99847 - DNA, 321 bp, Escherichia coli; identical to SEQ ID NO: 40582
  CDS (1)..(321)

SEQ ID NO: 99848 - protein, 106 aa, Escherichia coli; identical to SEQ ID NO: 40583

SEQ ID NO: 99849 - DNA, 336 bp, Lactobacillus acidophilus NCFM; identical to SEQ ID NO: 40584
  CDS (1)..(336)

SEQ ID NO: 99850 - protein, 111 aa, Lactobacillus acidophilus NCFM; identical to SEQ ID NO: 40585

SEQ ID NO: 99851 - DNA, 318 bp, Borrelia burgdorferi B31; identical to SEQ ID NO: 40586
  CDS (1)..(318): transl_table=11

SEQ ID NO: 99852 - protein, 105 aa, Borrelia burgdorferi B31; identical to SEQ ID NO: 40587

SEQ ID NO: 99853 - DNA, 306 bp, Vibrio cholerae O1 biovar eltor str. N16961; identical to SEQ ID NO: 40588
  CDS (1)..(306): transl_table=11

SEQ ID NO: 99854 - protein, 101 aa, Vibrio cholerae O1 biovar eltor str. N16961; identical to SEQ ID NO: 40589

SEQ ID NO: 99855 - DNA, 312 bp, Bacillus halodurans C-125; identical to SEQ ID NO: 40590
  CDS (1)..(312): transl_table=11

SEQ ID NO: 99856 - protein, 103 aa, Bacillus halodurans C-125; identical to SEQ ID NO: 40591

SEQ ID NO: 99857 - DNA, 327 bp, Lactococcus lactis subsp. lactis Il1403; identical to SEQ ID NO: 40592
  CDS (1)..(327): transl_table=11

SEQ ID NO: 99858 - protein, 108 aa, Lactococcus lactis subsp. lactis Il1403; identical to SEQ ID NO: 40593

SEQ ID NO: 99859 - DNA, 309 bp, Streptococcus pneumoniae TIGR4; identical to SEQ ID NO: 40594
  CDS (1)..(309): transl_table=11

SEQ ID NO: 99860 - protein, 102 aa, Streptococcus pneumoniae TIGR4; identical to SEQ ID NO: 40595

SEQ ID NO: 99861 - DNA, 309 bp, Clostridium acetobutylicum ATCC 824; identical to SEQ ID NO: 40596
  CDS (1)..(309): transl_table=11

SEQ ID NO: 99862 - protein, 102 aa, Clostridium acetobutylicum ATCC 824; identical to SEQ ID NO: 40597

SEQ ID NO: 99863 - DNA, 309 bp, Streptococcus pneumoniae R6; identical to SEQ ID NO: 40598
  CDS (1)..(309): transl_table=11

SEQ ID NO: 99864 - protein, 102 aa, Streptococcus pneumoniae R6; identical to SEQ ID NO: 40599

SEQ ID NO: 99865 - DNA, 309 bp, Streptococcus pneumoniae R6; identical to SEQ ID NO: 40600
  CDS (1)..(309): transl_table=11

SEQ ID NO: 99866 - protein, 102 aa, Streptococcus pneumoniae R6; identical to SEQ ID NO: 40601

SEQ ID NO: 99867 - DNA, 312 bp, Bacillus subtilis subsp. subtilis str. 168; identical to SEQ ID NO: 40602
  CDS (1)..(312): transl_table=11

SEQ ID NO: 99868 - protein, 103 aa, Bacillus subtilis subsp. subtilis str. 168; identical to SEQ ID NO: 40603

SEQ ID NO: 99869 - DNA, 321 bp, Salmonella typhimurium LT2; identical to SEQ ID NO: 40604
  CDS (1)..(321): transl_table=11

SEQ ID NO: 99870 - protein, 106 aa, Salmonella typhimurium LT2; identical to SEQ ID NO: 40605

SEQ ID NO: 99871 - DNA, 336 bp, Listeria innocua Clip11262; identical to SEQ ID NO: 40606
  CDS (1)..(336): transl_table=11

SEQ ID NO: 99872 - protein, 111 aa, Listeria innocua Clip11262; identical to SEQ ID NO: 40607

SEQ ID NO: 99873 - DNA, 306 bp, Listeria innocua Clip11262; identical to SEQ ID NO: 40608
  CDS (1)..(306): transl_table=11

SEQ ID NO: 99874 - protein, 101 aa, Listeria innocua Clip11262; identical to SEQ ID NO: 40609

SEQ ID NO: 99875 - DNA, 357 bp, Listeria innocua Clip11262; identical to SEQ ID NO: 40610
  CDS (1)..(357): transl_table=11

SEQ ID NO: 99876 - protein, 118 aa, Listeria innocua Clip11262; identical to SEQ ID NO: 40611

SEQ ID NO: 99877 - DNA, 330 bp, Clostridium perfringens str. 13; identical to SEQ ID NO: 40612
  CDS (1)..(330): transl_table=11

SEQ ID NO: 99878 - protein, 109 aa, Clostridium perfringens str. 13; identical to SEQ ID NO: 40613

SEQ ID NO: 99879 - DNA, 312 bp, Thermoanaerobacter tengcongensis MB4; identical to SEQ ID NO: 40614
  CDS (1)..(312): transl_table=11

SEQ ID NO: 99880 - protein, 103 aa, Thermoanaerobacter tengcongensis MB4; identical to SEQ ID NO: 40615

SEQ ID NO: 99881 - DNA, 327 bp, Thermoanaerobacter tengcongensis MB4; identical to SEQ ID NO: 40616
  CDS (1)..(327): transl_table=11

SEQ ID NO: 99882 - protein, 108 aa, Thermoanaerobacter tengcongensis MB4; identical to SEQ ID NO: 40617

SEQ ID NO: 99883 - DNA, 321 bp, Streptococcus agalactiae 2603V/R; identical to SEQ ID NO: 40618
  CDS (1)..(321): transl_table=11

SEQ ID NO: 99884 - protein, 106 aa, Streptococcus agalactiae 2603V/R; identical to SEQ ID NO: 40619

SEQ ID NO: 99885 - DNA, 306 bp, Oceanobacillus iheyensis HTE831; identical to SEQ ID NO: 40620
  CDS (1)..(306): transl_table=11

SEQ ID NO: 99886 - protein, 101 aa, Oceanobacillus iheyensis HTE831; identical to SEQ ID NO: 40621

SEQ ID NO: 99887 - DNA, 306 bp, Oceanobacillus iheyensis HTE831; identical to SEQ ID NO: 40622
  CDS (1)..(306): transl_table=11

SEQ ID NO: 99888 - protein, 101 aa, Oceanobacillus iheyensis HTE831; identical to SEQ ID NO: 40623

SEQ ID NO: 99889 - DNA, 300 bp, Lactobacillus plantarum WCFS1; identical to SEQ ID NO: 40624
  CDS (1)..(300): transl_table=11

SEQ ID NO: 99890 - protein, 99 aa, Lactobacillus plantarum WCFS1; identical to SEQ ID NO: 40625

SEQ ID NO: 99891 - DNA, 318 bp, Lactobacillus plantarum WCFS1; identical to SEQ ID NO: 40626
  CDS (1)..(318): transl_table=11

SEQ ID NO: 99892 - protein, 105 aa, Lactobacillus plantarum WCFS1; identical to SEQ ID NO: 40627

SEQ ID NO: 99893 - DNA, 327 bp, Lactobacillus plantarum WCFS1; identical to SEQ ID NO: 40628
  CDS (1)..(327): transl_table=11

SEQ ID NO: 99894 - protein, 108 aa, Lactobacillus plantarum WCFS1; identical to SEQ ID NO: 40629

SEQ ID NO: 99895 - DNA, 306 bp, Vibrio parahaemolyticus RIMD 2210633; identical to SEQ ID NO: 40630
  CDS (1)..(306): transl_table=11

SEQ ID NO: 99896 - protein, 101 aa, Vibrio parahaemolyticus RIMD 2210633; identical to SEQ ID NO: 40631

SEQ ID NO: 99897 - DNA, 330 bp, Enterococcus faecalis V583; identical to SEQ ID NO: 40632
  CDS (1)..(330): transl_table=11

SEQ ID NO: 99898 - protein, 109 aa, Enterococcus faecalis V583; identical to SEQ ID NO: 40633

SEQ ID NO: 99899 - DNA, 336 bp, Enterococcus faecalis V583; identical to SEQ ID NO: 40634
  CDS (1)..(336): transl_table=11

SEQ ID NO: 99900 - protein, 111 aa, Enterococcus faecalis V583; identical to SEQ ID NO: 40635

SEQ ID NO: 99901 - DNA, 303 bp, Bacillus cereus ATCC 14579; identical to SEQ ID NO: 40636
  CDS (1)..(303): transl_table=11

SEQ ID NO: 99902 - protein, 100 aa, Bacillus cereus ATCC 14579; identical to SEQ ID NO: 40637

SEQ ID NO: 99903 - DNA, 306 bp, Photorhabdus luminescens subsp. laumondii TTO1; identical to SEQ ID NO: 40638
  CDS (1)..(306): transl_table=11

SEQ ID NO: 99904 - protein, 101 aa, Photorhabdus luminescens subsp. laumondii TTO1; identical to SEQ ID NO: 40639

SEQ ID NO: 99905 - DNA, 324 bp, Lactobacillus johnsonii NCC 533; identical to SEQ ID NO: 40640
  CDS (1)..(324): transl_table=11

SEQ ID NO: 99906 - protein, 107 aa, Lactobacillus johnsonii NCC 533; identical to SEQ ID NO: 40641

SEQ ID NO: 99907 - DNA, 306 bp, Bacillus cereus ATCC 10987; identical to SEQ ID NO: 40642
  CDS (1)..(306): transl_table=11

SEQ ID NO: 99908 - protein, 101 aa, Bacillus cereus ATCC 10987; identical to SEQ ID NO: 40643

SEQ ID NO: 99909 - DNA, 306 bp, Listeria monocytogenes str. 4b F2365; identical to SEQ ID NO: 40644
  CDS (1)..(306): transl_table=11

SEQ ID NO: 99910 - protein, 101 aa, Listeria monocytogenes str. 4b F2365; identical to SEQ ID NO: 40645

SEQ ID NO: 99911 - DNA, 303 bp, Bacillus thuringiensis serovar konkukian str. 97-27; identical to SEQ ID NO: 40646
  CDS (1)..(303): transl_table=11

SEQ ID NO: 99912 - protein, 100 aa, Bacillus thuringiensis serovar konkukian str. 97-27; identical to SEQ ID NO: 40647

SEQ ID NO: 99913 - DNA, 318 bp, Erwinia carotovora subsp. atroseptica SCRI1043; identical to SEQ ID NO: 40648
  CDS (1)..(318)

SEQ ID NO: 99914 - protein, 105 aa, Erwinia carotovora subsp. atroseptica SCRI1043; identical to SEQ ID NO: 40649

SEQ ID NO: 99915 - DNA, 312 bp, Erwinia carotovora subsp. atroseptica SCRI1043; identical to SEQ ID NO: 40650
  CDS (1)..(312)

SEQ ID NO: 99916 - protein, 103 aa, Erwinia carotovora subsp. atroseptica SCRI1043; identical to SEQ ID NO: 40651

SEQ ID NO: 99917 - DNA, 306 bp, Erwinia carotovora subsp. atroseptica SCRI1043; identical to SEQ ID NO: 40652
  CDS (1)..(306)

SEQ ID NO: 99918 - protein, 101 aa, Erwinia carotovora subsp. atroseptica SCRI1043; identical to SEQ ID NO: 40653

SEQ ID NO: 99919 - DNA, 318 bp, Borrelia garinii PBi; identical to SEQ ID NO: 40654
  CDS (1)..(318): transl_table=11

SEQ ID NO: 99920 - protein, 105 aa, Borrelia garinii PBi; identical to SEQ ID NO: 40655

SEQ ID NO: 99921 - DNA, 318 bp, Yersinia pseudotuberculosis IP 32953; identical to SEQ ID NO: 40656
  CDS (1)..(318): transl_table=11

SEQ ID NO: 99922 - protein, 105 aa, Yersinia pseudotuberculosis IP 32953; identical to SEQ ID NO: 40657

SEQ ID NO: 99923 - DNA, 303 bp, Bacillus cereus ZK; identical to SEQ ID NO: 40658
  CDS (1)..(303): transl_table=11

SEQ ID NO: 99924 - protein, 100 aa, Bacillus cereus ZK; identical to SEQ ID NO: 40659

SEQ ID NO: 99925 - DNA, 300 bp, Bacillus licheniformis ATCC 14580; identical to SEQ ID NO: 40660
  CDS (1)..(300): transl_table=11

SEQ ID NO: 99926 - protein, 99 aa, Bacillus licheniformis ATCC 14580; identical to SEQ ID NO: 40661

SEQ ID NO: 99927 - DNA, 309 bp, Bacillus licheniformis ATCC 14580; identical to SEQ ID NO: 40662
  CDS (1)..(309): transl_table=11

SEQ ID NO: 99928 - protein, 102 aa, Bacillus licheniformis ATCC 14580; identical to SEQ ID NO: 40663

SEQ ID NO: 99929 - DNA, 336 bp, Photobacterium profundum SS9; identical to SEQ ID NO: 40664
  CDS (1)..(336): transl_table=11

SEQ ID NO: 99930 - protein, 111 aa, Photobacterium profundum SS9; identical to SEQ ID NO: 40665

SEQ ID NO: 99931 - DNA, 318 bp, Photobacterium profundum SS9; identical to SEQ ID NO: 40666
  CDS (1)..(318): transl_table=11

SEQ ID NO: 99932 - protein, 105 aa, Photobacterium profundum SS9; identical to SEQ ID NO: 40667

SEQ ID NO: 99933 - DNA, 312 bp, Geobacillus kaustophilus HTA426; identical to SEQ ID NO: 40668
  CDS (1)..(312): transl_table=11

SEQ ID NO: 99934 - protein, 103 aa, Geobacillus kaustophilus HTA426; identical to SEQ ID NO: 40669

SEQ ID NO: 99935 - DNA, 297 bp, Bacillus clausii KSM-K16; identical to SEQ ID NO: 40670
  CDS (1)..(297): transl_table=11

SEQ ID NO: 99936 - protein, 98 aa, Bacillus clausii KSM-K16; identical to SEQ ID NO: 40671

SEQ ID NO: 99937 - DNA, 324 bp, Lactobacillus gasseri; identical to SEQ ID NO: 40672
  CDS (1)..(324)

SEQ ID NO: 99938 - protein, 107 aa, Lactobacillus gasseri; identical to SEQ ID NO: 40673

SEQ ID NO: 99939 - DNA, 312 bp, Haemophilus somnus 2336; identical to SEQ ID NO: 40674
  CDS (1)..(312)

SEQ ID NO: 99940 - protein, 103 aa, Haemophilus somnus 2336; identical to SEQ ID NO: 40675

SEQ ID NO: 99941 - DNA, 303 bp, Listeria monocytogenes str. 1/2a F6854; identical to SEQ ID NO: 40676
  CDS (1)..(303): transl_table=11

SEQ ID NO: 99942 - protein, 100 aa, Listeria monocytogenes str. 1/2a F6854; identical to SEQ ID NO: 40677

SEQ ID NO: 99943 - DNA, 324 bp, Listeria monocytogenes str. 1/2a F6854; identical to SEQ ID NO: 40678
  CDS (1)..(324): transl_table=11

SEQ ID NO: 99944 - protein, 107 aa, Listeria monocytogenes str. 1/2a F6854; identical to SEQ ID NO: 40679

SEQ ID NO: 99945 - DNA, 321 bp, Enterococcus faecium; identical to SEQ ID NO: 40680
  CDS (1)..(321)

SEQ ID NO: 99946 - protein, 106 aa, Enterococcus faecium; identical to SEQ ID NO: 40681

SEQ ID NO: 99947 - DNA, 318 bp, Enterococcus faecium; identical to SEQ ID NO: 40682
  CDS (1)..(318)

SEQ ID NO: 99948 - protein, 105 aa, Enterococcus faecium; identical to SEQ ID NO: 40683

SEQ ID NO: 99949 - DNA, 309 bp, Oenococcus oeni PSU-1; identical to SEQ ID NO: 40684
  CDS (1)..(309)

SEQ ID NO: 99950 - protein, 102 aa, Oenococcus oeni PSU-1; identical to SEQ ID NO: 40685

SEQ ID NO: 99951 - DNA, 324 bp, Oenococcus oeni PSU-1; identical to SEQ ID NO: 40686
  CDS (1)..(324)

SEQ ID NO: 99952 - protein, 107 aa, Oenococcus oeni PSU-1; identical to SEQ ID NO: 40687

SEQ ID NO: 99953 - DNA, 312 bp, Pediococcus pentosaceus ATCC 25745; identical to SEQ ID NO: 40688
  CDS (1)..(312)

SEQ ID NO: 99954 - protein, 103 aa, Pediococcus pentosaceus ATCC 25745; identical to SEQ ID NO: 40689

SEQ ID NO: 99955 - DNA, 312 bp, Streptococcus suis 89/1591; identical to SEQ ID NO: 40690
  CDS (1)..(312)

SEQ ID NO: 99956 - protein, 103 aa, Streptococcus suis 89/1591; identical to SEQ ID NO: 40691

SEQ ID NO: 99957 - DNA, 306 bp, Streptococcus suis 89/1591; identical to SEQ ID NO: 40692
  CDS (1)..(306)

SEQ ID NO: 99958 - protein, 101 aa, Streptococcus suis 89/1591; identical to SEQ ID NO: 40693

SEQ ID NO: 99959 - DNA, 306 bp, Pectobacterium carotovorum; identical to SEQ ID NO: 40694
  CDS (1)..(306): transl_table=11

SEQ ID NO: 99960 - protein, 101 aa, Pectobacterium carotovorum; identical to SEQ ID NO: 40695

SEQ ID NO: 99961 - DNA, 312 bp, Bacillus pumilus; identical to SEQ ID NO: 40696
  CDS (1)..(312): transl_table=11

SEQ ID NO: 99962 - protein, 103 aa, Bacillus pumilus; identical to SEQ ID NO: 40697

SEQ ID NO: 99963 - DNA, 318 bp, Serratia marcescens; identical to SEQ ID NO: 40698
  CDS (1)..(318): transl_table=11

SEQ ID NO: 99964 - protein, 105 aa, Serratia marcescens; identical to SEQ ID NO: 40699

SEQ ID NO: 99965 - DNA, 309 bp, Bacillus subtilis; identical to SEQ ID NO: 40700
  CDS (1)..(309): transl_table=11

SEQ ID NO: 99966 - protein, 102 aa, Bacillus subtilis; identical to SEQ ID NO: 40701

SEQ ID NO: 99967 - DNA, 27 bp, Primer
atggaaaagaaacacatttatctgttt

SEQ ID NO: 99968 - DNA, 26 bp, Primer
ttaatttgctgcggcttttttaatcg

SEQ ID NO: 99969 - protein, 107 aa, consensus; identical to SEQ ID NO: 40704
  MISC_FEATURE (1)..(107): consensus for the disclosure of xaa see table XV

SEQ ID NO: 99970 - protein, 18 aa, consensus
  MISC_FEATURE (1)..(18): consensus for the disclosure of xaa see table XV
XXXXCXXGXXXXXXXXXX

SEQ ID NO: 99971 - protein, 11 aa, consensus
  MISC_FEATURE (1)..(11): consensus for the disclosure of xaa see table XV
DXXXXXPXXXX

SEQ ID NO: 99972 - protein, 21 aa, consensus
  MISC_FEATURE (1)..(21): consensus for the disclosure of xaa see table XV
XXXIXXXXYXXXXGXXXXXXX

SEQ ID NO: 99973 - DNA, 1008 bp, Escherichia coli; identical to SEQ ID NO: 42264
  CDS (1)..(1008)

SEQ ID NO: 99974 - protein, 335 aa, Escherichia coli; identical to SEQ ID NO: 42265

SEQ ID NO: 99975 - DNA, 1014 bp, Staphylococcus aureus subsp. aureus COL; identical to SEQ ID NO: 42266
  CDS (1)..(1014)

SEQ ID NO: 99976 - protein, 337 aa, Staphylococcus aureus subsp. aureus COL; identical to SEQ ID NO: 42267

SEQ ID NO: 99977 - DNA, 1176 bp, Xanthomonas oryzae pv. oryzae KACC10331; identical to SEQ ID NO: 42268
  CDS (1)..(1176)

SEQ ID NO: 99978 - protein, 391 aa, Xanthomonas oryzae pv. oryzae KACC10331; identical to SEQ ID NO: 42269

SEQ ID NO: 99979 - DNA, 1008 bp, Bacillus halodurans C-125; identical to SEQ ID NO: 42270
  CDS (1)..(1008): transl_table=11

SEQ ID NO: 99980 - protein, 335 aa, Bacillus halodurans C-125; identical to SEQ ID NO: 42271

SEQ ID NO: 99981 - DNA, 1002 bp, Pseudomonas aeruginosa PAO1; identical to SEQ ID NO: 42272
  CDS (1)..(1002): transl_table=11

SEQ ID NO: 99982 - protein, 333 aa, Pseudomonas aeruginosa PAO1; identical to SEQ ID NO: 42273

SEQ ID NO: 99983 - DNA, 1017 bp, Halobacterium salinarum NRC-1; identical to SEQ ID NO: 42274
  CDS (1)..(1017): transl_table=11

SEQ ID NO: 99984 - protein, 338 aa, Halobacterium salinarum NRC-1; identical to SEQ ID NO: 42275

SEQ ID NO: 99985 - DNA, 1017 bp, Deinococcus radiodurans R1; identical to SEQ ID NO: 42276
  CDS (1)..(1017): transl_table=11

SEQ ID NO: 99986 - protein, 338 aa, Deinococcus radiodurans R1; identical to SEQ ID NO: 42277

SEQ ID NO: 99987 - DNA, 1044 bp, Mycoplasma pulmonis UAB CTIP; identical to SEQ ID NO: 42278
  CDS (1)..(1044): transl_table=4

SEQ ID NO: 99988 - protein, 347 aa, Mycoplasma pulmonis UAB CTIP; identical to SEQ ID NO: 42279

SEQ ID NO: 99989 - DNA, 1008 bp, Agrobacterium tumefaciens str. C58; identical to SEQ ID NO: 42280
  CDS (1)..(1008): transl_table=11

SEQ ID NO: 99990 - protein, 335 aa, Agrobacterium tumefaciens str. C58; identical to SEQ ID NO: 42281

SEQ ID NO: 99991 - DNA, 1026 bp, Staphylococcus aureus subsp. aureus Mu50; identical to SEQ ID NO: 42282
  CDS (1)..(1026): transl_table=11

SEQ ID NO: 99992 - protein, 341 aa, Staphylococcus aureus subsp. aureus Mu50; identical to SEQ ID NO: 42283

SEQ ID NO: 99993 - DNA, 990 bp, Sinorhizobium meliloti 1021; identical to SEQ ID NO: 42284
  CDS (1)..(990): transl_table=11

SEQ ID NO: 99994 - protein, 329 aa, Sinorhizobium meliloti 1021; identical to SEQ ID NO: 42285

SEQ ID NO: 99995 - DNA, 1014 bp, Caulobacter crescentus CB15; identical to SEQ ID NO: 42286
  CDS (1)..(1014): transl_table=11

SEQ ID NO: 99996 - protein, 337 aa, Caulobacter crescentus CB15; identical to SEQ ID NO: 42287

SEQ ID NO: 99997 - DNA, 1008 bp, Salmonella typhimurium LT2; identical to SEQ ID NO: 42288
  CDS (1)..(1008): transl_table=11

SEQ ID NO: 99998 - protein, 335 aa, Salmonella typhimurium LT2; identical to SEQ ID NO: 42289

SEQ ID NO: 99999 - DNA, 996 bp, Listeria innocua Clip11262; identical to SEQ ID NO: 42290
  CDS (1)..(996): transl_table=11

SEQ ID NO: 100000 - protein, 331 aa, Listeria innocua Clip11262; identical to SEQ ID NO: 42291

SEQ ID NO: 100001 - DNA, 1053 bp, Ralstonia solanacearum GMI1000; identical to SEQ ID NO: 42292
  CDS (1)..(1053): transl_table=11

SEQ ID NO: 100002 - protein, 350 aa, Ralstonia solanacearum GMI1000; identical to SEQ ID NO: 42293

SEQ ID NO: 100003 - DNA, 1002 bp, Agrobacterium tumefaciens str. C58; identical to SEQ ID NO: 42294
  CDS (1)..(1002): transl_table=11

SEQ ID NO: 100004 - protein, 333 aa, Agrobacterium tumefaciens str. C58; identical to SEQ ID NO: 42295

SEQ ID NO: 100005 - DNA, 984 bp, Brucella melitensis 16M; identical to SEQ ID NO: 42296
  CDS (1)..(984): transl_table=11

SEQ ID NO: 100006 - protein, 327 aa, Brucella melitensis 16M; identical to SEQ ID NO: 42297

SEQ ID NO: 100007 - DNA, 981 bp, Corynebacterium glutamicum ATCC 13032; identical to SEQ ID NO: 42298
  CDS (1)..(981): transl_table=11

SEQ ID NO: 100008 - protein, 326 aa, Corynebacterium glutamicum ATCC 13032; identical to SEQ ID NO: 42299

SEQ ID NO: 100009 - DNA, 999 bp, Streptococcus pyogenes MGAS8232; identical to SEQ ID NO: 42300
  CDS (1)..(999): transl_table=11

SEQ ID NO: 100010 - protein, 332 aa, Streptococcus pyogenes MGAS8232; identical to SEQ ID NO: 42301

SEQ ID NO: 100011 - DNA, 1101 bp, Streptomyces coelicolor A3(2); identical to SEQ ID NO: 42302
  CDS (1)..(1101)

SEQ ID NO: 100012 - protein, 366 aa, Streptomyces coelicolor A3(2); identical to SEQ ID NO: 42303

SEQ ID NO: 100013 - DNA, 1110 bp, Xanthomonas axonopodis pv. citri str. 306; identical to SEQ ID NO: 42304
  CDS (1)..(1110): transl_table=11

SEQ ID NO: 100014 - protein, 369 aa, Xanthomonas axonopodis pv. citri str. 306; identical to SEQ ID NO: 42305

SEQ ID NO: 100015 - DNA, 1056 bp, Yersinia pestis KIM; identical to SEQ ID NO: 42306
  CDS (1)..(1056): transl_table=11

SEQ ID NO: 100016 - protein, 351 aa, Yersinia pestis KIM; identical to SEQ ID NO: 42307

SEQ ID NO: 100017 - DNA, 1002 bp, Oceanobacillus iheyensis HTE831; identical to SEQ ID NO: 42308
  CDS (1)..(1002): transl_table=11

SEQ ID NO: 100018 - protein, 333 aa, Oceanobacillus iheyensis HTE831; identical to SEQ ID NO: 42309

SEQ ID NO: 100019 - DNA, 912 bp, Oceanobacillus iheyensis HTE831; identical to SEQ ID NO: 42310
  CDS (1)..(912): transl_table=11

SEQ ID NO: 100020 - protein, 303 aa, Oceanobacillus iheyensis HTE831; identical to SEQ ID NO: 42311

SEQ ID NO: 100021 - DNA, 1020 bp, Oceanobacillus iheyensis HTE831; identical to SEQ ID NO: 42312
  CDS (1)..(1020): transl_table=11

SEQ ID NO: 100022 - protein, 339 aa, Oceanobacillus iheyensis HTE831; identical to SEQ ID NO: 42313

SEQ ID NO: 100023 - DNA, 987 bp, Streptococcus agalactiae NEM316; identical to SEQ ID NO: 42314
  CDS (1)..(987): transl_table=11

SEQ ID NO: 100024 - protein, 328 aa, Streptococcus agalactiae NEM316; identical to SEQ ID NO: 42315

SEQ ID NO: 100025 - DNA, 1041 bp, Corynebacterium efficiens YS-314; identical to SEQ ID NO: 42316
  CDS (1)..(1041): transl_table=11

SEQ ID NO: 100026 - protein, 346 aa, Corynebacterium efficiens YS-314; identical to SEQ ID NO: 42317

SEQ ID NO: 100027 - DNA, 966 bp, Corynebacterium efficiens YS-314; identical to SEQ ID NO: 42318
  CDS (1)..(966): transl_table=11

SEQ ID NO: 100028 - protein, 321 aa, Corynebacterium efficiens YS-314; identical to SEQ ID NO: 42319

SEQ ID NO: 100029 - DNA, 1005 bp, Pseudomonas putida KT2440; identical to SEQ ID NO: 42320
  CDS (1)..(1005): transl_table=11

SEQ ID NO: 100030 - protein, 334 aa, Pseudomonas putida KT2440; identical to SEQ ID NO: 42321

SEQ ID NO: 100031 - DNA, 981 bp, Pseudomonas putida KT2440; identical to SEQ ID NO: 42322
  CDS (1)..(981): transl_table=11

SEQ ID NO: 100032 - protein, 326 aa, Pseudomonas putida KT2440; identical to SEQ ID NO: 42323

SEQ ID NO: 100033 - DNA, 996 bp, Staphylococcus epidermidis ATCC 12228; identical to SEQ ID NO: 42324
  CDS (1)..(996): transl_table=11

SEQ ID NO: 100034 - protein, 331 aa, Staphylococcus epidermidis ATCC 12228; identical to SEQ ID NO: 42325

SEQ ID NO: 100035 - DNA, 1047 bp, Staphylococcus epidermidis ATCC 12228; identical to SEQ ID NO: 42326
  CDS (1)..(1047): transl_table=11

SEQ ID NO: 100036 - protein, 348 aa, Staphylococcus epidermidis ATCC 12228; identical to SEQ ID NO: 42327

SEQ ID NO: 100037 - DNA, 1008 bp, Bradyrhizobium japonicum USDA 110; identical to SEQ ID NO: 42328
  CDS (1)..(1008)

SEQ ID NO: 100038 - protein, 335 aa, Bradyrhizobium japonicum USDA 110; identical to SEQ ID NO: 42329

SEQ ID NO: 100039 - DNA, 1014 bp, Bradyrhizobium japonicum USDA 110; identical to SEQ ID NO: 42330
  CDS (1)..(1014)

SEQ ID NO: 100040 - protein, 337 aa, Bradyrhizobium japonicum USDA 110; identical to SEQ ID NO: 42331

SEQ ID NO: 100041 - DNA, 1002 bp, Pseudomonas syringae pv. tomato str. DC3000; identical to SEQ ID NO: 42332
  CDS (1)..(1002): transl_table=11

SEQ ID NO: 100042 - protein, 333 aa, Pseudomonas syringae pv. tomato str. DC3000; identical to SEQ ID NO: 42333

SEQ ID NO: 100043 - DNA, 987 bp, Enterococcus faecalis V583; identical to SEQ ID NO: 42334
  CDS (1)..(987): transl_table=11

SEQ ID NO: 100044 - protein, 328 aa, Enterococcus faecalis V583; identical to SEQ ID NO: 42335

SEQ ID NO: 100045 - DNA, 1017 bp, Streptomyces avermitilis MA-4680; identical to SEQ ID NO: 42336
  CDS (1)..(1017)

SEQ ID NO: 100046 - protein, 338 aa, Streptomyces avermitilis MA-4680; identical to SEQ ID NO: 42337

SEQ ID NO: 100047 - DNA, 1008 bp, Streptomyces avermitilis MA-4680; identical to SEQ ID NO: 42338
  CDS (1)..(1008)

SEQ ID NO: 100048 - protein, 335 aa, Streptomyces avermitilis MA-4680; identical to SEQ ID NO: 42339

SEQ ID NO: 100049 - DNA, 972 bp, Bordetella bronchiseptica RB50; identical to SEQ ID NO: 42340
  CDS (1)..(972): transl_table=11

SEQ ID NO: 100050 - protein, 323 aa, Bordetella bronchiseptica RB50; identical to SEQ ID NO: 42341

SEQ ID NO: 100051 - DNA, 1026 bp, Bordetella bronchiseptica RB50; identical to SEQ ID NO: 42342
  CDS (1)..(1026): transl_table=11

SEQ ID NO: 100052 - protein, 341 aa, Bordetella bronchiseptica RB50; identical to SEQ ID NO: 42343

SEQ ID NO: 100053 - DNA, 1032 bp, Chromobacterium violaceum ATCC 12472; identical to SEQ ID NO: 42344
  CDS (1)..(1032): transl_table=11

SEQ ID NO: 100054 - protein, 343 aa, Chromobacterium violaceum ATCC 12472; identical to SEQ ID NO: 42345

SEQ ID NO: 100055 - DNA, 1017 bp, Rhodopseudomonas palustris CGA009; identical to SEQ ID NO: 42346
  CDS (1)..(1017): transl_table=11

SEQ ID NO: 100056 - protein, 338 aa, Rhodopseudomonas palustris CGA009; identical to SEQ ID NO: 42347

SEQ ID NO: 100057 - DNA, 1122 bp, Mycobacterium avium subsp. paratuberculosis str. k10; identical to SEQ ID NO: 42348
  CDS (1)..(1122): transl_table=11

SEQ ID NO: 100058 - protein, 373 aa, Mycobacterium avium subsp. paratuberculosis str. k10; identical to SEQ ID NO: 42349

SEQ ID NO: 100059 - DNA, 1032 bp, Mycobacterium avium subsp. paratuberculosis str. k10; identical to SEQ ID NO: 42350
  CDS (1)..(1032): transl_table=11

SEQ ID NO: 100060 - protein, 343 aa, Mycobacterium avium subsp. paratuberculosis str. k10; identical to SEQ ID NO: 42351

SEQ ID NO: 100061 - DNA, 1011 bp, Bdellovibrio bacteriovorus HD100; identical to SEQ ID NO: 42352
  CDS (1)..(1011): transl_table=11

SEQ ID NO: 100062 - protein, 336 aa, Bdellovibrio bacteriovorus HD100; identical to SEQ ID NO: 42353

SEQ ID NO: 100063 - DNA, 972 bp, Anopheles gambiae str. PEST; identical to SEQ ID NO: 42354
  CDS (1)..(972)

SEQ ID NO: 100064 - protein, 323 aa, Anopheles gambiae str. PEST; identical to SEQ ID NO: 42355

SEQ ID NO: 100065 - DNA, 1014 bp, Staphylococcus aureus subsp. aureus MRSA252; identical to SEQ ID NO: 42356
  CDS (1)..(1014): transl_table=11

SEQ ID NO: 100066 - protein, 337 aa, Staphylococcus aureus subsp. aureus MRSA252; identical to SEQ ID NO: 42357

SEQ ID NO: 100067 - DNA, 1023 bp, Acinetobacter sp. ADP1; identical to SEQ ID NO: 42358
  CDS (1)..(1023): transl_table=11

SEQ ID NO: 100068 - protein, 340 aa, Acinetobacter sp. ADP1; identical to SEQ ID NO: 42359

SEQ ID NO: 100069 - DNA, 981 bp, Erwinia carotovora subsp. atroseptica SCRI1043; identical to SEQ ID NO: 42360
  CDS (1)..(981)

SEQ ID NO: 100070 - protein, 326 aa, Erwinia carotovora subsp. atroseptica SCRI1043; identical to SEQ ID NO: 42361

SEQ ID NO: 100071 - DNA, 981 bp, Propionibacterium acnes KPA171202; identical to SEQ ID NO: 42362
  CDS (1)..(981): transl_table=11

SEQ ID NO: 100072 - protein, 326 aa, Propionibacterium acnes KPA171202; identical to SEQ ID NO: 42363

SEQ ID NO: 100073 - DNA, 1014 bp, Symbiobacterium thermophilum IAM 14863; identical to SEQ ID NO: 42364
  CDS (1)..(1014): transl_table=11

SEQ ID NO: 100074 - protein, 337 aa, Symbiobacterium thermophilum IAM 14863; identical to SEQ ID NO: 42365

SEQ ID NO: 100075 - DNA, 993 bp, Bacillus licheniformis ATCC 14580; identical to SEQ ID NO: 42366
  CDS (1)..(993): transl_table=11

SEQ ID NO: 100076 - protein, 330 aa, Bacillus licheniformis ATCC 14580; identical to SEQ ID NO: 42367

SEQ ID NO: 100077 - DNA, 1038 bp, Mannheimia succiniciproducens MBEL55E; identical to SEQ ID NO: 42368
  CDS (1)..(1038): transl_table=11

SEQ ID NO: 100078 - protein, 345 aa, Mannheimia succiniciproducens MBEL55E; identical to SEQ ID NO: 42369

SEQ ID NO: 100079 - DNA, 1008 bp, Bacillus licheniformis ATCC 14580; identical to SEQ ID NO: 42370
  CDS (1)..(1008): transl_table=11

SEQ ID NO: 100080 - protein, 335 aa, Bacillus licheniformis ATCC 14580; identical to SEQ ID NO: 42371

SEQ ID NO: 100081 - DNA, 1002 bp, Burkholderia mallei ATCC 23344; identical to SEQ ID NO: 42372
  CDS (1)..(1002): transl_table=11

SEQ ID NO: 100082 - protein, 333 aa, Burkholderia mallei ATCC 23344; identical to SEQ ID NO: 42373

SEQ ID NO: 100083 - DNA, 1059 bp, Burkholderia pseudomallei K96243; identical to SEQ ID NO: 42374
  CDS (1)..(1059): transl_table=11

SEQ ID NO: 100084 - protein, 352 aa, Burkholderia pseudomallei K96243; identical to SEQ ID NO: 42375

SEQ ID NO: 100085 - DNA, 1185 bp, Nocardia farcinica IFM 10152; identical to SEQ ID NO: 42376
  CDS (1)..(1185): transl_table=11

SEQ ID NO: 100086 - protein, 394 aa, Nocardia farcinica IFM 10152; identical to SEQ ID NO: 42377

SEQ ID NO: 100087 - DNA, 1032 bp, Nocardia farcinica IFM 10152; identical to SEQ ID NO: 42378
  CDS (1)..(1032): transl_table=11

SEQ ID NO: 100088 - protein, 343 aa, Nocardia farcinica IFM 10152; identical to SEQ ID NO: 42379

SEQ ID NO: 100089 - DNA, 993 bp, Nocardia farcinica IFM 10152; identical to SEQ ID NO: 42380
  CDS (1)..(993): transl_table=11

SEQ ID NO: 100090 - protein, 330 aa, Nocardia farcinica IFM 10152; identical to SEQ ID NO: 42381

SEQ ID NO: 100091 - DNA, 1029 bp, Haloarcula marismortui ATCC 43049; identical to SEQ ID NO: 42382
  CDS (1)..(1029): transl_table=11

SEQ ID NO: 100092 - protein, 342 aa, Haloarcula marismortui ATCC 43049; identical to SEQ ID NO: 42383

SEQ ID NO: 100093 - DNA, 1011 bp, Geobacillus kaustophilus HTA426; identical to SEQ ID NO: 42384
  CDS (1)..(1011): transl_table=11

SEQ ID NO: 100094 - protein, 336 aa, Geobacillus kaustophilus HTA426; identical to SEQ ID NO: 42385

SEQ ID NO: 100095 - DNA, 984 bp, Idiomarina loihiensis L2TR; identical to SEQ ID NO: 42386
  CDS (1)..(984): transl_table=11

SEQ ID NO: 100096 - protein, 327 aa, Idiomarina loihiensis L2TR; identical to SEQ ID NO: 42387

SEQ ID NO: 100097 - DNA, 1005 bp, Silicibacter pomeroyi DSS-3; identical to SEQ ID NO: 42388
  CDS (1)..(1005): transl_table=11

SEQ ID NO: 100098 - protein, 334 aa, Silicibacter pomeroyi DSS-3; identical to SEQ ID NO: 42389

SEQ ID NO: 100099 - DNA, 999 bp, Bacillus clausii KSM-K16; identical to SEQ ID NO: 42390
  CDS (1)..(999): transl_table=11

SEQ ID NO: 100100 - protein, 332 aa, Bacillus clausii KSM-K16; identical to SEQ ID NO: 42391

SEQ ID NO: 100101 - DNA, 1005 bp, Bacillus clausii KSM-K16; identical to SEQ ID NO: 42392
  CDS (1)..(1005): transl_table=11

SEQ ID NO: 100102 - protein, 334 aa, Bacillus clausii KSM-K16; identical to SEQ ID NO: 42393

SEQ ID NO: 100103 - DNA, 984 bp, Rhodobacter sphaeroides 2.4.1; identical to SEQ ID NO: 42394
  CDS (1)..(984)

SEQ ID NO: 100104 - protein, 327 aa, Rhodobacter sphaeroides 2.4.1; identical to SEQ ID NO: 42395

SEQ ID NO: 100105 - DNA, 996 bp, Azotobacter vinelandii; identical to SEQ ID NO: 42396
  CDS (1)..(996)

SEQ ID NO: 100106 - protein, 331 aa, Azotobacter vinelandii; identical to SEQ ID NO: 42397

SEQ ID NO: 100107 - DNA, 1050 bp, Actinobacillus pleuropneumoniae serovar 1 str. 4074; identical to SEQ ID NO: 42398
  CDS (1)..(1050)

SEQ ID NO: 100108 - protein, 349 aa, Actinobacillus pleuropneumoniae serovar 1 str. 4074; identical to SEQ ID NO: 42399

SEQ ID NO: 100109 - DNA, 972 bp, Pseudomonas aeruginosa UCBPP-PA14; identical to SEQ ID NO: 42400
  CDS (1)..(972)

SEQ ID NO: 100110 - protein, 323 aa, Pseudomonas aeruginosa UCBPP-PA14; identical to SEQ ID NO: 42401

SEQ ID NO: 100111 - DNA, 1005 bp, Dechloromonas aromatica RCB; identical to SEQ ID NO: 42402
  CDS (1)..(1005)

SEQ ID NO: 100112 - protein, 334 aa, Dechloromonas aromatica RCB; identical to SEQ ID NO: 42403

SEQ ID NO: 100113 - DNA, 1026 bp, Ralstonia eutropha JMP134; identical to SEQ ID NO: 42404
  CDS (1)..(1026)

SEQ ID NO: 100114 - protein, 341 aa, Ralstonia eutropha JMP134; identical to SEQ ID NO: 42405

SEQ ID NO: 100115 - DNA, 1002 bp, Methylobacillus flagellatus KT; identical to SEQ ID NO: 42406
  CDS (1)..(1002)

SEQ ID NO: 100116 - protein, 333 aa, Methylobacillus flagellatus KT; identical to SEQ ID NO: 42407

SEQ ID NO: 100117 - DNA, 990 bp, Exiguobacterium sp. 255-15; identical to SEQ ID NO: 42408
  CDS (1)..(990)

SEQ ID NO: 100118 - protein, 329 aa, Exiguobacterium sp. 255-15; identical to SEQ ID NO: 42409

SEQ ID NO: 100119 - DNA, 987 bp, Mesorhizobium sp. BNC1; identical to SEQ ID NO: 42410
  CDS (1)..(987)

SEQ ID NO: 100120 - protein, 328 aa, Mesorhizobium sp. BNC1; identical to SEQ ID NO: 42411

SEQ ID NO: 100121 - DNA, 1011 bp, Exiguobacterium sp. 255-15; identical to SEQ ID NO: 42412
  CDS (1)..(1011)

SEQ ID NO: 100122 - protein, 336 aa, Exiguobacterium sp. 255-15; identical to SEQ ID NO: 42413

SEQ ID NO: 100123 - DNA, 1050 bp, Burkholderia cepacia R18194; identical to SEQ ID NO: 42414
  CDS (1)..(1050)

SEQ ID NO: 100124 - protein, 349 aa, Burkholderia cepacia R18194; identical to SEQ ID NO: 42415

SEQ ID NO: 100125 - DNA, 999 bp, Burkholderia cepacia R1808; identical to SEQ ID NO: 42416
  CDS (1)..(999)

SEQ ID NO: 100126 - protein, 332 aa, Burkholderia cepacia R1808; identical to SEQ ID NO: 42417

SEQ ID NO: 100127 - DNA, 1032 bp, Burkholderia cepacia R1808; identical to SEQ ID NO: 42418
  CDS (1)..(1032)

SEQ ID NO: 100128 - protein, 343 aa, Burkholderia cepacia R1808; identical to SEQ ID NO: 42419

SEQ ID NO: 100129 - DNA, 996 bp, Listeria monocytogenes str. 1/2a F6854; identical to SEQ ID NO: 42420
  CDS (1)..(996): transl_table=11

SEQ ID NO: 100130 - protein, 331 aa, Listeria monocytogenes str. 1/2a F6854; identical to SEQ ID NO: 42421

SEQ ID NO: 100131 - DNA, 1044 bp, Rubrivivax gelatinosus PM1; identical to SEQ ID NO: 42422
  CDS (1)..(1044)

SEQ ID NO: 100132 - protein, 347 aa, Rubrivivax gelatinosus PM1; identical to SEQ ID NO: 42423

SEQ ID NO: 100133 - DNA, 1002 bp, Pseudomonas fluorescens PfO-1; identical to SEQ ID NO: 42424
  CDS (1)..(1002)

SEQ ID NO: 100134 - protein, 333 aa, Pseudomonas fluorescens PfO-1; identical to SEQ ID NO: 42425

SEQ ID NO: 100135 - DNA, 1002 bp, Rhodospirillum rubrum; identical to SEQ ID NO: 42426
  CDS (1)..(1002)

SEQ ID NO: 100136 - protein, 333 aa, Rhodospirillum rubrum; identical to SEQ ID NO: 42427

SEQ ID NO: 100137 - DNA, 1017 bp, Ralstonia metallidurans CH34; identical to SEQ ID NO: 42428
  CDS (1)..(1017)

SEQ ID NO: 100138 - protein, 338 aa, Ralstonia metallidurans CH34; identical to SEQ ID NO: 42429

SEQ ID NO: 100139 - DNA, 1020 bp, Ralstonia metallidurans CH34; identical to SEQ ID NO: 42430
  CDS (1)..(1020)

SEQ ID NO: 100140 - protein, 339 aa, Ralstonia metallidurans CH34; identical to SEQ ID NO: 42431

SEQ ID NO: 100141 - DNA, 999 bp, Burkholderia fungorum LB400; identical to SEQ ID NO: 42432
  CDS (1)..(999)

SEQ ID NO: 100142 - protein, 332 aa, Burkholderia fungorum LB400; identical to SEQ ID NO: 42433

SEQ ID NO: 100143 - DNA, 1002 bp, Burkholderia fungorum LB400; identical to SEQ ID NO: 42434
  CDS (1)..(1002)

SEQ ID NO: 100144 - protein, 333 aa, Burkholderia fungorum LB400; identical to SEQ ID NO: 42435

SEQ ID NO: 100145 - DNA, 996 bp, Burkholderia fungorum LB400; identical to SEQ ID NO: 42436
  CDS (1)..(996)

SEQ ID NO: 100146 - protein, 331 aa, Burkholderia fungorum LB400; identical to SEQ ID NO: 42437

SEQ ID NO: 100147 - DNA, 1020 bp, Burkholderia fungorum LB400; identical to SEQ ID NO: 42438
  CDS (1)..(1020)

SEQ ID NO: 100148 - protein, 339 aa, Burkholderia fungorum LB400; identical to SEQ ID NO: 42439

SEQ ID NO: 100149 - DNA, 993 bp, Novosphingobium aromaticivorans DSM 12444; identical to SEQ ID NO: 42440
  CDS (1)..(993)

SEQ ID NO: 100150 - protein, 330 aa, Novosphingobium aromaticivorans DSM 12444; identical to SEQ ID NO: 42441

SEQ ID NO: 100151 - DNA, 1014 bp, Cytophaga hutchinsonii; identical to SEQ ID NO: 42442
  CDS (1)..(1014)

SEQ ID NO: 100152 - protein, 337 aa, Cytophaga hutchinsonii; identical to SEQ ID NO: 42443

SEQ ID NO: 100153 - DNA, 987 bp, Silicibacter sp. TM1040; identical to SEQ ID NO: 42444
  CDS (1)..(987)

SEQ ID NO: 100154 - protein, 328 aa, Silicibacter sp. TM1040; identical to SEQ ID NO: 42445

SEQ ID NO: 100155 - DNA, 1020 bp, Psychrobacter sp. 273-4; identical to SEQ ID NO: 42446
  CDS (1)..(1020)

SEQ ID NO: 100156 - protein, 339 aa, Psychrobacter sp. 273-4; identical to SEQ ID NO: 42447

SEQ ID NO: 100157 - DNA, 1020 bp, Rubrobacter xylanophilus DSM 9941; identical to SEQ ID NO: 42448
  CDS (1)..(1020)

SEQ ID NO: 100158 - protein, 339 aa, Rubrobacter xylanophilus DSM 9941; identical to SEQ ID NO: 42449

SEQ ID NO: 100159 - DNA, 1002 bp, Polaromonas sp. JS666; identical to SEQ ID NO: 42450
  CDS (1)..(1002)

SEQ ID NO: 100160 - protein, 333 aa, Polaromonas sp. JS666; identical to SEQ ID NO: 42451

SEQ ID NO: 100161 - DNA, 954 bp, Corynebacterium glutamicum; identical to SEQ ID NO: 42452
  CDS (1)..(954): transl_table=11

SEQ ID NO: 100162 - protein, 317 aa, Corynebacterium glutamicum; identical to SEQ ID NO: 42453

SEQ ID NO: 100163 - DNA, 981 bp, uncultured bacterium 311; identical to SEQ ID NO: 42454
  CDS (1)..(981): transl_table=11

SEQ ID NO: 100164 - protein, 326 aa, uncultured bacterium 311; identical to SEQ ID NO: 42455

SEQ ID NO: 100165 - DNA, 1035 bp, Yersinia enterocolitica; identical to SEQ ID NO: 42456
  CDS (1)..(1035): transl_table=11

SEQ ID NO: 100166 - protein, 344 aa, Yersinia enterocolitica; identical to SEQ ID NO: 42457

SEQ ID NO: 100167 - DNA, 942 bp, Bacillus subtilis; identical to SEQ ID NO: 42458
  CDS (1)..(942): transl_table=11

SEQ ID NO: 100168 - protein, 313 aa, Bacillus subtilis; identical to SEQ ID NO: 42459

SEQ ID NO: 100169 - DNA, 1020 bp, Bacillus subtilis; identical to SEQ ID NO: 42460
  CDS (1)..(1020): transl_table=11

SEQ ID NO: 100170 - protein, 339 aa, Bacillus subtilis; identical to SEQ ID NO: 42461

SEQ ID NO: 100171 - DNA, 1005 bp, Bacillus subtilis; identical to SEQ ID NO: 42462
  CDS (1)..(1005): transl_table=11

SEQ ID NO: 100172 - protein, 334 aa, Bacillus subtilis; identical to SEQ ID NO: 42463

SEQ ID NO: 100173 - DNA, 1011 bp, Bacillus subtilis; identical to SEQ ID NO: 42464
  CDS (1)..(1011): transl_table=11

SEQ ID NO: 100174 - protein, 336 aa, Bacillus subtilis; identical to SEQ ID NO: 42465

SEQ ID NO: 100175 - DNA, 1002 bp, Bacillus subtilis; identical to SEQ ID NO: 42466
  CDS (1)..(1002): transl_table=11

SEQ ID NO: 100176 - protein, 333 aa, Bacillus subtilis; identical to SEQ ID NO: 42467

SEQ ID NO: 100177 - DNA, 26 bp, Primer
atgactgataaaaccattgcgttttc

SEQ ID NO: 100178 - DNA, 26 bp, Primer
ttatcccaacaactcttccttaacat

SEQ ID NO: 100179 - protein, 413 aa, consensus; identical to SEQ ID NO: 42470
  MISC_FEATURE (1)..(413): consensus for the disclosure of xaa see table XV

SEQ ID NO: 100180 - protein, 82 aa, consensus; identical to SEQ ID NO: 42471
  MISC_FEATURE (1)..(82): consensus for the disclosure of xaa see table XV

SEQ ID NO: 100181 - protein, 26 aa, consensus
  MISC_FEATURE (1)..(26): consensus for the disclosure of xaa see table XV
XXXXXXXXXXXXXAXXXXXXXXXXXX

SEQ ID NO: 100182 - DNA, 844 bp, Hordeum vulgare
  CDS (113)..(556)
ctcgttgaggttgttcgaggaagaggagcccgtcctccgcctccgccgctcgctgaagaaggcggtcgaggaggagaggtttgcggatgctgccaagtacagagatgaactgatgattttggctccgcactccctcctcaaatgttctagtgatgctacaactctggggataagggtacaagtcaggagtgtctatattgaaagccggagccaacccttaaaggggaaattcttttttgcctacagaatcagaattacaaataattctcaacgtgctgtacagcttctcagacgacactggattgtcaccgatgcgaatggaaggacagagaatgtttggggtgttggtgtagtgggagagcaacctgtaatattcccaaagactggttttgagtactcatctgcatgcccactaaacacgccaaatgggagaatggaaggagattttgagatgaagcacattgacaaggttggatcctcaacattcaatatcgccatcgcaccattctctctgtcaatcctcggggacgacaatgacgctcccctcagaaggtgattgagtagcagggcgagtttgaaaaaatggcaatgccagtaagagtttgcacaaatacacaaacatagttaatgttgttagagaagtatttagagcatggaacatagtccggactgatgttatgtctactatgaaaaagaacagtgtcaaatatgaatggtgaaggtgtcttggaaggtatggaattaacacggttcttgtaagtttgtgggctatgagcgcttactgtatcaattccacttttgaatatacagcatatagagagctttgttgaaaaaaaaaaaaaaa

SEQ ID NO: 100183 - protein, 147 aa, Hordeum vulgare
MILAPHSLLKCSSDATTLGIRVQVRSVYIESRSQPLKGKFFFAYRIRITNNSQRAVQLLRRHWIVTDANGRTENVWGVGVVGEQPVIFPKTGFEYSSACPLNTPNGRMEGDFEMKHIDKVGSSTFNIAIAPFSLSILGDDNDAPLRR

SEQ ID NO: 100184 - DNA, 1109 bp, Glycine max
  CDS (113)..(910)
gcagtagtgaggtacgatgatttgattttgatttggatggttgcgccagaggaataattaataacactaataggataggtttgtggggaaaattggaagcatcgatcagaaaatgcaatccttatcgttaagtatgagtctgaggagtagtagtttagcgaattttctgttgctgagttcagagacgagagtgagaagaagaagaaggagtgtcatcgtagcgtgtgctttggagggagacagtggtagcagtagcacaagctcctttctctctcggacccaaacctacgcccttcttaagcaacaattgcaagtggctgctaaatctgaggattacaaggaagcagctagaattcgagactcgttgaagcaatttgaggacgaggagcctgttttgcgtctgaggagactattgaaggaagcaattgctgaagagagattccaggatgctgctagttaccgtgatgagctaaacaatattgccccacactctcttttaaaatgttgcagcgatgctacaacattgggaatcagggttcaagttaggagtgtatatatagagggcagaagtcagccttcaaaggggctatacttctttgcatatagaataagaattaccaataactcagaccaccctgttcaacttcttagaaggcattggattataactgatgctaatgggagaacggaaaatgtctggggaattggagttgttggtgaacagccattaatacttcctggaaatagttttgaatactcttcagcatgcccactgaacacaccaaatggtagaatggaaggtgattatgagatgatccattttgaaagagtaggctcacgatcattcaatgtggccattgccccgttttctctctctctgcttggagatgatgaaggttgtgttatttgaaattgaactgctgcatcacttctgcgacatgtaaattattatcattctcatcaccattccgaagtattaaagcaggctatttgctttattaagtgtaaaatatctgaatgttacgaccaaaaatgatcagcatacatttgtattttattgaaatcaagaaagaaatcaatatcaatatttgtagaaaaaaaaaaaaaaa

SEQ ID NO: 100185 - protein, 265 aa, Glycine max
MQSLSLSMSLRSSSLANFLLLSSETRVRRRRRSVIVACALEGDSGSSSTSSFLSRTQTYALLKQQLQVAAKSEDYKEAARIRDSLKQFEDEEPVLRLRRLLKEAIAEERFQDAASYRDELNNIAPHSLLKCCSDATTLGIRVQVRSVYIEGRSQPSKGLYFFAYRIRITNNSDHPVQLLRRHWIITDANGRTENVWGIGVVGEQPLILPGNSFEYSSACPLNTPNGRMEGDYEMIHFERVGSRSFNVAIAPFSLSLLGDDEGCVI

SEQ ID NO: 100186 - DNA, 801 bp, Brassica napus
  CDS (163)..(693)
tctcgattttttcatttggttctgtttctgtgtagctgttaaagttatccaagaacaacaaggataagcctttttaactagttttgtgtgttggatcatctgttaagctcggtttaatctaccttgctcttgtgttggactgtgtttggagaagaaccaaagatgtcatcggatgagaagaatcttatagagatcttggaggaaggccacaaagtcgatatagtcaagtacatcaactacgtcagtgcccctcaagccggcgccatagcgacattctctggcactacgagagacatgttcgagggcaaagcagttttggagctaaggtacgaagcgtatgtccccatggccacaagaaccctcacctccatctgcacagccgctagatcaaactgggacatccacaagatcgctgtcgctcaccgtctaggaccagttcccgttggagaaaccagcgtgttcatcgcggtttcatccgttcaccgtggggatggtttagacgcttgtaggttcttgatcgatgagctcaaggcaacggttccgatttggaagaaggaggtgtacactaatggagaggtttggaaggagaatagtgagtttctggagaagagagacggtttggtgaagagagaacataaaagaagttgctgtggaagtaaagttagagtacaagaagatgaaaacagttcttgattacttatagcaaagagcaatgttttagttttttttctactctcaataagcaaaaatgtcttaaacacacacattgttgaatctaaagactccaaaaaaaaaaaaaaa

SEQ ID NO: 100187 - protein, 176 aa, Brassica napus
MSSDEKNLIEILEEGHKVDIVKYINYVSAPQAGAIATFSGTTRDMFEGKAVLELRYEAYVPMATRTLTSICTAARSNWDIHKIAVAHRLGPVPVGETSVFIAVSSVHRGDGLDACRFLIDELKATVPIWKKEVYTNGEVWKENSEFLEKRDGLVKREHKRSCCGSKVRVQEDENSS

SEQ ID NO: 100188 - DNA, 1114 bp, Brassica napus
  CDS (8)..(955)
gcaagcgatgttggggtgggcgatagcgttacacggcggtggaggagacattccgatcgacctccctgacgagctgcgtatccctcgcgagaccgctctgcgtcactgccttgatctcggcgtttccgccctcaaatccggcaaacatccattggacgtcactgaactcgtcgttcgtgaacttgagaaccacccatacttcaatgctggtaaaggatccgttctaactgcacaaggcactgttgaaatggaagcttctattatggacggtaaaaccaaaagatgtggagccgtctctggcctcaccactgtcgttaaccccgtctctttagctcgactcgtcatggagaaaactcctcatatctatcttgctttcaacgctgcagaagctttcgctagagcacatggcgttgagacggctgaatcaacctatttcataactcctgaaaacattgcaaggctaaaacaggccaaagagttcaatcgcgtccagttggattacacagcgcctacaccaaaagaacctgaaatccgtggcgacagccagataggaacggtgggatgtgtagcagtggacagcgctggaaacctagctgcggccacatcaaccggcggctatgtcaataaaatggctggcagaatcggagactctccgttgattggtgcaggaacgtacgctaaccacctttgtgccgtctcagccacaggtaaaggagaatatataatacgcgcaaccatggctagagaagtggctgcacttatggaatacaaaggtttgtctttaaccgaagcagcggcttatgctgttgaacagtccggacctagaggaacctgtggactcgttgctgtgtctgctaatggtgaagttgctatgccgtataacaccaatgggatgtttagagcttgtgcaacagaggatggtttcactgaggtcgcaatctggcctaaaaattgaaatctcactagactgacgggtggcatagtctactctgtttctgttttatgatttgaattctaactcccgcttatatatatactagatttgggtccgtgcgttgcaacggactttatttgatattttaatttaataaaaaaatattaaaaaaaaaaaaaa

SEQ ID NO: 100189 - protein, 315 aa, Brassica napus
MLGWAIALHGGGGDIPIDLPDELRIPRETALRHCLDLGVSALKSGKHPLDVTELVVRELENHPYFNAGKGSVLTAQGTVEMEASIMDGKTKRCGAVSGLTTVVNPVSLARLVMEKTPHIYLAFNAAEAFARAHGVETAESTYFITPENIARLKQAKEFNRVQLDYTAPTPKEPEIRGDSQIGTVGCVAVDSAGNLAAATSTGGYVNKMAGRIGDSPLIGAGTYANHLCAVSATGKGEYIIRATMAREVAALMEYKGLSLTEAAAYAVEQSGPRGTCGLVAVSANGEVAMPYNTNGMFRACATEDGFTEVAIWPKN

SEQ ID NO: 100190 - DNA, 1241 bp, Triticum aestivum
  CDS (18)..(995)
ccaacccagcaagcaccatggccggcacgtgcgcccacgtcgaattcctccgcgcgcagccggcgtgggcgctggccctcgcggccgtcggcctcctcgtcgccgcccgcgccgccctgcgcctcgccctctgggtctacgccgccttcctccgccccggcaagcccctgcgccgccgctacgggccctgggccgtcgtcaccggcgccaccgacggcatcggccgcgccatcgccttccgccttgccgcctccggcctcggcctcgtgctcgtcggccgcaacccggacaagctcgccgccgtctccgaggagatcaggggcaagtaccccaagaccgaggtccgcaccttcgtgctcgacttcgcttccgaggggctcgccgctggggtggaggcgctcaaggactccatccggggcctcgacgtcggcgtgctcgtcaacaacgccggggtctcgtacccgtacgcccgctacttccatgaggtggacgaggagctcatgcggagcctcatccgggtcaacgtcgagggggtaacgcgggtcacccacgccgtgctcccgggcatggtcgacaggaagcgtggcgcaatcgtcaacatcggctccggtgctgcctctgttgtgccgtccgatccactctactccgtctacgccgccacgaaagcgtacgttgaccagttctcaagatgcctctatgttgagtacaagggcaagggcattgatgtgcaatgccaggtgcccttgtacgtggcgacaaagatggcatcaatcaggaggtcttccttctttgtgccatccgcggacacctatgctcgtgctgctattcgccacattggctatgagccgaggtgcacaccgtactggccacactctgttctgtggttcttgatctcccttctcccagagtcacttgtggatagtacacgcctcagcatgtgcatcaagatccgcaagaaggggcaggctaaggatgccaagaagaaagcgcagtgatgattccgctgctagttcattgttgagatctgccatgtttcttcattatgtgtaatggactagtacttgtagctctgttgtcggcatttcagtatcattaccttcccatcacactaggttgagactgttgttgttcgttccacggttacgaaagcacaagcctgtaatactttatctccaaatgaatgtaacgccagctgcactaaaggtgaaaatgaaaaaagagagagagagaccgacacgcag

SEQ ID NO: 100191 - protein, 325 aa, Triticum aestivum
MAGTCAHVEFLRAQPAWALALAAVGLLVAARAALRLALWVYAAFLRPGKPLRRRYGPWAVVTGATDGIGRAIAFRLAASGLGLVLVGRNPDKLAAVSEEIRGKYPKTEVRTFVLDFASEGLAAGVEALKDSIRGLDVGVLVNNAGVSYPYARYFHEVDEELMRSLIRVNVEGVTRVTHAVLPGMVDRKRGAIVNIGSGAASVVPSDPLYSVYAATKAYVDQFSRCLYVEYKGKGIDVQCQVPLYVATKMASIRRSSFFVPSADTYARAAIRHIGYEPRCTPYWPHSVLWFLISLLPESLVDSTRLSMCIKIRKKGQAKDAKKKAQ

SEQ ID NO: 100192 - DNA, 1085 bp, Brassica napus
  CDS (80)..(880)
tggcctaaacttttacttatatataatcaacccacacaagtattctcattataacatcatccactttaatctgaggggaatggctggagaagagcaaagacgtagatggagccttcaaggcaagaccgcacttgtcaccggtggaaccaaaggcattgggcatgctatagtagaggaacttgcaggatttggggtgataatacatacatgtgctcgagacgaagcacatctcaacgagtgtttaagcaagtggaagaataaagggtttcaagtcactggttcagtctgtgacgtatcgtcctggaccgaaagagagaagctaatgcaaactgtgtactctttgtttgatgccaagctcagtatccttatcaacaatgctggcgcaatccggtcaaagccaacaatagagcatacggctgaggatttctcgttccacatttcgaccaacttggaatctgcgtatcattttagccagcttgcacatcctctgctcaaagcttcaggatgtggtaacatcgtgttcatatcctccatttctggggtcgtctcacttagcatcagctccatctacagtgccacaaaaggggcaatgaatcagctagcaaggaatttggcatgcgagtgggcgagcgacagcataagagctaattctgtagctcctacattcattgccactccactggttgataatgcgtttgatgatgaatttaaaaaagtggtagaatcaacaaatcccttggggcgcataggaaaaccagaggaggtagcatcggtggtggcatttctttgtatgcctgcagcttcttacataacgggtcagaccatttgcgttgatggaggtctttcggtcaatggcttctcgtatcagccacacgcttaatcccaactaccaaaacaaataaaattgaagttcagtaataagtttgagtgttcagactttgtatccttcatatgattatgtttttcattattccctctgtttcaaataagttgatgttttttaaaataaataaaattagttgatgttttaaggtttttgcacacgttttatgaaattattaattttattccaaaaaaaaaaaaaa

SEQ ID NO: 100193 - protein, 266 aa, Brassica napus
MAGEEQRRRWSLQGKTALVTGGTKGIGHAIVEELAGFGVIIHTCARDEAHLNECLSKWKNKGFQVTGSVCDVSSWTEREKLMQTVYSLFDAKLSILINNAGAIRSKPTIEHTAEDFSFHISTNLESAYHFSQLAHPLLKASGCGNIVFISSISGVVSLSISSIYSATKGAMNQLARNLACEWASDSIRANSVAPTFIATPLVDNAFDDEFKKVVESTNPLGRIGKPEEVASVVAFLCMPAASYITGQTICVDGGLSVNGFSYQPHA

SEQ ID NO: 100194 - DNA, 981 bp, Glycine max
  CDS (14)..(856)
agtagacacagccatgtccactactggtactgttctggcttccactccaacacaaaggctattaggcaaagtggcattggttactggtggagcgtctggaattggagaaagcattgtgcgcctcttccatatccatggtgctaaaatatgtatagctgatgtgcaagacaaccttggaaagcaggtctgtcagtctcttggtgatgaagcaaatgttgtttttgtccattgtgatgttacagtagaggatgatgtttcccatgcagtggacttcactgtgggtaaatttggcacccttcacatcatagtcaacaatgccggaatttctggatcaccttgttccgatatccgcaatgcagacttatcagaattcgataaggtgtttagtgtaaatacgaagggagtgttccacgggatgaaacacgctgctcgaattatgatcccgaagaagaagggctcaatcatttctttatgcagtgtagcaagtgccataggtggcttaggaccgcatgcatacacagggtccaagtatgctgtattggggctcacaaagaatgttgcagctgaattggggaaacatgctataagagtgaactgtgtgtcaccttatggtgttgcaacaggtttggccttggctcatttgcctgaggatgagagaactgatgatgccttggtcagttttcgtgattttactgggagaatggccaacttgcagggggtagaattaactactcacgatgtggctaatgctgtgctcttccttgcaagtgatgatgctaaatatataagtggagagaatctcatggttgatggaggcttcacaagtgcaaatcactcactccaagtttttagatgattaatggtatttcaatgtttgttagtttgcataatttgaggcattgcaatcctgatgtctagtacaagggttttcagttaacatacaaaacaaaatgaaaatgctcctctaaaaaaaaaaaaaaa

SEQ ID NO: 100195 - protein, 280 aa, Glycine max
MSTTGTVLASTPTQRLLGKVALVTGGASGIGESIVRLFHIHGAKICIADVQDNLGKQVCQSLGDEANVVFVHCDVTVEDDVSHAVDFTVGKFGTLHIIVNNAGISGSPCSDIRNADLSEFDKVFSVNTKGVFHGMKHAARIMIPKKKGSIISLCSVASAIGGLGPHAYTGSKYAVLGLTKNVAAELGKHAIRVNCVSPYGVATGLALAHLPEDERTDDALVSFRDFTGRMANLQGVELTTHDVANAVLFLASDDAKYISGENLMVDGGFTSANHSLQVFR

SEQ ID NO: 100196 - DNA, 1119 bp, Glycine max
  CDS (75)..(971)
agcaagttgtttttttttttagagaagagaagcaataaatcaatcaatcaaatcattcttacattgttgttacgatggaatcaccgttcagaccagagattctgaagggaaaggttgctctaatcaccggtggagcctccggaatcggattcgaaatttccacccaattcggcaaacatggagcctcggtcgcgctcatgggccgccgcaagcaagttcttcagtccgctgtctccgttctccaatccctcgccattcccgcggttgggtttgagggggatgtgcggaagcaagaggatgcggtgagggtggtggaatcgactttcaagcattttggaaggattgatatacttgtgaatgctgcagctgggaactttctcgtttctgcagaggatttgtccccaaatggctttcggacagttctggacattgattctgttggcacattcacaatgtgccatgaagcactaaaatatctcaaaaaggggggagaaggaaggagcaactcttctagtgggggatcaataataaacattagtgctaccttgcattacacagcttcttggtatcaaattcacgtgtctgcagcaaaggctgcagttgatgccactacgagaaacttggcactagaatggggaacagactatgatattagagtcaatgggattgcaccaggtccaataagtgacacccctggcatgagtaaactggctcctgatgaaataagtagcaaagccagagattacatgccgctgtataaacttggggagaagtgggatattgccatggctgcacttttcctagtatcagatgcaggaaaattcattaatggcgacattatgattgttgacggaggactttggctgagtcggcctcgccatttagcaaaagaggctgtgaagcaggtatctcgatcagtagaaaacagatccagaaatgcatctgtcagtgttccaaaaagcaagctgtgaaccagcagattcaggtgttagcccctctacacagccgggaaacaaattataatttgtagaatactatggatttggaagatatcatctgttacttttaaattattaaatagttgaactttctcaaactatcaagaaaaaaaaaaaaaaa

SEQ ID NO: 100197 - protein, 298 aa, Glycine max
MESPFRPEILKGKVALITGGASGIGFEISTQFGKHGASVALMGRRKQVLQSAVSVLQSLAIPAVGFEGDVRKQEDAVRVVESTFKHFGRIDILVNAAAGNFLVSAEDLSPNGFRTVLDIDSVGTFTMCHEALKYLKKGGEGRSNSSSGGSIINISATLHYTASWYQIHVSAAKAAVDATTRNLALEWGTDYDIRVNGIAPGPISDTPGMSKLAPDEISSKARDYMPLYKLGEKWDIAMAALFLVSDAGKFINGDIMIVDGGLWLSRPRHLAKEAVKQVSRSVENRSRNASVSVPKSKL

SEQ ID NO: 100198 - DNA, 1163 bp, Glycine max
  CDS (83)..(877)
ggtagtcttactcctgctcagatccatattacattgttctgcctttcctttgcaactagttcattgaagagcaacaaaaataatggctgaaacaaagttgagctttaaggacaaaagatggtcactccatgggatgactgctctagtcacaggagccacccgcggcatagggcatgccattgttgaagaattggcagaatttggggcagctgttcatatttgtgcacggaaccaagatgatattgataaatgtttggaagagtggaaaagcaagggacttactgtgacgagttcagtatgtgatttacaatgttctgaccaacgtataagattaatggaaattctttcctccatcttccacggaaagctcaatattttagtgaacaatgctgcgacaactataacaaagaaaataatagattacactgcagaagatatatcaaccataatgggtactaattttgagtccgtttatcatttgactcaacttgcacacccgcttctaaaagaatctggacaaggaagcatagtatctatttcgtccattgcaggtttaaaagcccttcccgttttctctgtttatgcagcttccaaaggagccatgaatcaattcaccaaaaacttagcattggaatgggcaaaggataatattcgtgcaaatgctgtggcacctggacctgttatgacaaaacttttggactctatcatgaattcttctggaggggatgagtctgtggatggaatagtgtctcaaacacttgttggtcgcatgggagaagctaaagagatatcagcattagttgcctttctttgccttccagctgcatcatacatcactggacaggttatatgtgctgatgggggtttcacaacttagtttactgctattcatttggctgctgaataaaattctagtgttctttctctaccgtttgagtttcttccgaccgaatcatgcttggtatatcgttggttggatttgtcaactgtttttaaacatttagccatgtgtttttatttagtcccgttgtaagtgtgtctttctgccaaactattcaacaaggcagaataattgttaataaccttctcccttaggttatccttttgtggtgttaaaaatgaaacatcacttcatcgtacgtttgtggtaaaaaaaaaaaaaa

SEQ ID NO: 100199 - protein, 264 aa, Glycine max
MAETKLSFKDKRWSLHGMTALVTGATRGIGHAIVEELAEFGAAVHICARNQDDIDKCLEEWKSKGLTVTSSVCDLQCSDQRIRLMEILSSIFHGKLNILVNNAATTITKKIIDYTAEDISTIMGTNFESVYHLTQLAHPLLKESGQGSIVSISSIAGLKALPVFSVYAASKGAMNQFTKNLALEWAKDNIRANAVAPGPVMTKLLDSIMNSSGGDESVDGIVSQTLVGRMGEAKEISALVAFLCLPAASYITGQVICADGGFTT

SEQ ID NO: 100200 - DNA, 1098 bp, Glycine max
  CDS (36)..(920)
tcgaaaagtttccttgacaatctaattctgcaaaaatggcaagcaataaggagtctaagttcccagcacagagccagaaaactcagccaggaaaagaacatgtaatgaatccactcccacaagccacaaatcctgatcacaaggccgccaataaactccagggaaaggtggcgttggtgacaggaggtgactcaggaattggcagagcggtttgcctgtgtttcgcaaaagagggtgcaaccgtggcctttacatacgtaaagggccatgaggacagggataaagatgatactctgaagatgctgcttgaagctaagacaagtggtgcagacaatccattggcaatagcagcggatattggctttgatgagaactgcaaacaggtcattgaccttgttgtcaaagaatatggccgccttgatgttctggtcaacaatgcagctgagcagcatttgacaaactctgttgaggaaatcacacaacagcagcttgagagagtcttcggaaccaacatcttttctcagttctttttggtcaagcatgctctgaagcacatgaaagaagggagctgcatcataaactctacttcagttaatgcatacaatgggaatccagaagcgttggactacactgctaccaagggagcaattgtggccttcaccagaggtctttctcagcagctagcgagtaggggaattagggtgaatggtgtggcacctggcccagtttggacgccaatacaaccagcttcaaagcctgctgagatgattcagaacttggggtgtgaggtgccaatgaaccgcgtggctcagccttgtgagattgcaccatgttatttgttcttggcaacttgtcaggactcttcctactttactggccaagtcctccatccaaatggtgggatggtcgtcaacgcttaagctatagtgtgccttcacctatttcctattgaactggtttttctagcttacccctcctgaataagcagtgttacgttcggatgcatattttacgttgaaatacattgtgtttgtagcatatatgccttgagatgaataaacctttacgtgagttatttatcttcaaaaaaaaaaaaaa

SEQ ID NO: 100201 - protein, 294 aa, Glycine max
MASNKESKFPAQSQKTQPGKEHVMNPLPQATNPDHKAANKLQGKVALVTGGDSGIGRAVCLCFAKEGATVAFTYVKGHEDRDKDDTLKMLLEAKTSGADNPLAIAADIGFDENCKQVIDLVVKEYGRLDVLVNNAAEQHLTNSVEEITQQQLERVFGTNIFSQFFLVKHALKHMKEGSCIINSTSVNAYNGNPEALDYTATKGAIVAFTRGLSQQLASRGIRVNGVAPGPVWTPIQPASKPAEMIQNLGCEVPMNRVAQPCEIAPCYLFLATCQDSSYFTGQVLHPNGGMVVNA

SEQ ID NO: 100202 - DNA, 1263 bp, Triticum aestivum
  CDS (8)..(922)
ctcatccatggcatcaaccatgccgttctccgctggcctcgtttctcttgggtctccgccgccgcagcgccacagctgcaggttccagcgatatcatcgaccgggcactctcatttcatcagctataaggcatggtcaggttaaagctatggctggagtgagcatggatggcttggcacagcctcaagccccagttgcagtggttaccggagcatcgagggggattgggcgagcgatagctgtggctcttggcaaagcagggtgcaaggtagttgtgaactatgccaagtcaggcatggaagctgaagaagtgtgcagagagatcatggagtccggtggcactgccatctccttttcagccgatgtctccattgaagccgaggttgaaaccatgatgagagcggtaattgatacttggggaacgctggacgtgatggtgaacaatgcagggatcacgcgagatgctctgctaatgcggatgaagaaggcgcagtggcaggaagtagtggacgtaaaccttaccggtgtttacctctgcgcccaggctgcggcggcagtgatgatgaagaggaagaagggaagaatcatcaacatcgcctcagttgccgggatgatcggcaacattggccaggccaactactgcgccgccaaggccggggtgattggattgaccaaggccatggcccgggaatacggtggcagaaacataaatgtgaatgcagtttccccgggctgggtcgcgtctgacatgaccgcaaaactaggcgacgacatcgaacgaaaggcgctcgagacaataccactaggacgattcggcaagccagaggagattgctggactggtggagttcttggctgttcatccggctgcaagctacatgaccgggcaggtgctcccagttgatggtggcctgtccatttgagtgttactgaaaccgaacctaagcgagatgtggaaacgtaaattttccaatgagaaacaaggttgtgtcacacaaaattaagcacaagagggctccatgcctttgcgtcaggcttgtggcgtacggagtgcctactcatgtgttctttactgggaggttggagaaagttatagtctggatggaaattcagtagtatgtattgcccatagcgtatactcgatcatttggttcaaccgaaagtaccagaaaaataaccaaagttaacgaatgtatatccaagatgtattgtacaagtccgccaaatgtaatgttttggctgtccaaagaaaaaaaaaaaaaaa

SEQ ID NO: 100203 - protein, 304 aa, Triticum aestivum
MASTMPFSAGLVSLGSPPPQRHSCRFQRYHRPGTLISSAIRHGQVKAMAGVSMDGLAQPQAPVAVVTGASRGIGRAIAVALGKAGCKVVVNYAKSGMEAEEVCREIMESGGTAISFSADVSIEAEVETMMRAVIDTWGTLDVMVNNAGITRDALLMRMKKAQWQEVVDVNLTGVYLCAQAAAAVMMKRKKGRIINIASVAGMIGNIGQANYCAAKAGVIGLTKAMAREYGGRNINVNAVSPGWVASDMTAKLGDDIERKALETIPLGRFGKPEEIAGLVEFLAVHPAASYMTGQVLPVDGGLSI

SEQ ID NO: 100204 - DNA, 662 bp, Triticum aestivum
  CDS (19)..(381)
cggctctacgaggaggagatggccgcggtagacgacatcatcggctccagtgcggggaggtggtccctccacggcaggacggcgctcgtcaccggcggaacccgcggcatcgggcgctcggtggtggaggagctggcggcgctcggggccgccgtgcacacgtgctcccggaaggaagccgagctcggcgagcgcttgaaggagtgggaggccaggggattccgcgtcacgggctccgtctgcgacgtctccgtgcgcgaccagcgcgagctcctgctccacaccgtcgccggccgcttcgccggcaagctggacatcctcgtacgtgaagcaccccatatcttctccccagtccccacgcctttgtcgatctgttgctaaaccctggagtatgtagttatctttcctagtttcgtcacaaactttgcatgttttgattcctgtatatgtcggcatagtatatctctttggaaatactgcgtgtagtgtcctgtggatctgagtaaatgtgagaaaagataagtgctgaatactgtctctgtagccgtatgcctgtgactcgtggcgtgtcatcatgttattattttggcttcagaaaacaaagctcttcttggtttgtcgtcatgaatgaccagtaatttaaaacgaaaaaaaaaaaaaaa

SEQ ID NO: 100205 - protein, 120 aa, Triticum aestivum
MAAVDDIIGSSAGRWSLHGRTALVTGGTRGIGRSVVEELAALGAAVHTCSRKEAELGERLKEWEARGFRVTGSVCDVSVRDQRELLLHTVAGRFAGKLDILVREAPHIFSPVPTPLSICC

SEQ ID NO: 100206 - DNA, 1359 bp, Zea mays
  CDS (207)..(1163)
gaattcccgggtcgacgatttcgtcgtgcgctccgcccgtcgcgccgtcatcgcggagcttccaaagcccccgtcccccaatagactcctccccatccgtgctctgctccgtcacggctcaaatactccgcctgcatctccaaagcacactgctccctctggcttcccgcctcctcttcggctccttcgcgtcccgacgccccctcatggccaccgccgccgccaccgcagcagcagcagcagtctcctccccggctgcgcgtggagcagccggggccgccgccgcctcccgccgggggttcgtcacgtttggtggaggcgccgcccgcttctctcccacgctgcggtccggccgtgggttctctggtgtgcaaacccatgttgctgctgttgaacaagcagttgtaaaagatgctaccaagctggaagctccagttgttgttgttacaggtgcatctagagggattggtaaggcaactgctctagcccttggaaaagcaggatgcaaggttctggtaaactatgcccggtcctcgaaagaggctgaagaggtctccaaagagattgaagcatctggtggtgaggctatcaccttcggaggagatgtttcaaaagaagctgatgtagagtctatgatgaaagcagctctagataaatggggaacaatagatgtgctggtaaataatgcagggattacacgagacacattgttgatgaggatgaagaaatctcagtggcaagacgtaattgatctgaatcttactggcgtcttcctttgtacacaggctgcaacaaaagtaatgatgaaaaagagaaagggaaaaattatcaacattgcatctgtagttggtcttactggcaatgttggccaagctaattatagcgcagccaaggctggagtgattggtttcacaaaaacagttgccagggagtatgcaagcagaaatatcaatgtgaatgctattgcaccagggttcattgcatctgatatgactgccgaacttggagaagagcttgagaagaaaatcttgtcaaccattccgttagggagatatggccaaccagaggaagttgcagggttggtcgagttcctggcccttaaccccgcagctagctatatgactggacaggtgcttacaattgacggagggatggtaatgtaagatttgagttagcttgatgcacttctacttttgctgagcatttaatgttgaacacccttgttgtgcacgggcgattttggacaacaaattagtgttgtctctttctttgtaatactctctggtaataaatctagcatgtggaatggaagttgaaatctgggttttcgtgcaaaaaaaaaaaaaaaaaagcggccgc

SEQ ID NO: 100207 - protein, 318 aa, Zea mays
MATAAATAAAAAVSSPAARGAAGAAAASRRGFVTFGGGAARFSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDKWGTIDVLVNNAGITRDTLLMRMKKSQWQDVIDLNLTGVFLCTQAATKVMMKKRKGKIINIASVVGLTGNVGQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 100208 - DNA, 2333 bp, Triticum aestivum
  CDS (179)..(2083)
ggaagaaggacgggacgacttcgtctcccccagcagacagctcccgcctcggcagctccgcaggccggccgtgctgcccatacccactcccctctcccccgtaccgccccgtctccctccgtgcttctctcgctcgctcgcctgaagctggtcggtctccccccaccgcgccggcgagatggagctgaagcccggcatgtcggccctcgtcaccggcggcgcctccggcatcgggaaagcgctctgcatcgcttttgcacaaaagggtctatttgtgactgtggtcgatttctctgaacaaaatggaagagaagtcacttcgctagttcaaaaggaaaacaaaaagtttcatggagatgttggagtaccgtctgccatattcgtcaagtgtgatgtttctattgaaggtgatctagctgctgcttttgcgaaacatgtagacacatatggtggactagatatctgcatcaattgtgctggaattgccaacaaaacattagtttatgatgatatatctgacggaactaggacatggaggcatgccataaatgtgaactttgtcgctgttattgatggtactcgcattgcaagtcaaataatgcgatcccggaagaagcctggtatcataatcaatattggttcagctgcgggcctttatcccatgttcgccgatcccatatatactgggacaaaaggtggtgttgttatgtttactagatcacttgctccattgaaacgccatggtgttcgtgtcaacgtgctctgccccgagtttgttcagactaatatggctgagcaaataaatcaaaaaatagtacatgcaactggtggatttttgaagatggaggaagttgttaatggtgcatttgaacttataaaagatgagagcaaagctggtgcttgcctttggataactaagcggagagggatggaatattggccatcagcagaggaacaaagaaaatatctgttgaattataccaagtcaaaaagaacagtaacaaagaatgtatttcctagcatccaaacacctgagttttatgagaagatagttgttcacacactcagccataatttccgcaatgctacaagaattgatcgtgtgcgattgagattgcccattgaaccacaaagtgcgctagttaaaataatatacgctggtgtaaatgctagtgatgtaaacttcagctccggacggtatttcagtggtagtgctaaagaaactgctgcacgccttccattcgatgctggttttgaggctgtgggaattgttgcttctgttggagatgcagtgagccatgtcaaagttggcagtcctgtggcccttatgacttttggaagctatgctgaatttacgatggttccagccaaacatcttcttccggtgccaagaccagacccggaggttgttgctatgctaacatcaggattgaccgcttcaatttctcttgaaaaggcaggtcaaatgacatctgggcaagttgttttagttacagcagctgctggtggaacaggacagttcgcggttcagcttgcaaaactagcaggcaacaaggttgttgccacatgtggtggcgaaagtaaggctgcatttctagcttccttaggtgttgatcgagttatcaactaccagcatgagaagatcaaagatgttctggaaaaggagtttccaaaaggtgtagatattatatatgaatctgtaggtggggacatgtttgatttgtgcttgaatgcgctcgcagtccatggacgcctcattgtaattggtatgatctctcagtatcaaggagaggagggatggaagccgaagaactacactggactatgtgagaagattcttgctaaaagtcaaactgtggctggatttttcctggttcaacatgctcacatgtggcaagatcatcttgacaaactatttgagttgtatgcctctggaaagctaaaggtctcgctcgaccctaagaaattcctgggcgttgcttccgcggtggatgctgtagagtatcttcattctggcaagagcgtcggcaaggtcgtcgtctgcatcgatccagcatacagccagaccctcgctaagctgtagcctgtactccgcagagacgtcatcacaatgcatgacgcaggaaatgtaatttatgacaagtgcgtacgttatggtggtgcacattcagtgtcgaggcgaggaacttagtagttgcatagtaaagtcaccgtgtagctcggttgtctgatcagtttgcaaccggccaagcgttatatagaaaccaaataagtgtacgattccacataccatgcctaaataaatgaatagattgctcaaaaaaaaaaaaaaa

SEQ ID NO: 100209 - protein, 634 aa, Triticum aestivum
MELKPGMSALVTGGASGIGKALCIAFAQKGLFVTVVDFSEQNGREVTSLVQKENKKFHGDVGVPSAIFVKCDVSIEGDLAAAFAKHVDTYGGLDICINCAGIANKTLVYDDISDGTRTWRHAINVNFVAVIDGTRIASQIMRSRKKPGIIINIGSAAGLYPMFADPIYTGTKGGVVMFTRSLAPLKRHGVRVNVLCPEFVQTNMAEQINQKIVHATGGFLKMEEVVNGAFELIKDESKAGACLWITKRRGMEYWPSAEEQRKYLLNYTKSKRTVTKNVFPSIQTPEFYEKIVVHTLSHNFRNATRIDRVRLRLPIEPQSALVKIIYAGVNASDVNFSSGRYFSGSAKETAARLPFDAGFEAVGIVASVGDAVSHVKVGSPVALMTFGSYAEFTMVPAKHLLPVPRPDPEVVAMLTSGLTASISLEKAGQMTSGQVVLVTAAAGGTGQFAVQLAKLAGNKVVATCGGESKAAFLASLGVDRVINYQHEKIKDVLEKEFPKGVDIIYESVGGDMFDLCLNALAVHGRLIVIGMISQYQGEEGWKPKNYTGLCEKILAKSQTVAGFFLVQHAHMWQDHLDKLFELYASGKLKVSLDPKKFLGVASAVDAVEYLHSGKSVGKVVVCIDPAYSQTLAKL

SEQ ID NO: 100210 - DNA, 1396 bp, Linum usitatissimum
  CDS (116)..(1084)
ccggagcttccaaagccatagatactctataaaaccgaagctccattcgcgattctctctggctactctcatcgctttgcattctttcaggaggaacctagtaggcggagctatcatggctgctagtaccggatccaccgccgtcgtattcaaatccgccggcttcgccacctcctccggcgaaaggagcattaaccagttccgccactggtctccggttcccgccagcctccactcctcccgcgctggcctccgctgtagatcgagaagctcggtatcctcttccggtgtgagagctcaggttgctgcagttgaaccagtcagcagtgagtcagttaagaaggtggaatctccagtagttattgtaactggagcttccagaggaatcgggaaagcgattgcattgtcgttggggaaagcaggttgcaaggttctggttaactatgcaaggtcatctaaggaggctgaggaagtctccaaagagattgaagcttccggtggtcaagctgtaacctttggtggtgatgtctctaaagaagaggatgtggaggccatgatgaaaactgctattgatgcttttggaacagttgacatactgataaacaatgcagggatcacaagggacactttgttgatgcggatgaagaaacagcagtggcaggatgttattgacctcaatcttactggtgtcttcctttgtacacaggctgcagccaagatcatgatgaagaaaagaaagggaaggattatcaatatcgcttcagttgttggtttggttggtaacgttgggcaagctaactacagtgctgcaaaggcaggagtcattggattcacaaagagtgtcgcaaaggaatattcaagcagaaatatcaacgtcaatgctgttgctcctggattcattgcatctgacatgactgccaagcttggggatgacattgaaaagaaaatcttggagacgattcctttagggcggtacggtcagccggaagaggtggccggattggtggaattcctcgctctgaacccagctgctggctacatgaccgggcaggtgcttaccatcgacggaggaatggtgatgtaaagcgaacaaagagggttccccgctccgaaagctgcatattgccgtattccagatacgtgacctttcgcatagtcaaatttttaccagcaaaatgtgtcctatgattagagcttagcagagttaataaaccgaattgcagtatttggtaggattctttaatagcaatgtccaaatgtactcgattctgtggttagtctttgatagagtttgtgacgtcgtttgttatttccttctgggaattcaatcaaagctgtgttgtatgaattactgaactgatatttcatattttgactgtccaaaaaaaaaaaaaaa

SEQ ID NO: 100211 - protein, 322 aa, Linum usitatissimum
MAASTGSTAVVFKSAGFATSSGERSINQFRHWSPVPASLHSSRAGLRCRSRSSVSSSGVRAQVAAVEPVSSESVKKVESPVVIVTGASRGIGKAIALSLGKAGCKVLVNYARSSKEAEEVSKEIEASGGQAVTFGGDVSKEEDVEAMMKTAIDAFGTVDILINNAGITRDTLLMRMKKQQWQDVIDLNLTGVFLCTQAAAKIMMKKRKGRIINIASVVGLVGNVGQANYSAAKAGVIGFTKSVAKEYSSRNINVNAVAPGFIASDMTAKLGDDIEKKILETIPLGRYGQPEEVAGLVEFLALNPAAGYMTGQVLTIDGGMVM

SEQ ID NO: 100212 - DNA, 1075 bp, Hordeum vulgare
  CDS (24)..(842)
agcggcgggtggttggcgggccgatggctgcggcggagacgtcgggatcgagccagccgggcgctccaggacggtggtctcttcacggcaaaacggctctcgtcaccggaggcacccgcgggatcgggcgtgcggtggtggaggagcttgccgcgctgggggcggccgtgcacacctgctcccggaaggaggcggagcttggcgagcgcctcaaggagtgggaggccaggggcttccgcgtcacaacctccgtctgcgacctctccgtccgggagcagcgggagcgcctgattggcgaggtcgccgaacgcttcggaggcaagctcaacatcctcgtaaataatgtggggacaaacataaggaaaccaactactgaattttctgctgaagattactcttttttgatggccactaaccttgaatctgcatatcatctgtgccaacttgcacatcctcttctaaaagcatctggtttgggcagcattgtttttgtatcatctgtctgtggattagtagccgtatttagcggctctatatatgctatgaccaaaggtgccatcaaccaattaaccaagaacctagcatgtgaatgggcgaaagatggcataagaacaaactctgttgctccatggtacataacaacgtcacttacagaaggacttttggctaacaaggaatttgaggcctccgttgtgagtcgaacaccacttgggcgtgtcggagaaccaggagaagtatcatcgctggttgcttttctttgcatgcctggtgccacttacataacaggccagacgatctcagtggatggaggtatgactgtcaatgggatgtatccagcataaagactgccattctactaaggaagatgctatgtatcgatttgctgcccaggagcccagtcataccttgtgttcttggcaaccaaaataagtgctgtattcctgtaaaactgagctcaccttgaacactattattcgccattgttcaggtcagccatgtgaagaaagttgtggtcagatttgtgctattatttttagaatgtggcgagctctttcagtttaaaaaaaaaaaaaaa

SEQ ID NO: 100213 - protein, 272 aa, Hordeum vulgare
MAAAETSGSSQPGAPGRWSLHGKTALVTGGTRGIGRAVVEELAALGAAVHTCSRKEAELGERLKEWEARGFRVTTSVCDLSVREQRERLIGEVAERFGGKLNILVNNVGTNIRKPTTEFSAEDYSFLMATNLESAYHLCQLAHPLLKASGLGSIVFVSSVCGLVAVFSGSIYAMTKGAINQLTKNLACEWAKDGIRTNSVAPWYITTSLTEGLLANKEFEASVVSRTPLGRVGEPGEVSSLVAFLCMPGATYITGQTISVDGGMTVNGMYPA

SEQ ID NO: 100214 - DNA, 1305 bp, Hordeum vulgare
  CDS (3)..(986)
gaatgctcctcctcctcgctttcctcgccgccgccgccgccgccgccttcttcctcttcaagttcgtcaccgccgatggggatttcaccctcttgtcgtgcggccggccgcggcgggacaaagtggacggcaaggttgtgtggataacgggagcgagccgtgggattggggaggttctttcgatgcagtttgcgagtttaggagcaaagctcatactatctgcacgtaacaaggaggagcttgagagagtgaaacataacatcatgagcaagcatccagatagcaaagttgaagtgttacccatggatttatcatctgatgaaaaatctctgaaagaagttgtacattcagcggaatctctcttttccagtgctggcattgactatatgatgcacaatgcagcctttgagcgtccaaaaaggggagccctggaagaaaccgaggaaggtcttaaggctacttttaaggtcaatgtctttggaacaattactttgactcgccttcttgcacccttcatgttggatagagggatgggtcattttgttgtgatgagtagtgcagctggaaaggtgcccacacctggtcaggctctttactctgcttccaaacatgctctcaatgggtactttgcttctctgcgttctgagttatgtacgaaaggcattaaggtcactgttgtctgtcctggacctattgaaacaccagaatcttctggtgcaacttcttcatcacaaaggcattcgtccgagaaacgtgtttcagtggaaagatgtgctgaactgacaatagttgccgcaactcatggactaaaagaagcatggatatcatatcagcctgtgctggctgttatgtacgtggtgcaatacatgccaacaattggatgctggcttatggataaggttggtgcgaagcgagttgatgccgctgcaaagaaaggcaacgcctacagctggaatctcctcttcggtggcaaaaagtcggcttgacgatgaagttgctcattacacctatagttggaatctacaagatgcgagaggacgttggagatgtacatcaaaataactgtttatgtccgtttaatcctataggtgtacttcctctgtacctaaataactgactagttctctccaactacaattatctaggtaagggagtacaagtctatatagattatgaaccttgttaccctttttcatctttatgtgcgacatgaccagtgggaaggcaagcacgccttgtaccgtcacctagtcagtgagtttcaagtattttagaactcaaatacaaaccaaaaaaaaaaaaaaa

SEQ ID NO: 100215 - protein, 327 aa, Hordeum vulgare
MLLLLAFLAAAAAAAFFLFKFVTADGDFTLLSCGRPRRDKVDGKVVWITGASRGIGEVLSMQFASLGAKLILSARNKEELERVKHNIMSKHPDSKVEVLPMDLSSDEKSLKEVVHSAESLFSSAGIDYMMHNAAFERPKRGALEETEEGLKATFKVNVFGTITLTRLLAPFMLDRGMGHFVVMSSAAGKVPTPGQALYSASKHALNGYFASLRSELCTKGIKVTVVCPGPIETPESSGATSSSQRHSSEKRVSVERCAELTIVAATHGLKEAWISYQPVLAVMYVVQYMPTIGCWLMDKVGAKRVDAAAKKGNAYSWNLLFGGKKSA

SEQ ID NO: 100216 - DNA, 1129 bp, Hordeum vulgare
  CDS (46)..(834)
cgcacacgcagacgcacacagagcgatctagcccgagagatagagatggcggccggcggcatgagcagggaggagaggtggagcctggccggcgcgacggcgctcgtcaccggcggcagcaaaggcatcggccaggcgatcgtggaggagctggcggggcacggggcgcgggtgcacacgtgcgccaggagcgcggcggagctggaggagtgccgccgccggtgggaggccaaggggctcccggtcaccgtctccgtctgcgacgtctccctgcgcgccagcagggagcagctcgtggagacggtcaagcaagtcttcggcggcaagctcgacatactggtgaacaacgcggcacagattcttgccaaggcggccgtggagtggacatcggaggagtactcgcacctcatggcgaccaatctagagtcgtgcttccacctcagccagctcgcgcaccccttgctcctcaacgcctccatcgctggaggtagcatcgtcaacatatcctcccttgggggcacacttggtttcacgggccttgcgctttacagtatgacaaaaggaggaataaaccagcttacaaggagccttgctactgaatgggcccagaacaagatccgggtgaattgcgtcgccccgggcgcgaccaagagtgacatgttaagcagtctcccactggagattagagagaacgagttggcgaggactccaatgcggcgggcaggcgagccagcggaggtggctgcaatggtgtcgttcctctgcatgccggcggcatccttcgtcaccggccaggtcatcgccgtcgacggtggtcggacaattagtgcttagttaattaggagtaccttacctgtaaactcttcttcaggttgatcaaatagtaaagtagcagcaagtagttagcaaggacctgagtgttatccgctagtataattattttgccacattgttgttagtttttaatatgtttctaaggttgatttgcctattttactagccaagcaaccgtggccgcacccatgatgcatgatcttggatgttggcattgttattactagcaaaagagcctgtgccttgcattggaaacatatacaaataaaacattgaacgcaaaaaaaaaaaaaaa

SEQ ID NO: 100217 - protein, 262 aa, Hordeum vulgare
MAAGGMSREERWSLAGATALVTGGSKGIGQAIVEELAGHGARVHTCARSAAELEECRRRWEAKGLPVTVSVCDVSLRASREQLVETVKQVFGGKLDILVNNAAQILAKAAVEWTSEEYSHLMATNLESCFHLSQLAHPLLLNASIAGGSIVNISSLGGTLGFTGLALYSMTKGGINQLTRSLATEWAQNKIRVNCVAPGATKSDMLSSLPLEIRENELARTPMRRAGEPAEVAAMVSFLCMPAASFVTGQVIAVDGGRTISA

SEQ ID NO: 100218 - DNA, 934 bp, Brassica napus
  CDS (8)..(736)
cgggacgatgacgatagcgacgcctttcagcggggctgcgaactcggttacgtcggcgaaagtcgtgctgataacgggagtgagcaaaggtctgggaagagccttatctctcgagatggcgaagagaggccacactgtgattggatgcgcccgcactcaggagaagctcaccgctcttcaatcggagctctcctccccggaaaatcatctcctcctcaccgccgatgtgaaatcagatagcagcgtcaaagagatggcacacacaattatggagaagaaaggtgtcccagacatcatagttaacaatgccggtactatcaataagaacaacaagatttgggaagtctctgcagaagattttgacagtgtcatggatacaaacgttaaaggagtagtaaatgtactgcgacatttcatccctttgatgctcccacggaagcaagggattattgttaacatgtcttctggatggggaagatctggtgctgccctggttgcaccttactgtgcatcgaaatgggcgattgagggtttaagccgatcagtggcaaaggaggtagccgaaggaatggcagtggttgcattaaatccaggagtgatcaacacagaaatgctcacttcctgctttggcaacacagcttccttgtatcaagctcctgatgcttgggctgtgaaggctgcaacgatgattctgaaccttacagcgggtgataatggcggatctcttacggtctaacaactaaactacactttgcttttttgacttcagtaatatggacaaggagcttcttcagcagagtccattgatttgaggctttaattcatttctgtaaccagaaattttagcatagtcactacgttctaagttcaactaagctgtattttcttgtaacgttttcacctaagtcaattttagatcaaaaaaaaaaaaaaa

SEQ ID NO: 100219 - protein, 242 aa, Brassica napus
MTIATPFSGAANSVTSAKVVLITGVSKGLGRALSLEMAKRGHTVIGCARTQEKLTALQSELSSPENHLLLTADVKSDSSVKEMAHTIMEKKGVPDIIVNNAGTINKNNKIWEVSAEDFDSVMDTNVKGVVNVLRHFIPLMLPRKQGIIVNMSSGWGRSGAALVAPYCASKWAIEGLSRSVAKEVAEGMAVVALNPGVINTEMLTSCFGNTASLYQAPDAWAVKAATMILNLTAGDNGGSLTV

SEQ ID NO: 100220 - DNA, 1359 bp, Zea mays; identical to SEQ ID NO: 100206
  CDS (207)..(1163)

SEQ ID NO: 100221 - protein, 318 aa, Zea mays; identical to SEQ ID NO: 100207

SEQ ID NO: 100222 - DNA, 1241 bp, Triticum aestivum; identical to SEQ ID NO: 100190
  CDS (18)..(995)

SEQ ID NO: 100223 - protein, 325 aa, Triticum aestivum; identical to SEQ ID NO: 100191

SEQ ID NO: 100224 - DNA, 1396 bp, Linum usitatissimum; identical to SEQ ID NO: 100210
  CDS (116)..(1084)

SEQ ID NO: 100225 - protein, 322 aa, Linum usitatissimum; identical to SEQ ID NO: 100211

SEQ ID NO: 100226 - DNA, 1305 bp, Hordeum vulgare; identical to SEQ ID NO: 100214
  CDS (3)..(986)

SEQ ID NO: 100227 - protein, 327 aa, Hordeum vulgare; identical to SEQ ID NO: 100215

SEQ ID NO: 100228 - DNA, 1034 bp, Glycine max
  CDS (16)..(843)
ttaggtcatatatcaatggcaacttcaacctctgcactcaataaaaggctggaaggaaaagttgcactgatcacaggaggagctagtggcatcggcaaacgcactgcagaagtgttcgctcagcaaggagccaaagtagtgatcgctgacatccaagacgaactgggacattccgttgctcagtccatagggccatcaacatgttgttatgtccattgcgatgtcaccgatgagaaccaaataaaaaatgccgtccaaaaagccgtagatgcttatgggaagctagacatcatgttcaacaacgccggcattgttgatcccaacaagaaccgaatcattgacaacgataaggcagatttcgaacgtgtcctaagcgtcaatgtcacgggtgttttccttgggatgaagcatgcggcgcaggcgatgatcccagcacgcagtggtagcatcatctctacggccagcataagctcctacgttggtggtgcagcctcgcatgcttactgttgtgctaagcatgctgtggttggtctaactaaaaatgcagcagttgagcttggacagttcggaataagggtgaattgtttgtcaccttacgctcttgctacacctttggccaccaagtttgttggagctaatgatgaggagcttgagactatcatgaactcactggctaatctcaagggtgtcactcttaaagctgaggatgtggctaatgccgcactttattttgctagtgatgattccaggtacgtcagtgggcaaaatttgctcatagatggaggcttcagcattgttaatccttcctttcacatgtttcagtacccggactcggagtcttgatttttgtctactatgaagaagcaagagtaattaataagggctcatatagattgagctatagtgcttgtgggattgggctttgattgtaaaacatacgggtgtttaaaaatgttgaactgaaccaaattgtgtgaaatcatcctatttaatttgtttcaattcaagtttactatagcaaaaaaaaaaaaaaa

SEQ ID NO: 100229 - protein, 275 aa, Glycine max
MATSTSALNKRLEGKVALITGGASGIGKRTAEVFAQQGAKVVIADIQDELGHSVAQSIGPSTCCYVHCDVTDENQIKNAVQKAVDAYGKLDIMFNNAGIVDPNKNRIIDNDKADFERVLSVNVTGVFLGMKHAAQAMIPARSGSIISTASISSYVGGAASHAYCCAKHAVVGLTKNAAVELGQFGIRVNCLSPYALATPLATKFVGANDEELETIMNSLANLKGVTLKAEDVANAALYFASDDSRYVSGQNLLIDGGFSIVNPSFHMFQYPDSES

SEQ ID NO: 100230 - DNA, 1085 bp, Brassica napus; identical to SEQ ID NO: 100192
  CDS (80)..(880)

SEQ ID NO: 100231 - protein, 266 aa, Brassica napus; identical to SEQ ID NO: 100193

SEQ ID NO: 100232 - DNA, 981 bp, Glycine max; identical to SEQ ID NO: 100194
  CDS (14)..(856)

SEQ ID NO: 100233 - protein, 280 aa, Glycine max; identical to SEQ ID NO: 100195

SEQ ID NO: 100234 - DNA, 1119 bp, Glycine max; identical to SEQ ID NO: 100196
  CDS (75)..(971)

SEQ ID NO: 100235 - protein, 298 aa, Glycine max; identical to SEQ ID NO: 100197

SEQ ID NO: 100236 - DNA, 1163 bp, Glycine max; identical to SEQ ID NO: 100198
  CDS (83)..(877)

SEQ ID NO: 100237 - protein, 264 aa, Glycine max; identical to SEQ ID NO: 100199

SEQ ID NO: 100238 - DNA, 1098 bp, Glycine max; identical to SEQ ID NO: 100200
  CDS (36)..(920)

SEQ ID NO: 100239 - protein, 294 aa, Glycine max; identical to SEQ ID NO: 100201

SEQ ID NO: 100240 - DNA, 1263 bp, Triticum aestivum; identical to SEQ ID NO: 100202
  CDS (8)..(922)

SEQ ID NO: 100241 - protein, 304 aa, Triticum aestivum; identical to SEQ ID NO: 100203

SEQ ID NO: 100242 - DNA, 662 bp, Triticum aestivum; identical to SEQ ID NO: 100204
  CDS (19)..(381)

SEQ ID NO: 100243 - protein, 120 aa, Triticum aestivum; identical to SEQ ID NO: 100205

SEQ ID NO: 100244 - DNA, 1359 bp, Zea mays; identical to SEQ ID NO: 100206
  CDS (207)..(1163)

SEQ ID NO: 100245 - protein, 318 aa, Zea mays; identical to SEQ ID NO: 100207

SEQ ID NO: 100246 - DNA, 1241 bp, Triticum aestivum; identical to SEQ ID NO: 100190
  CDS (18)..(995)

SEQ ID NO: 100247 - protein, 325 aa, Triticum aestivum; identical to SEQ ID NO: 100191

SEQ ID NO: 100248 - DNA, 2333 bp, Triticum aestivum; identical to SEQ ID NO: 100208
  CDS (179)..(2083)

SEQ ID NO: 100249 - protein, 634 aa, Triticum aestivum; identical to SEQ ID NO: 100209

SEQ ID NO: 100250 - DNA, 1396 bp, Linum usitatissimum; identical to SEQ ID NO: 100210
  CDS (116)..(1084)

SEQ ID NO: 100251 - protein, 322 aa, Linum usitatissimum; identical to SEQ ID NO: 100211

SEQ ID NO: 100252 - DNA, 1004 bp, Linum usitatissimum
  CDS (7)..(840)
gcaaaaatgagtgccactaacgccgctagttccgtcattagaaggctggaaggcaaagtggcgctgatcaccggcggagctagcgggataggagaagccacggccaagctgttcgtccaacacggcgccaaggtcgtcatcgccgatgtcaaagaccaactcggcgggtcactcactgagaagctggggggcccacacgcggccacctacgtccactgcgacgtcacacatcctgcccacgtcagcgatgcggttgacgcggcagtgtccacgtatggccagctggacatcatgcacaacaatgccggcatcgccggcaactttgatcctcgcatcctcaactccgacgacgataattttaagcgagtcatcgacattaacctcttcggcgccttcctaggtgccaagcatgccgccagggtgatggtaccggcggggagaggcggctgcatcctgttcacagccagtgcagtctcggtgactagcggcaacatttcgtacgcatacaaggtgtcgaagaacggggtagtggggctggccaacaatctgtgcgcggagctgggacagcatgggattcgagtcaacgcgatatcgcctttcgcgctggcgacgccgttactgagggcggcgctgggcgggatgggaaaggaggagggtgacgcgttcgtcgagaagatagggaacttgaaagggactgttctgaaagagggggatattgcagcggcggcattgtacctggctagcgacgatgctaagtacgtgagcgggatgaatttggtcgtggatggaggtcacaggcagaacaaccccatatttcctgcttcgacgttcactaagtagtgtcgatacgccaattcgaaggatttgtcgatcagaatcattaagttttcacgtatcttgattaagtatctattcgtgaggacggttatagtatcataaataataaaatgtattatgtcacaccaataataaaatgtattattgacactaaaaaaaaaaaaaaa

SEQ ID NO: 100253 - protein, 277 aa, Linum usitatissimum
MSATNAASSVIRRLEGKVALITGGASGIGEATAKLFVQHGAKVVIADVKDQLGGSLTEKLGGPHAATYVHCDVTHPAHVSDAVDAAVSTYGQLDIMHNNAGIAGNFDPRILNSDDDNFKRVIDINLFGAFLGAKHAARVMVPAGRGGCILFTASAVSVTSGNISYAYKVSKNGVVGLANNLCAELGQHGIRVNAISPFALATPLLRAALGGMGKEEGDAFVEKIGNLKGTVLKEGDIAAAALYLASDDAKYVSGMNLVVDGGHRQNNPIFPASTFTK

SEQ ID NO: 100254 - DNA, 1075 bp, Hordeum vulgare; identical to SEQ ID NO: 100212
  CDS (24)..(842)

SEQ ID NO: 100255 - protein, 272 aa, Hordeum vulgare; identical to SEQ ID NO: 100213

SEQ ID NO: 100256 - DNA, 1305 bp, Hordeum vulgare; identical to SEQ ID NO: 100214
  CDS (3)..(986)

SEQ ID NO: 100257 - protein, 327 aa, Hordeum vulgare; identical to SEQ ID NO: 100215

SEQ ID NO: 100258 - DNA, 1129 bp, Hordeum vulgare; identical to SEQ ID NO: 100216
  CDS (46)..(834)

SEQ ID NO: 100259 - protein, 262 aa, Hordeum vulgare; identical to SEQ ID NO: 100217

SEQ ID NO: 100260 - DNA, 1006 bp, Zea mays
  CDS (50)..(811)
cttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacctctggacgtatcaataatggtgcttatgtatccccttttttttgtgccaaaaaaaaaaaaaaa

SEQ ID NO: 100261 - protein, 253 aa, Zea mays; identical to SEQ ID NO: 67063

SEQ ID NO: 100262 - DNA, 1450 bp, Brassica napus
  CDS (31)..(1272)
gcaatccgtaactccgcttcacgggggacgatgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgagcgtaggatcgctggcacctccttcatggagtatcttccgatgggagggagtgtcaaaatggtggacgagacattgaagcttgcctatggggacaactctgagtttatcaaagacaaaaggattgctgcagttcagtctctctccggcactggagcttgccggctcttcgcagacttccagaaacgtttccgtcccgattcgcagatctacattcctgtaccaacctggtccaaccaccacaacatctggagagatgcacaagtcactcaaaagacgtaccattactaccatccagaaaccaagggcttggatttctcagggttgatggatgatgtgaagaatgctccgcaaggctccttcttccttctccacgcttgtgctcacaatcctactggagtagaccctacagaggagcaatggagagagatctcacagctattcaaggccaaaaaccatttcgcattcttcgacatggcctatcaaggctttgcaagcggtgaccctgcgagagacgccaagtccatcaggatctttctcgaggacggtcatcatattggaatctctcagtcttatgctaagaacatgggactctacggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagcttagagaagttaggatcgcctctatcatgggagcacgtaaccaagcagattggaatgttctgctacagtgggatgacaccagaacaggttgaccgtttaacaagcgaatatcacatctatatgacccgtaatggtcgtatcagtatggccggtgttacaacaggaaacgtgggataccttgcgaatgctatacatgaagtcaccaagtcatcttaaattgttttacatgtctcaagtcgagagataaatttgtttctttttgaaagagttaataagacagaggaagcttacaacatttgttcttcttcaattgttttggtggggactgaaagtcttacccacaaacagtaacttatcagcgcaataaaattttgaaccgcaaaaaaaaaaaaaa

SEQ ID NO: 100263 - protein, 413 aa, Brassica napus
MMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPQGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPALKGLWLKEVKVMADRIIGMRTALRESLEKLGSPLSWEHVTKQIGMFCYSGMTPEQVDRLTSEYHIYMTRNGRISMAGVTTGNVGYLANAIHEVTKSS

SEQ ID NO: 100264 - DNA, 1535 bp, Brassica napus
  CDS (89)..(1306)
taactttgatactctcaaaaagcttcgtgaagaaaaaaaaagataaattctcttcatccagattcatctttttacgatacttgctctaatggagtccgtcttctcaaacgtcgttcgtgctcccgaagatcctattctcggtgtgacggttgcttacaataatgatccaagcccagctaagctcaatttgggtgtcggtgcctatcgaactgaggaagggaagccacttgttcttgacgtggtgcgaagggcggagcaacagcttgtgaacgatccgtcccgggtcaaggaatacattcctattgctggacttgctgattttaacaaacttagcgctaagctcatcttaggtgctgatagtcctgcaattcaagagagtagagttgctacaatccagtgcttgtctggtactgggtcattgagagttggggctgagtttctcaaaaaacactaccaccaaagtgtcattttcattccgaaaccaacttgggggaaccatcccaaagttttcaacctggctggcttgtctgtggagtactaccgttactatgatccctcgacccgtggacttgacttccaaggcttactcgaggatcttggtgctgcaccatctggagcgattgtcttacttcatgcatgtgctcacaatcccactggagttgacccaacctctgaacagtgggaacagattcggcaactaataagatctaaaagcttgttaccgttttttgatagtgcatatcagggttttgctagtggtagcctagacacagatgcacattcagtccgcacctttgttgctgatggcggtgaatgcttgatagctcaaagttatgccaaaaatatgggactctatggggagcgtgttggtgcccttagcattgtctgcaagtcatcagatgtggctagtaaggttgagagccaggtgaaacttgttgtgcgacccatgtactcgagcccacctattcatggagcatcaattgttgccaccattctgaaaagcagtgatatgtacaatgactggaccatcgagctgaaaggaatggctggccgcattattagcatgcgccaacacttatttgaagctctacaagctaaaggcacacctggtgattggagtcacattatcaaacagattgggatgttcacttttactggattgaacaaggagcaagttgccttcatgaccaaagagtttcacatttacatgacatctgacgggagaataagcatggcaggtctcagttcgaagacggtgcctcacctggttgaagctatacatgctgcagttacccgcgtcgcctaaactaaagcgagacgatatttttcttgtttcgtcgaataaaatgaaattttcaaaaacaaaaaaaaaaacatcttccttggtttatagactaaggatttttcccattggtatcatatgtttcctcatatctttttggccaaggatgtttgaaccaaacaaaccgagtattgcgacactgaaatcttcaatgttgaaggaaaatattggttattagcaaaaaaaaaaaaaa

SEQ ID NO: 100265 - protein, 405 aa, Brassica napus
MESVFSNVVRAPEDPILGVTVAYNNDPSPAKLNLGVGAYRTEEGKPLVLDVVRRAEQQLVNDPSRVKEYIPIAGLADFNKLSAKLILGADSPAIQESRVATIQCLSGTGSLRVGAEFLKKHYHQSVIFIPKPTWGNHPKVFNLAGLSVEYYRYYDPSTRGLDFQGLLEDLGAAPSGAIVLLHACAHNPTGVDPTSEQWEQIRQLIRSKSLLPFFDSAYQGFASGSLDTDAHSVRTFVADGGECLIAQSYAKNMGLYGERVGALSIVCKSSDVASKVESQVKLVVRPMYSSPPIHGASIVATILKSSDMYNDWTIELKGMAGRIISMRQHLFEALQAKGTPGDWSHIIKQIGMFTFTGLNKEQVAFMTKEFHIYMTSDGRISMAGLSSKTVPHLVEAIHAAVTRVA

SEQ ID NO: 100266 - DNA, 1435 bp, Brassica napus
  CDS (75)..(1325)
aatcatgcttaaataattgaggactctacaaccttttcttccaaattcactatcgattgattagtcattttgtgatgagttccatcttgtcaaacgtccttcctgctccggaagatccttttctcagtgcttttaatcttctttgtatggtcacaaaacaggttatttttgcctgtagggatgatccttgtccagttaagttgaatttgagtgcgggtgcctatcgaaccgaggagggaaagcctcttgttcttgaggtggtgagaaaagcagagcaacagttagcgaatgacctatcttgtgacaagggttatctctcaattgatggacttgctgattttaacaaattgagcgccaagctgatcttaggtgatgatagtcatgcagtggatgagaatagagttgttactatccagtgtttgtctggtactggttctttgagagtcggagctgagtttctagcaaaacaccaccaacaacgagtcgttttcgttccaaatccaacttgggggaaccatccctttattttcacattggcgggtttaagtgtagagtatttccgttactatgatccgcaaacccgaggactcgacttcgaaggcatgctcgaggatcttggtgctgcaccgcctggagctattgtggtattgcaatcttgtgcgcataaccccacaggaattgacccaacactggaacaatgggaaaagattcgacaaattgtgaggtctaaaggtttattacccttctttgataatgcatatcagggttttgctagtgggaaccttgactcagatgcacaatcggtgcgtatgtttgttgctgatggaggtgaatgtttgatagctcaaagttttgccaaaaacatgggtctttatggtgagcgtattggtgctcttaccattgtatgcacctcacaagatgtggctaggaaaattcacagtcaagtgttacttgttgttagacctatgtatcttagcccaccaattcatggagcatccattgttaccacaattcttaaaaacagtgatatgtacaaggactggactatcgagctgaaaggcatggctgaccgcatcataagcatgcgccaacagttatatgaagctatacaagctagaggtacacccggtgattggagtcacattatcaaacagattgggatgttttcttttacaggactgaatgagaagcaagttcgttggatggccaaagaatatcacatttatattacttatgatgggaggataagcattgcaagtctaagttcaaagacagtgcctcaactcgctgatgctatacatgctgcagttacccgccttgcctaatccaatgattctgttcttttgttgtttcataaataaattggttaaaaacagagttcctggttaacatttcattagcgaaaacaaagaagcgtacttaaaaaaaaaaaaaa

SEQ ID NO: 100267 - protein, 416 aa, Brassica napus
MSSILSNVLPAPEDPFLSAFNLLCMVTKQVIFACRDDPCPVKLNLSAGAYRTEEGKPLVLEVVRKAEQQLANDLSCDKGYLSIDGLADFNKLSAKLILGDDSHAVDENRVVTIQCLSGTGSLRVGAEFLAKHHQQRVVFVPNPTWGNHPFIFTLAGLSVEYFRYYDPQTRGLDFEGMLEDLGAAPPGAIVVLQSCAHNPTGIDPTLEQWEKIRQIVRSKGLLPFFDNAYQGFASGNLDSDAQSVRMFVADGGECLIAQSFAKNMGLYGERIGALTIVCTSQDVARKIHSQVLLVVRPMYLSPPIHGASIVTTILKNSDMYKDWTIELKGMADRIISMRQQLYEAIQARGTPGDWSHIIKQIGMFSFTGLNEKQVRWMAKEYHIYITYDGRISIASLSSKTVPQLADAIHAAVTRLA

SEQ ID NO: 100268 - DNA, 1633 bp, Glycine max
  CDS (49)..(1332)
cctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgaggttacaaaatcattctagattattcaatcacccaacaggtgaccaaatttttgtctttggagacaaacatctcagaagtagtacccttatccaggggagcaaaataaatttaataaagtctgacaaattttcaacttgtttcggggtaagatagtgatactcttcagggtttaccttgcatattgaagacccttattgcaatacgtatccgatttatcatatccatgcaccatagattatatccatttttacagacatcttgtttagcactttaatgagcataaccctgtatcatcattttttttaaaaaaaaaaaaaa

SEQ ID NO: 100269 - protein, 427 aa, Glycine max
MAIRNSLTGQFLRRSSVAGARLMSSSSSWFRSIEPAPKDPILGVTEAFLADQSPNKVNVGVGAYRDDHGKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLHACAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVADAIHEVTKSF

SEQ ID NO: 100270 - DNA, 1692 bp, Brassica napus
  CDS (138)..(1499)
gaattcccgggtcgacgtaagccacttgaagagggagcatcacccaaggaagaacctctttcacgctaacacaatctcgatctgatcgttttcgaaaccgcgcggttccaacgaagctcagcttaccgattgattccatggcttcatcaatgctgtctctcggttctacttctctgctacctcgcgtgattaacaaggataagctaaagcttggaacttccggttccaaccccttcctgaaagcaaagtcttttagcagggtgaccatgtcggttacagtcaagccttctcgctttgagggtatcactatggctccaccagaccctattcttggagtcagcgaagctttcaaagctgacactaacgagcttaagctcaatctcggtgttggtgcttatcgaactgaggaactccagccttatgtccttaatgttgttaaaaaggcggagaacctgatgttggagagaggagataacaaagagtatctcccaatcgaagggttggctgcattcaacaaggccactgctgagctgctgtttggagctggtcatcctgttattaaggaacaaaaggtggcaacaattcaaggtctttccggaacaggttcactgagactagcagcggctcttatcgagcgttattttcctggagctaaagtgcttatatctgcaccaacatggggtaaccacaagaacatcttcaacgacgccaaagttccctggtctgaataccgctactatgatcccaaaacaattggtttggactttgaagggatgatagcagatataaaggaagctccagaaggatcattcatactgctacacggatgtgctcacaacccaactggaatcgacccaacacctgaacagtgggtgaaaattgctgacgtcattcaagaaaagaaccacatcccatttttcgatgttgcataccagggctttgctagtggaagccttgacgaagacgcagcttccgtgagactatttgctgagcgtgggatggagtttttcgtcgctcagtcgtatagtaaaaacttgggtctttatgctgaaaggattggagctatcaacgtcgtctgctcatcagctgatgctgctacaagggtgaagagccagttgaaaaggatagctaggcctatgtactcgaacccaccggttcacggtgcgaggatcgtggctaatgtagtgggagatgcagctatgttcaacgagtggaaagcagagatggaaatgatggcggggaggattaagacggtgagacagcagctgtacgacagcctcgtttcgaaggataagagcggcaaagactggtcgtttattctgaagcagattggcatgttctcattcaccggtctcaacaaagctcagagtgataacatgacggacaagtggcatgtgtacatgactaaagacgggaggatatcgttggctggactgtctatggcgaaatgcgagtaccttgctgatgccatcatcgactcgtaccataacgtaagctgagttttggttttcgagaagattacaatgagaactgaagttttatttataccctttttagcttctccttcatctcatttgaaagaattgctaaaatgaataagctaagctcagctcaggctgttatatctatgacatttagtcaaggaaactttttttaatttgattgtgtttcacaggctaaaaaaaaaaaaaa

SEQ ID NO: 100271 - protein, 453 aa, Brassica napus
MASSMLSLGSTSLLPRVINKDKLKLGTSGSNPFLKAKSFSRVTMSVTVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDAAMFNEWKAEMEMMAGRIKTVRQQLYDSLVSKDKSGKDWSFILKQIGMFSFTGLNKAQSDNMTDKWHVYMTKDGRISLAGLSMAKCEYLADAIIDSYHNVS

SEQ ID NO: 100272 - DNA, 1601 bp, Triticum aestivum
  CDS (132)..(1412)
cagaacaacatagcggcacgcaacacgccagccgcagcaaagcaccggtgccgcgccgcttcctcaggacccaagtcacctgccatctcctccccagcagcggcaaactcgccaccgcacgcagcgacggcatggcgatgtctcgcgccgcggcagcggtcgggcggcgccggtgcgggccgcgcctgcccgcggcgaggtccatggcgtcgtggttcggccacgtggagccggccgccaaggaccccatcctcggcgtcaccgaggccttcctcgccgacccctcgccggacaaagtgaacgtcggcgtcggtgcgtaccgggacgacgacgggaagcccgtggtgctcgagtgcgtgcgcgaggcggagcggcgcatcgccgggagcaccaacatggagtaccttccaatgggaggaagcgtgaagatgatcgaggagtcgctgaagctggcatacggggaggattctgagttcatcaaggacaagaggattgcggcagtgcaggctctttcagggactggtgcatgtcgcctctttgcagatttccagaaacgcttcttgccggattcacagatctacatacctacgcctacatggtcaaaccatcacaacatttggagggatgcccaggtaccacaaagaacatttgcctactaccacccggaatcaagaggactggactttgcaggcctaatggatgatatcaagaacgctccagagggttccttctttttgcttcatgcatgtgctcacaatcccactggggtcgatccttctgaggaacagtggagagagatatctcaacaattcaaggtgaagaaccatttcccatttttcgacatggcataccaaggatttgccagtggtgacccagagagagatgccaaggcaattcggatctttctcgaagatggacatcaaattggatgtgcacagtcatatgcaaaaaacatgggactttatggccaaagagcaggatgccttagtattctctgcgacgatgaaatacaagcagttgatgtgaagagccagttacaacagattgccagacctatgtacagcaacccaccccttcacggcgcactaattgtttccactatccttggtgatccagcactgaaaagcttatggctgaaagaggtcaagggtatggctgatcgcattattggaatgcgaaaagcacttaaggagagccttgaaaagttgggttcaccattatcatgggaacatattactaatcagattggcatgttttgctacagcgggatgacacctgaacaagttgatcgcttaacaaatgaatttcacatatacatgactcgtaatggcaggataagcatggctggtgtaacaacaggaaatgtcgcatatttggctaacgctattcatgaggtcactaagccaatttaagaccccttcctccctcctgccattttgagaaataagaggagcctttcaacttcaagttgcagtttgcttttaatttccttaaaccttttatgttccaacaatgttgtttttatcaaacaatgtcccatattgttgtgacctatgggtgtgcaaatattgatttgtttcatcccgacacgcagcggccgc

SEQ ID NO: 100273 - protein, 426 aa, Triticum aestivum
MAMSRAAAAVGRRRCGPRLPAARSMASWFGHVEPAAKDPILGVTEAFLADPSPDKVNVGVGAYRDDDGKPVVLECVREAERRIAGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPESRGLDFAGLMDDIKNAPEGSFFLLHACAHNPTGVDPSEEQWREISQQFKVKNHFPFFDMAYQGFASGDPERDAKAIRIFLEDGHQIGCAQSYAKNMGLYGQRAGCLSILCDDEIQAVDVKSQLQQIARPMYSNPPLHGALIVSTILGDPALKSLWLKEVKGMADRIIGMRKALKESLEKLGSPLSWEHITNQIGMFCYSGMTPEQVDRLTNEFHIYMTRNGRISMAGVTTGNVAYLANAIHEVTKPI

SEQ ID NO: 100274 - DNA, 1509 bp, Glycine max
  CDS (103)..(1362)
ccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttgatgtgagatttttaaaggaaacttttctgaaaaaaaaaaaaaa

SEQ ID NO: 100275 - protein, 419 aa, Glycine max; identical to SEQ ID NO: 55167

SEQ ID NO: 100276 - DNA, 1596 bp, Zea mays
  CDS (68)..(1297)
gaattcccgggtcgacgatttcgtagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccatgaaggtcaacctcggggttggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcatggaagacctcggttctgctccttcaggttcaattgtactgctgcatgcctgtgcccacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaactgctcatggctcagagctacgctaagaacatgggattgtatggagagcgtgttggcgctttgagcattgtatgtagaagtgccgatgtagctgttagggttgaaagtcaactcaaacttgtcatcaggcctatgtattcaaaccctcctcttcatggtgcctctattgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtggcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatttgtttttttactctgttcgtggggcagttttgtattggtggattcataatgactctgattatggtgcgttgggaacttctaataatatgcacatgaaattttgcttcaggtgcaaaaaaaaaaaaaaaaaaaaaaaaaaaaaaaaaaaaaaaaaaaaaataaaaaaaaaaaaaaaaaagcggccgc

SEQ ID NO: 100277 - protein, 409 aa, Zea mays
MASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 100278 - DNA, 1624 bp, Hordeum vulgare
  CDS (91)..(1464)
ccaaggccatcgccatccacccgctccgctctgatcccagatcaccctcgccccctcctgctccgaacgctgcacctctcgccccagcggatggcctccgccctctccgcgccggcggcctccgccgtcgccgccgccgccgcccggcgcaaggtgttcggcggaggaaggaacgacgggagggccgggtgccgcgtcgggatcgcgaggaagaatactggccacatagcgatggcacttacagtacacgcttctcgctttgaaggagtgtcgatggcccctccagacccgatccttggggtctcggaagcgtttaaagcagatacaagtgatctgaagctcaaccttggtgttggcgcctacagaacggaagagctacagcccgcagtcctcaacgttgtcaagaaggctgaaaaacttatgctagagaaaggagaaaacaaagagtatctgcctattgaaggctttgctgcatttaacaaagcaactgcagatctattgcttggagctgacaatcctgtcatcaagcaaggacgggttgctactcttcagtctctctcagggactggatcattacgccttgctgcagcatttattcagagatacttccctgatgcaaaagtacttatatcatctcccacatggggaaaccacaaaaacatattcaatgatgctagggtgccatggtcagaataccggtattatgatcccaagactgttgggctggattttgaaggaatgatagctgacatacaggctgccccagaagggtcttttgttctgctacatggttgtgctcacaatccaactggaatagacccaactcctcaacagtgggagaaactggcagatctgattgaagagaaaaaacatatgcctttctttgatgttgcctatcaaggttttgccagtggaagccttgatgaagatgcatcctccgtcaggctttttgttaagcgtggcctggaagtgtttgttgcacagtcttacagcaagaaccttggtctatatgcagaaaggatcggtgcgataaatgtcatttgcacagcaccggaagttgcagatagggtgaagagccagttgaagcgattggcgcggcccatgtactcaaacccacctattcacggtgccaagatcgtcgccaacgttgttggagaccctaccatgttcggtgagtggaaagaagagatggaacaaatggcagggcggatcaagaatgttcggcagaagctttacgatagcttgactgcaaaggaccagtctggcaaggactggtctttcattcttagccagataggcatgttctccttcacgggcttgaacagaacccagagcgataacatgaccgataaatggcacatatatatgaccaaggacgggaggatttcgttggcagggctgaacctggcgaaatgcgagtaccttgctgatgccatcatcgactccttccacaatgtcaactagattacgatttgcgtcgcagccacgctattgtgagtagttccttctatagtttgctgggatttttgggtccttccagctcgagttgtaagtcaggatgctgatgatgtgtccgttaattcagaggtacagtaataaataatctggcaaaaaaaaaaaaaaa

SEQ ID NO: 100279 - protein, 457 aa, Hordeum vulgare
MASALSAPAASAVAAAAARRKVFGGGRNDGRAGCRVGIARKNTGHIAMALTVHASRFEGVSMAPPDPILGVSEAFKADTSDLKLNLGVGAYRTEELQPAVLNVVKKAEKLMLEKGENKEYLPIEGFAAFNKATADLLLGADNPVIKQGRVATLQSLSGTGSLRLAAAFIQRYFPDAKVLISSPTWGNHKNIFNDARVPWSEYRYYDPKTVGLDFEGMIADIQAAPEGSFVLLHGCAHNPTGIDPTPQQWEKLADLIEEKKHMPFFDVAYQGFASGSLDEDASSVRLFVKRGLEVFVAQSYSKNLGLYAERIGAINVICTAPEVADRVKSQLKRLARPMYSNPPIHGAKIVANVVGDPTMFGEWKEEMEQMAGRIKNVRQKLYDSLTAKDQSGKDWSFILSQIGMFSFTGLNRTQSDNMTDKWHIYMTKDGRISLAGLNLAKCEYLADAIIDSFHNVN

SEQ ID NO: 100280 - DNA, 1131 bp, Glycine max
  CDS (57)..(944)
ttagtatcagctgccattgaagccacgaagcaaagagattgagagtggcaattgcaatgttctcacagtgccattttctctctcactccccaattcccaatactacctttcgtctcagagccatggcgcctcacagcacgcctcttgaactcaatcgcttcgccgaggtcggtaacaaagtcgccgatgctgccggagaagttatccgcaaatacttcagaaaaaacttcgacgttattcacaaacatgatctcagtccagtaaccattgcagatcaatctgctgaggaggctatggtttcaatcatactagacaatttcccttctcatgccatttacggagaggaaaatgggtggaggtgtgaagaaaagaatgctgattatgtttgggtattagatcccatagatgggactaagagctttattactgggaaacctgtatttggtactctcgttgctcttctacaaaatggcacaccaatccttggcataattgatcaacctgtgttaagagaaaggtggatcgggatagcaggaaagagaacctcactgaacggacaagaaatatctacacgcacttgtgcggacctttctcaagcatacctgtacaccacaagcccacatctgttcagtggagatgcagaagaggcattcattcgtgttagaagcaaggttaaaattccattgtatggctgcgactgctatgcatatgcacttttgtcttctggttttgtggatcttgttgttgagtctggtctgaagccatacgattttcttgcattgattcctgttattgaaggcgctggaggtgtcataactgattggaaaggagataaactgttttgggaagcttctccactttcaatcgccacaagttttaatgttgtggctgctggtgacaaacagattcatcaacaagctctagattcattgcagtggaagtgatagcttgaattaatcttcagtgcaaataatcttctctgcaaatggtcttgattcagatgttcctaaggacatgtattaccgtaccattttctggcatttaagttgaaaaccatgtactcagaatcttgaataagttcctgcagaaattaacctctttctctattggttgggcaaaaaaaaaaaaaaa

SEQ ID NO: 100281 - protein, 295 aa, Glycine max
MFSQCHFLSHSPIPNTTFRLRAMAPHSTPLELNRFAEVGNKVADAAGEVIRKYFRKNFDVIHKHDLSPVTIADQSAEEAMVSIILDNFPSHAIYGEENGWRCEEKNADYVWVLDPIDGTKSFITGKPVFGTLVALLQNGTPILGIIDQPVLRERWIGIAGKRTSLNGQEISTRTCADLSQAYLYTTSPHLFSGDAEEAFIRVRSKVKIPLYGCDCYAYALLSSGFVDLVVESGLKPYDFLALIPVIEGAGGVITDWKGDKLFWEASPLSIATSFNVVAAGDKQIHQQALDSLQWK

SEQ ID NO: 100282 - DNA, 1038 bp, Zea mays
  CDS (1)..(1038)
atggaccacgcggcggacgcgcaccggacggacctgatgaccatcacgcggcacgtgctgaacgagcagagccggaaccccgagtcccgcggcgacttcaccatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctgatcccaaccaagatccacgacaggtccccgatattcctcggaagctacgacgacgtggaggagatcaaagcgttgtacgccgagcaggcgaagtcgagctcggcttcatcctaa

SEQ ID NO: 100283 - protein, 345 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLIPTKIHDRSPIFLGSYDDVEEIKALYAEQAKSSSASS

SEQ ID NO: 100284 - DNA, 1242 bp, Zea mays
  CDS (1)..(1242)
atggccgccgccgccaccacctcctcatcctcccacttgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagatcgtgacgctcacgacgtggctgctgcagcaggagcggaccggcgcgatcgacaacgagatgaccatcgtgctggccagcatatccacggcgtgcaagcagatcgcggcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtgccagccggggagcaacctgctggccgccggctactgcatgtactcgagctcggtgatcttcgtgctcaccgtcggcaccggggtgtacgtgttcacgctggaccccatgtacggcgagttcgtgctgacgcaggagaaggtgcagatccccaaggcgggcaagatctacgccttcaacgagggcaactacgcgctctgggacgacaagctgaagctgtacatggacagcctcaaggagcccggcgactcggggaagccctactccgcgcggtacatcggcagcctcgtcggcgacttccaccgcactcttctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggcttga

SEQ ID NO: 100285 - protein, 413 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 100286 - DNA, 1367 bp, Linum usitatissimum
  CDS (72)..(1154)
cgcaattccaattttaacctaatttcactctttacccccctttttaatcaaattactcgccggcggccaatatgggtagcatcggaaaggagagaaccatcgtcggctgggccgccaccgatccttccggcgtcctcactcctcacaccttcactctcaggaacaccggccctgaagatgtgttcatcagagtgaagtgctgcggaatctgccatagcgacatccaccaggtgaagaacgaccttgggatgtctcgttaccccatggttcctggacatgaagtggtgggggaggtgatggaggtgggatcggaggtgacgaagtataaagcaggggacatcgtcggagtcgggctcctcgtcggatgctgccggagctgccgggcttgcgaatccgacatcgagcagtactgcaacaagaagatctggtcgtacaacgacgtgtacaccgatgggaagcccacgcaaggcgggtttgcagagtccatggtcgttgatcagaaatttgtggtgaagatcccggaagggatgtccccggagcaggctgcacccctgttatgcgcaggggtgacggtttacagcccgctgatccatttcgggctgaaccaaaccggattgagaggcggcatcttggggcttggtggagttggccacatgggtgttaagattgctaaggcaatgggtcaccacataactgtgataagctcttctgataagaagagagttgaggcattggagcatttgggagctgatgactatctggttagctctgataaggaaaagatggaagaggctgccgattcgctcgattacatcattgataccgtaccggttaaccacccgctcgagccgtacctttcgctgttgaaggttgatgggaagttgatcttgatgggtgttatcaacacacctttgcagtttatcagccccatggtcatgcttgggaggaaggcgataacagggagtttcgtggggagcatgaaggaaatggaggagatgctggagttctgcagggagaaagggttgagctccatgatagaggtgatcaagatggactacatcaacacggcattcgagaggctggagaagaacgatgttcgttacaggttcgtggtcgatatcgaggggagcgacaagcttgttcagcaacaataatggatcgatcaaagaatagaaaacccagctgaaatgcaggagagccacaagaaactaactgattacagttgtggccctttgtccttttttgcttcttcttctgtatcttttggtgatgttgttaaagctgttttgttcttttggtgtttggtgggttgtgagggattattgaaaagcgaaccaactttgcccgccggcaaaaaaaaaaaaaaa

SEQ ID NO: 100287 - protein, 360 aa, Linum usitatissimum
MGSIGKERTIVGWAATDPSGVLTPHTFTLRNTGPEDVFIRVKCCGICHSDIHQVKNDLGMSRYPMVPGHEVVGEVMEVGSEVTKYKAGDIVGVGLLVGCCRSCRACESDIEQYCNKKIWSYNDVYTDGKPTQGGFAESMVVDQKFVVKIPEGMSPEQAAPLLCAGVTVYSPLIHFGLNQTGLRGGILGLGGVGHMGVKIAKAMGHHITVISSSDKKRVEALEHLGADDYLVSSDKEKMEEAADSLDYIIDTVPVNHPLEPYLSLLKVDGKLILMGVINTPLQFISPMVMLGRKAITGSFVGSMKEMEEMLEFCREKGLSSMIEVIKMDYINTAFERLEKNDVRYRFVVDIEGSDKLVQQQ

SEQ ID NO: 100288 - DNA, 1247 bp, Brassica napus
  CDS (27)..(1100)
attacaaacagagaaagaaatcaagaatggggaaaatggaggtagagaggaaaacaacaggctgggctgcgagagacccttctgggttactctctccttacacttacactctcagagagacaggaccagaggatgttcacataagaatcatatgctgtggaatctgccacacagatctccatcaaaccaaaaacgatcttggcatgtcaaactaccccatggttcctgggcacgaggttgttggggaagtggtggaggtgggatcagatgtgagcaagttcaccgcaggggatatagttggagttggttgtctcgttggatgctgcggaggttgtagcccctgcgagagagatctggaacagtattgtcccaagaagatctggagctacaacgatgtttacatcgatggtcaaccaacacaaggcggtttcgctagagccaccgtcgttcaccaaaagtttgtggtgaagattccagaaggaatggctgttgagcaggcggcaccactactgtgtgccggtgtgacagtgtacagtccactggctcacttcggtctgaagcgaccaggcctaagaggaggtatactagggctaggtggagttggtcacatgggtgtgaaaatagccaaagcaatgggtcaccatgtgactgtcataagctcatcaaacaagaagaaagaagaggctttgaaagatcttggagcagatgattacgtgatcggatccgaccaatcgaagatgaacgaattggcggattcaatggattacataatcgacacggtccctgttcatcatgcacttgagccttacttgtctctgcttaggcttgatgggaaactcatactcatgggagtcataagcaatccattacaatttctcactcctatggttatgcttgggaggaaagtgataacggggagcttcattgggagcatgaaggaaacagaggagatgcttgagttctgtaaagaaaagggtttgagttcgatcatcgaagtagtgaagatggattatgtgaacactgcgtttgagagactcgagaagaacgatgtgcgttataggttcgtggttgatgtcgaaggaagcaaacttgaggcttgagttacttgaaactataacatcttttgtccttctttacaaaccgatgataacattttatgtttgtttgtgagcataaaaatgatttgtcgctgctttttatgtgaaagcatatacttatactgaatttaaaacaaaaaaaaaaaaaaa

SEQ ID NO: 100289 - protein, 357 aa, Brassica napus
MGKMEVERKTTGWAARDPSGLLSPYTYTLRETGPEDVHIRIICCGICHTDLHQTKNDLGMSNYPMVPGHEVVGEVVEVGSDVSKFTAGDIVGVGCLVGCCGGCSPCERDLEQYCPKKIWSYNDVYIDGQPTQGGFARATVVHQKFVVKIPEGMAVEQAAPLLCAGVTVYSPLAHFGLKRPGLRGGILGLGGVGHMGVKIAKAMGHHVTVISSSNKKKEEALKDLGADDYVIGSDQSKMNELADSMDYIIDTVPVHHALEPYLSLLRLDGKLILMGVISNPLQFLTPMVMLGRKVITGSFIGSMKETEEMLEFCKEKGLSSIIEVVKMDYVNTAFERLEKNDVRYRFVVDVEGSKLEA

SEQ ID NO: 100290 - DNA, 1363 bp, Brassica napus
  CDS (14)..(1099)
ccttgattaggtaatggaagaatcgaaaccgccgatgagttcttccggaggagacgagtgcttgagttgggctgcacgagatccatctggtctcctctctcctcacaccttcactcgcagatctgtaacaagtgatgatgtttcactaaaaatcacacactgtggggtctgttacgctgacgtcatctggacaaaaaacaaacatggagactctaagtaccctttggttcctgggcatgagattgctggagtagtgaacaaggttggatctaatgtcacacggttcaaagtcggagaccacgttggtgttggcacgtttgttaactcctgcagggagtgtgattactgtgacgaaggacaagaggttagctgtgtgaaagggcaagtcttcactttcaacggcgttgattacgatggctctgttactaaaggaggctactctagccacattgttgttcacgagaggtactgctacaagatacctgtggactatcctttggaatcagctgcgccgttgctatgcgctggagtcactgtttatgctcccatggtgcgtcacagtatgaaccagcctggtaagtctcttggggtggttgggcttggtgggcttggccacatggcggttaagttcggcaaggcttttggacttcatgtgacggttttcagcactagtgtttccaagaaagaggaggctttgaacctgctgggagctaacaacttcgttatctcctctgatcatgaccagatgaaggcactagcgaagtctctagactttgttattgacacagcgtctggtgatcacgcgtttgatccttacatgtcactcttgaagatcgctggaacttatgtcctggttggtttcccaagtgagattaaaatccaacctgccactctcaacctcggtatgagagtgcttgcgggaagtgtaagtggaggtaccaaggtgactcaggagatgatagatttctgtgcagctcataagatttatcccaacattgaggtgattcctattcagaaggcaaacgaagctattgaaagggtggtgaagaaggacatcaagtaccggtttgtgattgatatcgagaactctctgaaatagaaaccatataaagcatcattggtctcgtttagaggctttctgaacgtttgtaaacctgatttccacaaagcacaagaggcataatggcgactgaagtgattttctgtaataaaagaacactcactgctacacttattattgttctttgcgtttgttaataaagtaaataagtggagattattaagagaatgtattgttcatgttaagctgatgttattggttcttgtatttggaatgtgttattggttttatgccgacacgcag

SEQ ID NO: 100291 - protein, 361 aa, Brassica napus
MEESKPPMSSSGGDECLSWAARDPSGLLSPHTFTRRSVTSDDVSLKITHCGVCYADVIWTKNKHGDSKYPLVPGHEIAGVVNKVGSNVTRFKVGDHVGVGTFVNSCRECDYCDEGQEVSCVKGQVFTFNGVDYDGSVTKGGYSSHIVVHERYCYKIPVDYPLESAAPLLCAGVTVYAPMVRHSMNQPGKSLGVVGLGGLGHMAVKFGKAFGLHVTVFSTSVSKKEEALNLLGANNFVISSDHDQMKALAKSLDFVIDTASGDHAFDPYMSLLKIAGTYVLVGFPSEIKIQPATLNLGMRVLAGSVSGGTKVTQEMIDFCAAHKIYPNIEVIPIQKANEAIERVVKKDIKYRFVIDIENSLK

SEQ ID NO: 100292 - DNA, 1292 bp, Brassica napus
  CDS (50)..(1123)
attattgtcacctaaaaactgagttctattctcttgttgtttatccatcatgggaaaggtgcctgcgacggaggcgttcggattggccgcgaaagacgaatccggagttctctcgcctttccgtttctcaagaagggagacgggagagaaggatgtgaggttaaaagtgttgttctgtggaatttgccacactgatgtatgtatggccagaaacgagtggggatttactacttaccctctcgtccccgggcatgagattgttggcgtggtgactgaagtcggagctaaagtgattaaattcaaagccggagacaaagtcggagttggttatatgctcagctcgtgccggtcatgtgacatctgcaccgatgaccaagagaaccactgtccaaaaatgattatgacgtccggaggaaagtactacgatgacaccatgacttatggtggttactctgaccacctggtttgtgaagaggattacatcatccgtattcctgaaaatctcccgttagacgctgccgcgccgctactctgcgctggggtcacggtttattcaccgttgaagtctcacggactcgacaagcccggaatccacattggtgtggtgggactaggcggtttaggtcacgtagcagtgaaatttgccaaggctatgggtactaaggttacggttattagttcgtcagatggtaagagagacgaggcgattaatcggcttggtgcggatctgttcttggtgagccgtgacccggaagagatgaaggatgcaatggggactatggatggtattattgatacagtatctgccactcatccgcttcttccgcttcttggtttgctaaaatataagggaaaatttattatggttggtgcacccgataaaccacttgaccttccagctttaccgctcatcttagggaagaagatggtggtgggaagtatgacaggagggataaaagagtctcaagagatggttgattttgccggtaaacacaacataacggcagatattgagcttatctctgcggattatgtcaacatggctatggaacggctagaaaagggggatgttagataccgttttgtgattgatgttgccaacacaatgaagcctactccttagttacaaagctttaaaacttaattaatttcctgaaaacgtctttttcttgtttattttgtcgtaataagttccgagttgtttgttgaaggcttcgtctgtatcaccactgtatttttcaactgaatcaacttgaatattatcatgtgctagctataaaaaaaaaaaaaaa

SEQ ID NO: 100293 - protein, 357 aa, Brassica napus
MGKVPATEAFGLAAKDESGVLSPFRFSRRETGEKDVRLKVLFCGICHTDVCMARNEWGFTTYPLVPGHEIVGVVTEVGAKVIKFKAGDKVGVGYMLSSCRSCDICTDDQENHCPKMIMTSGGKYYDDTMTYGGYSDHLVCEEDYIIRIPENLPLDAAAPLLCAGVTVYSPLKSHGLDKPGIHIGVVGLGGLGHVAVKFAKAMGTKVTVISSSDGKRDEAINRLGADLFLVSRDPEEMKDAMGTMDGIIDTVSATHPLLPLLGLLKYKGKFIMVGAPDKPLDLPALPLILGKKMVVGSMTGGIKESQEMVDFAGKHNITADIELISADYVNMAMERLEKGDVRYRFVIDVANTMKPTP

SEQ ID NO: 100294 - DNA, 1279 bp, Linum usitatissimum
  CDS (21)..(1094)
ctgaaactaaaagaagaaaaatggcagagaaacaacatccggtgccggcctacggattggctgccagagaccagtctggacttgtttctcctttcaacttctccagaagagaaacaggggaaaccgatgtgaaatttaaggttctctactgtgggatttgccattccgatcttcatatgctcaagaatgaatggggctcctccacctatcccattgtccctgggcatgagatagtgggacaagtgacagaggttggaagcaaagtggagaaatacagagttggagacagagtaggcgttggatgcatggttgggtcgtgccgatcttgcaacaactgctcccaaagcatcgaaaattactgccccaagatgatccaaacctatggaggaacctaccatgatggcacccctacctacggaggctactccgacgtcatggtctgcgacgagcatttcgtggtccgagtccccgactccctgcccttagacgttgccgcacctctgctctgcgctggtatcacactttacagccctttaaagttctatggactggacaagccgggcctccacgtcggcattgtcgggctcggtggactgggccacgtgggtgtcaagtttgctaaagccatgggtgtgaaagtcaccgtgattagtacctcccctggcaagaagcaggaggcaatcgagcgacatggtgctgatgccttcttggtgagccttgaccaggaacaaatgaaggctgcaatggggacgatggatggtattatcgacacggtatcagctgttcacccaataatgccattgattgggctgttaaagacacaaggcaagttggtgttggttggtgctccagagaagcctcttgagttgccagttttccctctgctcatgggaaggaagatagtaggagggagttgcattggaggaatgaaggagacgcaagagatgcttgatttcgcagcaaagcacaacatcactgcggacattgaggttatatcagcagactatgtgaacactgcaatggagaggcttgccaagaatgatgttaaatacagattcgtcatcgatgttgccaacactatgcaagctccttgaatatatttacttgttcagtagaatggagagtggtgttggccggtgggtcagtgtgtgtactgtgtgatgaattctcccctgtttttgttgtgtgtgtggctatcagtatcagtggttaagtactttaagtagagtatctgaaataacaagggacttcttttattagtaccaaaaaaaaaaaaaaa

SEQ ID NO: 100295 - protein, 357 aa, Linum usitatissimum
MAEKQHPVPAYGLAARDQSGLVSPFNFSRRETGETDVKFKVLYCGICHSDLHMLKNEWGSSTYPIVPGHEIVGQVTEVGSKVEKYRVGDRVGVGCMVGSCRSCNNCSQSIENYCPKMIQTYGGTYHDGTPTYGGYSDVMVCDEHFVVRVPDSLPLDVAAPLLCAGITLYSPLKFYGLDKPGLHVGIVGLGGLGHVGVKFAKAMGVKVTVISTSPGKKQEAIERHGADAFLVSLDQEQMKAAMGTMDGIIDTVSAVHPIMPLIGLLKTQGKLVLVGAPEKPLELPVFPLLMGRKIVGGSCIGGMKETQEMLDFAAKHNITADIEVISADYVNTAMERLAKNDVKYRFVIDVANTMQAP

SEQ ID NO: 100296 - DNA, 1388 bp, Linum usitatissimum
  CDS (128)..(1195)
cgtgtcctctcctccgccttgctctcgaactcggtggttgtgctgtgaatctgtcatcgtcaattacgtctgtgttatctttctccttcgtcatccgcttcaacctgttgcttgagtcttctggaaaatgagttctgagaatgcgaaagaggattgccttgcatgggctgcgagagatccgtctggagttttatccccctacaagttcagccgtagggcaacaagggatgatgatgtttctctaagaataacacactgtggagtatgctatgctgatgttgtttggactcggaataaacattatgattccaagtatccgttggtgcctgggcatgaaatcgttgggattgtacaagaggttggccgcaacgtgagccaattgaaacctggtgaccatgttggagtaggcacttatgttaactcctgcagggagtgcgaattttgtgatgacagagatgaagtcaactgtgtaaaaggttctgttttcacctttaatggtcttgattccgatggcaccatcacaaaaggtggatattccagccacattgttgttcatgaaagatactgctacaagatacctgatggatatcctttggcaatggctgctcctttgctatgtgctggagttactgtttacaatcccatggttcgtcataacatgaatcagcccggcaaatctttgggagtgattgggcttggcggtcttggccacatggcagtgaagttcgggaaagcttttggattgcaggtcacaatattcagcacaagtgcatcaaaaaaagaggaagccttgagcgtacttggtgctgacaggtttatcgtctcctcagacgaagagcagatgaaggtcttatcgaaatcactggacttcataatcgacactgcatccggcgaccacccgttcgatccgtacatgtctcttctcaagactcggggtgttcttgtccttgtcggtttccccggtgaagtgaaattcagtcctgcgaaccttattctcggtactagaaccgttgcagggagtgtaacgggcggaacaaaggtgacgcaagagatgctggagttctgtgctgcaaataagatctatcccaagacggaggtgattccgattcaggatgtcaacgaagcgatcgagaggcttatcaatagagatgtgaagtatcgcttcgtgatagatatcgagaactcgttgaagtgagcaatgacatagtgaggaataagaccataagggcgtctgttattttcagaacacaaaatatagcaggttgatcctgcgtctaagttctttcagtcattgtcgataagtataaagtctgtgtatttagtatctactatatctgttatgtacgccttttgtatttgttatataggttacgaaaaaaaaaaaaaaa

SEQ ID NO: 100297 - protein, 355 aa, Linum usitatissimum
MSSENAKEDCLAWAARDPSGVLSPYKFSRRATRDDDVSLRITHCGVCYADVVWTRNKHYDSKYPLVPGHEIVGIVQEVGRNVSQLKPGDHVGVGTYVNSCRECEFCDDRDEVNCVKGSVFTFNGLDSDGTITKGGYSSHIVVHERYCYKIPDGYPLAMAAPLLCAGVTVYNPMVRHNMNQPGKSLGVIGLGGLGHMAVKFGKAFGLQVTIFSTSASKKEEALSVLGADRFIVSSDEEQMKVLSKSLDFIIDTASGDHPFDPYMSLLKTRGVLVLVGFPGEVKFSPANLILGTRTVAGSVTGGTKVTQEMLEFCAANKIYPKTEVIPIQDVNEAIERLINRDVKYRFVIDIENSLK

SEQ ID NO: 100298 - DNA, 1367 bp, Hordeum vulgare
  CDS (149)..(1261)
gcaacatttccacctgcgcaactcggtccttcccctgtccttcttccccggcgagctcggcgcccggttctcgcccactgagcccaggcatctgacgagcagcgtccgcgtcgctgttgcgtcgccgtcaagagccctgcggccccacatggcgaaggcggtggcgaaggaggtgggggcgcaggaggcggcgcaaggcagcgcggcgctcgggtgggcggccagagacgcctccggtgtcctctccccgttcgacttctcaagaagggctcagaaggacgacgatgtgacgatcagggtgctctactgcgggatctgccacactgacctctacaccatcaagaacgagtggggcaccgccatgtaccccgtcgtccccgggcacgagatcctgggcgtcgtgaccagcgtcggcagcggcgtcagcaagttcaaggccggcgacacggtgggcgtgggctacttcgtcgggtcgtgccgctcctgcgagtgctgcggcaacgggtacgagaactactgctccggcatggtgctcacctccaacggcatcgaccccgagcacggcggcgcggtcacccaggggggcttctccgacgtcatgctcgtgaacgaggactacgtggtccgcgtcccggacgggctgccgctggacaaggccgcgccgctgctctgcgccggcgtcacggtgtacagcccgatgatgcgcttcggcctgaacgcgccggggaagcacctgggcgtcgtcggcctcgggggcctcggccacgtcgccgtcaagttcggcaaggcgttcggcatgcgggtcaccgtcatcagcacctcgcccgggaagcgcgaggaggcgctggagcggctgggcgcggacgagttcctggtgagccgggaccccgagcagatgcaggcggccgtgggcaccatggacggcatcctcgacacggtgtcggcgtggcacccgatctcgccgctgttcgcgctgatgaagccgatggggcagatggtgttcgtgggagggccgaccaagccgctggagctgccggcgtacgccatcgtgccgggcgggaagggcatcgccgggaactgcgtcggcggcatcagggactgccaggccatgctggaattcgcggcaaagcacggcatcaccgcggaggtggaggtgataaagatggactacgtcaacacggcgctcgagcggctcgcgaagaacgacgtccgctaccgcttcgtcatcgacatcgcgggcagcctcggctcaacctcgtgagctggaatagccaccttgttcattttcttcagggaatttagagctcttagtaactgcgcccagcgcccgttaaaccactgttgtgtctaagaaaaaaaaaaaaaaa

SEQ ID NO: 100299 - protein, 370 aa, Hordeum vulgare
MAKAVAKEVGAQEAAQGSAALGWAARDASGVLSPFDFSRRAQKDDDVTIRVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEALERLGADEFLVSRDPEQMQAAVGTMDGILDTVSAWHPISPLFALMKPMGQMVFVGGPTKPLELPAYAIVPGGKGIAGNCVGGIRDCQAMLEFAAKHGITAEVEVIKMDYVNTALERLAKNDVRYRFVIDIAGSLGSTS

SEQ ID NO: 100300 - DNA, 1634 bp, Zea mays
  CDS (9)..(1163)
ctagtagtatgctcgccgccgcctggaggctgtcgcagcgagccgtcacgtctcctctcctaggcatcgggcgatcccaaatccgaaaccctttctccaccatggcgtctctgtcgccggcagccgcctcgccgaagaggctgagggtctactcgtctgccgcggccgacggtgacggcgcggggagcggcaagcgcgtggggacccacaacggaagcttccactgcgatgaggcgctcggctgcttcctcatccgcctcacctcccagttcgccggcgccgacgtcgtccgcacccgcgattcccagatccttgatacattggatgctgttcttgatgttgggggtgtctatgatcccagtcggcatcgctatgatcatcaccagaagggcttcagtgaggtttttggacatggattcaacacaaaacttagcagtgctggacttgtgtacaagcacttcggtaaggagataattgctaaggagcttgcggttaatgaggatcatgaagatgttcactgtttgtatctcgcgatatataaaagctttgttgaggcacttgatgcgattgacaatggaatcaatcaatatgacacagatcaaccgccaaagtatgtgaacaatacacacttgtcttcacgcgttggacgctttaatctggactggactgatccagaccagtcacttgagaaggagaatgcggcatttgaacaggcaatgatactagctggaagtgaatttatggagagggttcgcttccatgttaaatcatggttaccggcaaggtctattgtcctggagtgtttgttatcaaaaggaaacattgatccaagtggagaaatcttggttttggatagattctgcccgtggaaacttcatttatttgagcttgaagaggagctgaagactgatcctctgaccaagtatgtgctgtatcaggatgagaggagcaagagttggcgagtccaagcagtcgcagttgctcctgacaggttcgagagccgaaaggctctgccagagaagtggaggggcatgagagacgacgaactttcagcagaaaccggcatccctggctgtgtgtttgtccacatgagtggcttcattgggggcaacaagacctacgagggagcattggaaatggcgagagctgctctgaaattctgattcaaccaaagcatattacccatgttaccattatatcagtaaacacatcaggaacacaagatgcagttgcgctttctccaatgttatcgtggactccagccgtggttaactgggactgattcttgcactgatcttctgttatcctcatcttacagaagaggtcgattgacccttttcattctttcgtgggatctggtattgtttagaatgtgacggtttatctgaaaaaaatgatggaactttttgtcctcaagcatgttctccgttttggagtattcatctgtggcccggcacagccaccgtggttttgtgtgtgcatggagagacaggcagacgaaaacgaatgcaaagaaagcttgtggggatcaggtagttttaccctctaaacgactgtacttgaattataatttcagtgtcgatgtgagcatgatttccaactacatgaattgatggtgagaaaaaaaaaaaaaa

SEQ ID NO: 100301 - protein, 384 aa, Zea mays
MLAAAWRLSQRAVTSPLLGIGRSQIRNPFSTMASLSPAAASPKRLRVYSSAAADGDGAGSGKRVGTHNGSFHCDEALGCFLIRLTSQFAGADVVRTRDSQILDTLDAVLDVGGVYDPSRHRYDHHQKGFSEVFGHGFNTKLSSAGLVYKHFGKEIIAKELAVNEDHEDVHCLYLAIYKSFVEALDAIDNGINQYDTDQPPKYVNNTHLSSRVGRFNLDWTDPDQSLEKENAAFEQAMILAGSEFMERVRFHVKSWLPARSIVLECLLSKGNIDPSGEILVLDRFCPWKLHLFELEEELKTDPLTKYVLYQDERSKSWRVQAVAVAPDRFESRKALPEKWRGMRDDELSAETGIPGCVFVHMSGFIGGNKTYEGALEMARAALKF

SEQ ID NO: 100302 - DNA, 795 bp, Zea mays
  CDS (1)..(795)
atgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttga

SEQ ID NO: 100303 - protein, 264 aa, Zea mays
MSSMESRPGRTNLVEPIGHGAALPSGGQAVQPWWTSSGAVLGAVSPAVVAVAPGSGTGISLSSSPAGGSGGGGAAKGAASDESSEDSRRSGEPKDGSASQEKNHATSQIPALAPEYLAPYSQLELNQSIASAAYQYPDPYYAGMVAPYGSHAVAHFQLPGLTQSRMPLPLEVSEEPVYVNAKQYHGILRRRQSRAKAELEKKVVKARKPYLHESRHQHAMRRARGNGGRFLNTKKSDSGAPNGGENAEHLHVPPDLLQLRQNEA

SEQ ID NO: 100304 - DNA, 735 bp, Zea mays
  CDS (1)..(735)
atgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtag

SEQ ID NO: 100305 - protein, 244 aa, Zea mays
MRQNGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 100306 - DNA, 906 bp, Zea mays
  CDS (1)..(906)
atgtgccttttacgggaaatggaggatcattctgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccgtcttttccttatattccttatactgctgacgcttactatggtggcgttggggtcttgacaggatatgctccgcatgccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggtcggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtga

SEQ ID NO: 100307 - protein, 301 aa, Zea mays
MCLLREMEDHSVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFPYIPYTADAYYGGVGVLTGYAPHAIVHPQQNDTTNSPVMLPAEPAEEEPIYVNAKQYHAILRRRQTRAKLEAQNKMVKGRKPYLHESRHRHAMKRARGSGGRFLNTKQQPQEQNQQYQASSGSMCSKTIGNSVISQSGPICTPSSDAAGASAASQDRGCLPSVGFRPTANFSEQGGGGSKLVVNGMQQRVSTIR

SEQ ID NO: 100308 - DNA, 645 bp, Zea mays
  CDS (1)..(645)
atgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagtcggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtga

SEQ ID NO: 100309 - protein, 214 aa, Zea mays
MTSVVHSVSGDHRAEDQNQQKKQAEPGDQQEAPVTSSDSQPTVGTPSTDYVAPYAPHDMSHAMGQYAYPNIDPYYGSLYAAAYGGQPLMHPPLVGMHPAGLPLPTDAIEEPVYVNAKQYNAILRRRQSRAKAESERKLIKGRKPYLHESRHQHALKRARGAGGRFLNSKSDDKEENSDSSHKENQNGVAPHRSGQPSTPPSPNGASSANQGRQS

SEQ ID NO: 100310 - DNA, 648 bp, Zea mays
  CDS (1)..(648)
atgacctctgttgttcagagcgtttcaggtgaccacagggctgaggatcaaagtcatcagaagaagcaaactgaacctggggaccagcaagaagccccagttactagttcagatagccaaccaacagtgggcacaccatcaacagattatgtggcaccctatgcccctcatgacatgagccatgcaatgggtcaatatgcttatccaaatattgatccatactatggaagtctttatgcggcggcttatggtggacatccattgatgcatccaacattagtcggaatgcatccggctggcttacctttgcctaccgatgcaattgaagagccagtgtatgtaaatgcaaagcaatacaatgccatattaagacggcgtcaatctcgggctaaagctgaatcagaacggaagcttgtcaagggccgcaagccctatctccatgagtcacggcatcagcatgccttgaaaagggccaggggagctggaggtcggtttctcaattcgaagtcagatgacaaggaagagaactccgactcaagtcaaaaagagattcagaacggagttgcgccccaaaagggtggccaaccgtcaacccctccgtctcccaacggtgcgtcgtcagcttatcaggcgcctagtcgtgaatga

SEQ ID NO: 100311 - protein, 215 aa, Zea mays
MTSVVQSVSGDHRAEDQSHQKKQTEPGDQQEAPVTSSDSQPTVGTPSTDYVAPYAPHDMSHAMGQYAYPNIDPYYGSLYAAAYGGHPLMHPTLVGMHPAGLPLPTDAIEEPVYVNAKQYNAILRRRQSRAKAESERKLVKGRKPYLHESRHQHALKRARGAGGRFLNSKSDDKEENSDSSQKEIQNGVAPQKGGQPSTPPSPNGASSAYQAPSRE

SEQ ID NO: 100312 - DNA, 903 bp, Zea mays
  CDS (1)..(903)
atgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattggcaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtga

SEQ ID NO: 100313 - protein, 300 aa, Zea mays
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTADAYYSAVGVLTGYPPHAIVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIGNSIISQSGPTCTPSSGTAGASTAGQDRSCLPSVGFRPTTNFSDQGRGGLKLAVIGMQQRVSTIR

SEQ ID NO: 100314 - DNA, 735 bp, Zea mays; identical to SEQ ID NO: 100304
  CDS (1)..(735)

SEQ ID NO: 100315 - protein, 244 aa, Zea mays; identical to SEQ ID NO: 100305

SEQ ID NO: 100316 - DNA, 648 bp, Zea mays; identical to SEQ ID NO: 100310
  CDS (1)..(648)

SEQ ID NO: 100317 - protein, 215 aa, Zea mays; identical to SEQ ID NO: 100311

SEQ ID NO: 100318 - DNA, 1247 bp, Zea mays
  CDS (290)..(997)
catctcccaggttttcccctccaatcacccccaggtcttcctctcgcgagttgcggtctcgcgcccccctccgccgaccgccgcctcctcacaaccgcggaagctgcttccctctccattggacgcggccagcttccatctctcggtcacctccctctacatcccacggccgctaccaccttccctctacctcacacggccgccggcctctccaagcaggaaaaaccttgccacgagtcgccgacactccatcccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgccactgagaagaagctgccttctattttagtggatgaaacatctgtgcaaaagattcaggcactaacacctaatattggagttgtctatagtgggatgggtccagatttccgtgttctggtgaggaaaagtcgaaagcaggcacaacaatattatcggttgtacaaggaacatatacctgtaacacagcttgtacgagagactgctgctgtcatgcaggagttcacacagtcaggtggtgtgagaccatttggagtatcactgttgattgctgggtatgatgacaatggcccgcagttgtatcaggttgatccctcaggatcatacttctcctggaaggcatcagccatgggaaaaaatgtgtccaatgcaaagacgtttcttgaaaagagatacacagaagatatggagcttgatgatgccatccacactgcaattttgactttgaaagaaggatatgaggggcaaatttcctccaacaacattgaaatcggaattattcgagctgatcgtgagttcaaagttttaagcccagcagagatcaaggatttcttggaagaggtggagtaagctgtctgttgatgatactagttcagacaacaatagcagcgtcacttatgagcagccagcctgaagattgtcttggttttattactctgtaaactgatttgctccagcgccatgtggtggttacatttgaaccctcctcaacgcatactgtagacaatgagataacgtaggatgaatgctgtatttgacatactttgcagcttgtttatgtgatgcacgttcttgcggacagtatcaaaaaaaaaaaaaa

SEQ ID NO: 100319 - protein, 235 aa, Zea mays
MGDSQYSFSLTTFSPSGKLVQIEHALTAVGSGQTSLGIKAANGVVIATEKKLPSILVDETSVQKIQALTPNIGVVYSGMGPDFRVLVRKSRKQAQQYYRLYKEHIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISSNNIEIGIIRADREFKVLSPAEIKDFLEEVE

SEQ ID NO: 100320 - DNA, 976 bp, Zea mays
  CDS (158)..(772)
gtcgacttcgctgtcgacgatttcgtctggggcgggcgactgcctccttccctcgatctattccccatcttgtcctccctttgctaaaaataacgaggcagaggcaacttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgtccagcaaattcggcaacctcactgaggcaaaggtggttcttgacaaattttcaggccgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggtggtggtggtggtggtgactgcttcaagtgtgggaaacctggtcattttgctagagagtgcccatctggggatggtgggagaggggacagatatggtgggagagatgacaggtatggcggcggtggcggcggtggtggtggtcgttatggttctgaccgtggtggtgaccgatactctggccgtagccgagatggcggcagctatgggggtggcgatcgctacagccgtgaccgatcaggtccttactgatggccttagttcttgattgagaagtatgtgccatccaggtatgaaagtctatctactattataaggcttgttattgtgtctggaactttgttatcctgtagttggagtcgacatgtaccgtgagaaatcagctgctttgttatagaccgtattactgaccggtttattatcgtttcctgcttgccaggcaaaaaaaaaaaaaaa

SEQ ID NO: 100321 - protein, 204 aa, Zea mays
MADVDEYRCFIGNLSWSTTDESLKDASSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGDCFKCGKPGHFARECPSGDGGRGDRYGGRDDRYGGGGGGGGGRYGSDRGGDRYSGRSRDGGSYGGGDRYSRDRSGPY

SEQ ID NO: 100322 - DNA, 1562 bp, Zea mays
  CDS (93)..(1373)
cctcgccccccacggacctgaaccgagaaccgttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgcaagaagaacaaccgttacaagtagcaagatgtacaaagattataagccctaatacggatgatgccaaatatgttataaatgtaaaacaaattgcaaagtttgtggtcggattgggagataaggtctctccaactgatatcgaggaagggatgagggttggtgttgatcgcaacaagtaccagattcaaatccctcttccaccaaaaattgacccaagtgttaccatgatgactgtggaggaaaagccagatgtgacgtacaatgatgtcggtggctgcaaggagcagattgagaagatgcgtgaagttgttgaacttcctatgcttcacccagaaaagtttgtcaagcttggtattgaccctccgaaaggtgtcctttgctatggcccacctggtactggcaagacacttcttgcaagagctgtagcaaaccggactgatgcttgtttcatccgtgtaattggaagtgagctagttcagaagtatgttggagaaggtgctcggatggtcagggaactgttccagatggcccgctcaaagaaggcatgcattgtattctttgatgaagttgatgcaattggtggtgctcgttttgatgatggggttggtggtgacaatgaggtgcagcgtacaatgttggaaatagtaaaccaacttgatgggtttgatgcaagagggaacatcaaagttctcatggccactaataggcctgataccttggatcctgcacttctgcgccctggtcgcttggacagaaaggtggaattcgggctacctgacttggagggccgtacccaaattttcaagatccatacacgtaccatgaactgtgagcgagatattcgtttcgagcttctggcacggctctgccccaactctactggagctgatataaggagcgtttgcacagaagccgggatgtacgccattcgcgcccgcaggaaaacggtgacagaaaaggattttctcgatgctgtcaacaaggtcatcaagggctaccagaagttcagtgcaacacccaagtatatggtgtacaactagtcggcgtgtcttcatgggatctgttgtttctagaaactctggatctttttcatggttgtatcatcatgagattctctatgcaaaggttgttgtttgtttagcaaattggatgccgagtgatttgtgacctgtaccgcatgtttttaagataacaaggttcttcgctcggtggttcaaaaaaaaaaaaaa

SEQ ID NO: 100323 - protein, 426 aa, Zea mays
MAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 100324 - DNA, 723 bp, Escherichia coli K12
  CDS (110)..(613): n means a or g or c or t/u
gatttggacactgnagctccatgtgctgggnattatgcagttcacttacaccgcttctcaacccggtacgcaccagnaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagtttggagtcattaccaaaaggttaggaatacggttagccatttgcctgctttatatagttcatatggggattaccctttatgttgataagaaataaaagaaaatgccaa

SEQ ID NO: 100325 - protein, 167 aa, Escherichia coli K12
MPGNSPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 100326 - DNA, 357 bp, Yersinia pestis
  CDS (1)..(357)
atgggcaacaaaaagcagcaacgttggctttggtatgcctgggagtctcgcctcaaacgtattattgctcatgtttttggtcgtcggagcaaaaagacatttcgccaattattggggttgctgtcaggtttcaatatcgtcttctggtgtaccgacaacttcagtgcttatgagatgttgccggatgaaaaacacatcaggagcaagctttacacgcagcggattgagcgtgaaaacctgaatatccgtaatcggttgaaacgactgaaccgcaagactctcggagactcaaagtcggcagaaatgcatgacaggatcatcggtacgttcattgagcgtgagcattacctagtgtga

SEQ ID NO: 100327 - protein, 118 aa, Yersinia pestis
MGNKKQQRWLWYAWESRLKRIIAHVFGRRSKKTFRQLLGLLSGFNIVFWCTDNFSAYEMLPDEKHIRSKLYTQRIERENLNIRNRLKRLNRKTLGDSKSAEMHDRIIGTFIEREHYLV

SEQ ID NO: 100328 - DNA, 378 bp, Shigella dysenteriae
  CDS (1)..(378)
atggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagaaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 100329 - protein, 125 aa, Shigella dysenteriae
MDEQWGYVGAKSRQRWLFYAYDRLRKTVVAHVFGERTMATLGRLMSLLSPFDVVIWMTDGWPLYESRLKGKLHVIRKRYTQRIERHNLNLRQHLARLGRKSLSFSKSVELHDKVIGHYLNIKHYQ

SEQ ID NO: 100330 - DNA, 396 bp, Shigella dysenteriae
  CDS (1)..(396)
atggcgcttatctgcgaacttgatgagcaatggagtttcgttggcagtaaagcccggcaacactggctctggtacgcgtataacaccaaaacagggggggtactggcctacacttttggtccccgtaccgatgaaacctgccgggaactactggcactgcttacgccattcaacatcggcatgctcaccagcgacgactggggcagctatggccgggaggtgccgaaggataagcatctgaccggaaaaatattcacccaacggattgagcgcaataacctgacgctgcgcacccgcattaagcgcttggctcgtaaaacaatctgcttctcgcgttcagtagagatccacgaaaaagtcatcgggacgtttattgaaaaacacatgttctactaa

SEQ ID NO: 100331 - protein, 131 aa, Shigella dysenteriae
MALICELDEQWSFVGSKARQHWLWYAYNTKTGGVLAYTFGPRTDETCRELLALLTPFNIGMLTSDDWGSYGREVPKDKHLTGKIFTQRIERNNLTLRTRIKRLARKTICFSRSVEIHEKVIGTFIEKHMFY

SEQ ID NO: 100332 - DNA, 504 bp, Escherichia coli
  CDS (1)..(504)
atgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagcagcatgacaaagtcatcgggcattatctgaacataaaacactatcaataa

SEQ ID NO: 100333 - protein, 167 aa, Escherichia coli
MPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVEQHDKVIGHYLNIKHYQ

SEQ ID NO: 100334 - DNA, 417 bp, Synechocystis sp
  CDS (1)..(417)
atggcattttcttcaggccaaaaaaacaagttatggctctggaaggcatatgaccgtgttactgggagactcatcgactgggaactgggaaatcgtgatagtcaaaccctgagtcgtttgctggagagactggcaaagtggaaagtgacagtgtcctgtaccgatgactggaggccctatcaacaactgctggatgaacatcctgatgcgtttcatgggattagcaaaagagaaacagtaggaattgagagaaacaactcagataatcgccattggcttgctagatttcatcgccccacgaaagttatctccaggtcagcccacatggttaatatcaccatggcaatatttgccaaattcagggtcaatggtaacatagaactattacgcaactggcgcctttcattactttcttga

SEQ ID NO: 100335 - protein, 138 aa, Synechocystis sp
MAFSSGQKNKLWLWKAYDRVTGRLIDWELGNRDSQTLSRLLERLAKWKVTVSCTDDWRPYQQLLDEHPDAFHGISKRETVGIERNNSDNRHWLARFHRPTKVISRSAHMVNITMAIFAKFRVNGNIELLRNWRLSLLS

SEQ ID NO: 100336 - DNA, 417 bp, Synechocystis sp
  CDS (1)..(417)
atggcattttctccaggcaaaaaaaacaagttatggctctggaaagcatatgaccgtgttactgggagactcatcgactgggaactgggaaatcgtgatagtcaaaccctaagtcgtttgctagagagactggcaaagtggaaagtgacagtgtactgcaccgatgactggaggccctatcaacaactgctggatgaacatcccgatgcgtttcatgggattagcaaaagagaaacagtaggaattgagagaaacaactcagataaccgccattggtttgctagatttcatcgccgcatgaaagttgtctccaggtcagcccacatgattgatatcaccatggcaatatttgccaaattcagggtcaatggtaacacagaaccactgcgggactggcgcctctcattactctcttga

SEQ ID NO: 100337 - protein, 138 aa, Synechocystis sp
MAFSPGKKNKLWLWKAYDRVTGRLIDWELGNRDSQTLSRLLERLAKWKVTVYCTDDWRPYQQLLDEHPDAFHGISKRETVGIERNNSDNRHWFARFHRRMKVVSRSAHMIDITMAIFAKFRVNGNTEPLRDWRLSLLS

SEQ ID NO: 100338 - DNA, 504 bp, Shigella flexneri
  CDS (1)..(504)
atgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100339 - protein, 167 aa, Shigella flexneri
MSRQCTHYGRWPQHGFTSLKKLRPQSVTSRIQPGSDVIVCAEMDEHWGYVGAKSRQRWLFYAYDRIRRTVVAHVFGERTLATLERLLSLLSAFEVVVWMTDGWPLYESRLKGKLHVISKRYTQRIERHNLNLRQHLARLVRKSLSFSKSVELHDKVIGHYLNIKHYQ

SEQ ID NO: 100340 - DNA, 441 bp, Escherichia coli
  CDS (1)..(441)
atgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcggcgaattgagcggcataacctgaatctgaggcagcacctggcacggctgggacggaagtcgctgtcgttctaa

SEQ ID NO: 100341 - protein, 146 aa, Escherichia coli
MPGNCPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTRRIERHNLNLRQHLARLGRKSLSF

SEQ ID NO: 100342 - DNA, 387 bp, Edwardsiella ictaluri
  CDS (1)..(387)
atgagctttgtggacagtaaagcccggcagcactggctctggtacgcgtacaataccaaaacaggcggtgtactggcctacatttttggtcccagaaccgatgaaagctgccgggagctactggcagtgctcatgccattcaacattggcatgagcaccagcgacgaccggggccgcgatggccgggaggtgccgaaggataagcatctgaccggcaaaatattcacccaacgcattgagtgtaataacctgatgctctgcaccatgattaagcggctttcccgtaaaataatcagtttctcacgctcggttgagatccacgaaaaattcatcggagattttatcggaaaatacatattctactcattggatacatcgccaacttaa

SEQ ID NO: 100343 - protein, 128 aa, Edwardsiella ictaluri
MSFVDSKARQHWLWYAYNTKTGGVLAYIFGPRTDESCRELLAVLMPFNIGMSTSDDRGRDGREVPKDKHLTGKIFTQRIECNNLMLCTMIKRLSRKIISFSRSVEIHEKFIGDFIGKYIFYSLDTSPT

SEQ ID NO: 100344 - DNA, 738 bp, Microcystis aeruginosa
  CDS (1)..(738)
atgcaatgtcctgaatgtcaatccaatcatatcaataaaaatggtcataaaaaaggaaaacagaactatatttgtgtgaactgcggaagacaatttatagaggtttatgaaccccagagaggttattcagaagaaatgaaacgggaatgtctgaaaatgtatgttaatggtctgggttttcgagccattgaaagggttaaaaacgttcatcatacgacaattatgaattgggttaaacaagtcggcgaacttttaccggattattatgacccacaaacaattcccgatgtgggagaattagatgaattagaaacatttgtcggctcaaaaaaaaccaaaatctggttatggacagcggtagatcactttaaaacagggattttaggatgggttttaggcgatcatagtgctaaaacttttgcggacttatggaaagttgttggtcagtggaaatgtcatttttatgtgacagatggatggaaagtttaccctaattttatccccgacggagaccagattattagcaaaacttatatgaccagagtagagggagaaaatactagactaagacattatttagccaggttacatcgaaaaactctttgttattccaagtctgaacaaatgctcagacattcaattcgattactaattcactacctaaaatttgaggatgttccagttccttattcaaataacagaagttattttcctctgaatgctcgccattttgcctaa

SEQ ID NO: 100345 - protein, 245 aa, Microcystis aeruginosa
MQCPECQSNHINKNGHKKGKQNYICVNCGRQFIEVYEPQRGYSEEMKRECLKMYVNGLGFRAIERVKNVHHTTIMNWVKQVGELLPDYYDPQTIPDVGELDELETFVGSKKTKIWLWTAVDHFKTGILGWVLGDHSAKTFADLWKVVGQWKCHFYVTDGWKVYPNFIPDGDQIISKTYMTRVEGENTRLRHYLARLHRKTLCYSKSEQMLRHSIRLLIHYLKFEDVPVPYSNNRSYFPLNARHFA

SEQ ID NO: 100346 - DNA, 504 bp, Shigella boydii
  CDS (1)..(504)
atgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgccggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100347 - protein, 167 aa, Shigella boydii
MSRQCTHYGRWPQHGFTSLKKLRPQSVTSRIQPGSDVIVCAEMDEQWGYVGAKSRQRWLFYAYDRIRRTVVAHVFGERTLATLERLLSLLPAFEVVVWMTDGWPLYESRLKGKLHVISKRYTQRIERHNLNLRQHLARLGRKSLSFSKSVELHDKVIGHYLNIKHYQ

SEQ ID NO: 100348 - DNA, 396 bp, Shigella flexneri
  CDS (1)..(396)
atggcgtttatctgcgagcttgatgagcaatggagctacgttggcagtaaagcccggcaacattggctcgggtacgcgtacaacaccaaaacaggcggtgtactggcctacacttttggtccccgaaccgatcaaacgtgccgggagctactggcactgcttacacccttcaacatcggcatgctgaccagcgatgactggggcagctatggccgggaggtgccgaagaataagcatctgaccggcaaaatattcacccaacgcattgagcgtaataatctgacgctacgcacccgcattaagcggttgggtcgtaaaacaatctgcttctcacgctcagttgagatccacgaaaaagtgatcggagcgtttatcgaaaaacacatgttctactaa

SEQ ID NO: 100349 - protein, 131 aa, Shigella flexneri
MAFICELDEQWSYVGSKARQHWLGYAYNTKTGGVLAYTFGPRTDQTCRELLALLTPFNIGMLTSDDWGSYGREVPKNKHLTGKIFTQRIERNNLTLRTRIKRLGRKTICFSRSVEIHEKVIGAFIEKHMFY

SEQ ID NO: 100350 - DNA, 426 bp, Vibrio vulnificus
  CDS (1)..(426)
atgacctcgattccattcgataaagcaaatatctctctcatctgtgaagttgatgagcaatggtcattcgtcggtaaaaagaaaaatcgccgctggctttggtatgcttgggagcctcgctataaacgcatcattgctcacgcatttggtaaacgaaatacggatgctcttcgatcgttactcactttgctaaagccgttcgacatcagcttcttttttaccgatgacttcagcgtttacgcaaaagaattaccaaaggaaaagcatgttgtaggcaaaaggttcactcagcggattgagcgaaccaatctgaccttacgttccagattaaaacgtttagtgcgtagaactatcggcttttctagatcggaggagatgcacgataaggtgatcggaacattcattgaacgggaattctatttttaa

SEQ ID NO: 100351 - protein, 141 aa, Vibrio vulnificus
MTSIPFDKANISLICEVDEQWSFVGKKKNRRWLWYAWEPRYKRIIAHAFGKRNTDALRSLLTLLKPFDISFFFTDDFSVYAKELPKEKHVVGKRFTQRIERTNLTLRSRLKRLVRRTIGFSRSEEMHDKVIGTFIEREFYF

SEQ ID NO: 100352 - DNA, 696 bp, Shigella flexneri
  CDS (1)..(696)
atggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctctacacggttttacgtcacttaaaaaactcagccgagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggggaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggccatcgggcattatctgaacataaaacactatcagtaa

SEQ ID NO: 100353 - protein, 231 aa, Shigella flexneri
MASISIRCPSCSATEGVVRNGKSTAGHQRYLCSHCRKTWQLQFTYTASQPGTHQKIIDMAMNGVGCRASARIMGVGLYTVLRHLKNSAESVTSRIQPGSDVIVCAEMDEHWGYVGAKSRQRWLFYAYDRIRRTVVAHVFGERTLATLERLLSLLSAFEVVVWMTDGCPLYESRLKGKLHVISKRYTQRIERHNLNLRQHLARLVRKSLSFSKSVELHDKAIGHYLNIKHYQ

SEQ ID NO: 100354 - DNA, 396 bp, Shigella flexneri 2a str
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100355 - protein, 131 aa, Shigella flexneri 2a str
MIVCAEMDEHWGYVGAKSRQRWLFYAYDRIRRTVVAHVFGERTLATLERLLSLLSAFEVVVWMTDGCPLYESRLKGKLHVISKRYTQRIERHNLNLRQHLARLVRKSLSFSKSVELHDKVIGHYLNIKHYQ

SEQ ID NO: 100356 - DNA, 396 bp, Shigella flexneri 2a str
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggccatcgggcattatctgaacataaaacactatcagtaa

SEQ ID NO: 100357 - protein, 131 aa, Shigella flexneri 2a str
MIVCAEMDEHWGYVGAKSRQRWLFYAYDRIRRTVVAHVFGERTLATLERLLSLLSAFEVVVWMTDGWPLYESRLKGKLHVISKRYTQRIERHNLNLRQHLARLGRKSLSFSKSVELHDKAIGHYLNIKHYQ

SEQ ID NO: 100358 - DNA, 396 bp, Shigella flexneri 2a str
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100359 - protein, 131 aa, Shigella flexneri 2a str
MIVCAEMDEHWGYVGAKSRQRWLFYAYDRIRRTVVAHVFGERTLATLERLLSLLSAFEVVVWMTDGWPLYESRLKGKLHVISKRYTQRIERHNLNLRQHLARLVRKSLSFSKSVELHDKVIGHYLNIKHYQ

SEQ ID NO: 100360 - DNA, 396 bp, Shigella flexneri 2a str
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctggtacggaagccactgtcgttctcaaaatcggtggagctgcatgacaaggtcatcgggcattatctgaacataaaacactatcagtaa

SEQ ID NO: 100361 - protein, 131 aa, Shigella flexneri 2a str
MIVCAEMDEHWGYVGAKSRQRWLFYAYDRIRRTVVAHVFGERTLATLERLLSLLSAFEVVVWMTDGWPLYESRLKGKLHVISKRYTQRIERHNLNLRQHLARLVRKPLSFSKSVELHDKVIGHYLNIKHYQ

SEQ ID NO: 100362 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtgccgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100363 - protein, 131 aa, Shigella flexneri
MIVCAEMDEHWGYVGAKSRQRWLFYAYDRIRRTVVPHVFGERTLATLERLLSLLSAFEVVVWMTDGWPLYESRLKGKLHVISKRYTQRIERHNLNLRQHLARLGRKSLSFSKSVELHDKVIGHYLNIKHYQ

SEQ ID NO: 100364 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggggaacgcactctggccacactggagcgtcttctgagcctgctgtcggcctttgaggtcgtggtatggatgacggatggctggccgctgtatgaatcatgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100365 - protein, 131 aa, Shigella flexneri
MIVCAEMDEHWGYVGAKSRQRWLFYAYDRIRRTVVAHVFGERTLATLERLLSLLSAFEVVVWMTDGWPLYESCLKGKLHVISKRYTQRIERHNLNLRQHLARLVRKSLSFSKSVELHDKVIGHYLNIKHYQ

SEQ ID NO: 100366 - DNA, 504 bp, Shigella flexneri
  CDS (1)..(504)
atgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggggaacgcactctggccacactgagggtttttttgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100367 - protein, 167 aa, Shigella flexneri
MSRQCTHYGRWPQHGFTSLKKLRPQSVTSRIQPGSDVIVCAEMDEHWGYVGAKSRQRWLFYAYDRIRRTVVAHVFGERTLATLRVFLSLLSAFEVVVWMTDGWPLYESRLKGKLHVISKRYTQRIERHNLNLRQHLARLVRKSLSFSKSVELHDKVIGHYLNIKHYQ

SEQ ID NO: 100368 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaaccacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100369 - protein, 131 aa, Shigella flexneri
MIVCAEMDEHWGYVGAKSRQRWLFYAYDRIRRTVVAHVFGERTLATLERLLSLLSAFEVVVWMTDGWPLYEPRLKGKLHVISKRYTQRIERHNLNLRQHLARLVRKSLSFSKSVELHDKVIGHYLNIKHYQ

SEQ ID NO: 100370 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacgggggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100371 - protein, 131 aa, Shigella flexneri
MIVCAEMDEHWGYVGAKSRQRWLFYAYDRIRGTVVAHVFGERTLATLERLLSLLSAFEVVVWMTDGWPLYESRLKGKLHVISKRYTQRIERHNLNLRQHLARLGRKSLSFSKSVELHDKVIGHYLNIKHYQ

SEQ ID NO: 100372 - DNA, 474 bp, Shigella flexneri
  CDS (1)..(474)
atgtcgcgccagtgcacgcattatgggcgttggcctcaacacggttttacgtcacttaaaaaactcacgccgcagtcggtaacctcgcgcatacaaccgggcactgatgtgattgtctgcgctgaaatggacgaacattggggctatttttgtgctaaaaaacgtcagcgctggctggttgacacctatgacaagatacggaggacggatgtggaccacgttttcggtgaacgcactctggccacactggagcgtcttctgagcctgctgtcggcctttgaggtcgcggtatggatgacggatggttggccgctgtatgaatcacgcctgaagggaaagctgcacgttatcagcaagcgttacactcagcgcattgagcgacataatctgaatctgagacaacatttggcaaggctggtacggaagtcactgtcgttctcaaaatcggtggagctgcattcgggcattatctga

SEQ ID NO: 100373 - protein, 157 aa, Shigella flexneri
MSRQCTHYGRWPQHGFTSLKKLTPQSVTSRIQPGTDVIVCAEMDEHWGYFCAKKRQRWLVDTYDKIRRTDVDHVFGERTLATLERLLSLLSAFEVAVWMTDGWPLYESRLKGKLHVISKRYTQRIERHNLNLRQHLARLVRKSLSFSKSVELHSGII

SEQ ID NO: 100374 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgccggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100375 - protein, 131 aa, Shigella flexneri
MIVCAEMDEHWGYVGAKSRQRWLFYAYDRIRRTVVAHVFGERTLATLERLLSLLSAFEVVVWMPDGWPLYESRLKGKLHVISKRYTQRIERHNLNLRQHLARLGRKSLSFSKSVELHDKVIGHYLNIKHYQ

SEQ ID NO: 100376 - DNA, 396 bp, Shigella flexneri
  CDS (1)..(396)
atgattgtctgcgctgaaatggacgaacattggggctacgtcggtgctaaatcacgtcagcgctggctgttttacgcgtgtgacaggatacggaggacggctgtggcgcacgtcttcggggaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100377 - protein, 131 aa, Shigella flexneri
MIVCAEMDEHWGYVGAKSRQRWLFYACDRIRRTAVAHVFGERTLATLERLLSLLSAFEVVVWMTDGWPLYESRLKGKLHVISKRYTQRIERHNLNLRQHLARLGRKSLSFSKSVELHDKVIGHYLNIKHYQ

SEQ ID NO: 100378 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaagctgagacaacatctggcaaggctggtacggaagtcactgtcgttctcaaaatcggtggagctgcatgacaaggtcatcgggcattatctgaacataaaacactatcagtaa

SEQ ID NO: 100379 - protein, 131 aa, Shigella flexneri
MIVCAEMDEHWGYVGAKSRQRWLFYAYDRIRRTVVAHVFGERTLATLERLLSLLSAFEVVVWMTDGWPLYESRLKGKLHVISKRYTQRIERHNLKLRQHLARLVRKSLSFSKSVELHDKVIGHYLNIKHYQ

SEQ ID NO: 100380 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcacattgagcgacataatctgaatctgagacaacatctggcaaggctgggacggaagtcactgtcgttctcaaaatcggtggagctgcatgacaaggtcatcgggcattatctgaacataaaacactatcagtaa

SEQ ID NO: 100381 - protein, 131 aa, Shigella flexneri
MIVCAEMDEHWGYVGAKSRQRWLFYAYDRIRRTVVAHVFGERTLATLERLLSLLSAFEVVVWMTDGWPLYESRLKGKLHVISKRYTQHIERHNLNLRQHLARLGRKSLSFSKSVELHDKVIGHYLNIKHYQ

SEQ ID NO: 100382 - DNA, 396 bp, Shigella flexneri
  CDS (1)..(396)
atgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgttttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctggtacggaagtcactgtcgttctcaaaatcggtggagctgcatgacaaggtcatcgggcattatctgaacataaaacactatcagtaa

SEQ ID NO: 100383 - protein, 131 aa, Shigella flexneri
MIVCAEMDEHWGYVGAKSRQRWLFYAYDRIRRTVVAHVFGERTLATLERFLSLLSAFEVVVWMTDGWPLYESRLKGKLHVISKRYTQRIERHNLNLRQHLARLVRKSLSFSKSVELHDKVIGHYLNIKHYQ

SEQ ID NO: 100384 - DNA, 393 bp, Shigella flexneri
  CDS (1)..(393)
atgtctgcgctgaaatggacgaacattggggctacgtcgggtgctaaatcatgtcagcgctggctgttttacgcgtatgacaggatacggaggacggttgtgccgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagttactgtcgttctcaaaatcggtggagttgcatgacaaggtcatcgggcattatctgaacataaaacactatcagtaa

SEQ ID NO: 100385 - protein, 130 aa, Shigella flexneri
MSALKWTNIGATSGAKSCQRWLFYAYDRIRRTVVPHVFGERTLATLERLLSLLSAFEVVVWMTDGWPLYESRLKGKLHVISKRYTQRIERHNLNLRQHLARLGRKLLSFSKSVELHDKVIGHYLNIKHYQ

SEQ ID NO: 100386 - DNA, 369 bp, Yersinia pestis
  CDS (1)..(369)
atgtggtcatttgtgggcaacaaaaagcagcaacgttggctttggtatgcctgggagtctcgcctcaaacgtattattgctcatgtttttggtcgtcggagcaaaaagacatttcgccaattattggggttgctgtcaggtttcaatatcgtcttctggtgtaccgacaacttcagtgcttatgagatgttgccggatgaaaaacacatcaggagcaagctttacacgcagcggattgagcgtgaaaacctgaatatccgtaatcggttgaaacgactgaaccgcaagactctcggagactcaaagtcggcagaaatgcatgacaggatcatcggtacgttcattgagcgtgagcattacctagtgtga

SEQ ID NO: 100387 - protein, 122 aa, Yersinia pestis
MWSFVGNKKQQRWLWYAWESRLKRIIAHVFGRRSKKTFRQLLGLLSGFNIVFWCTDNFSAYEMLPDEKHIRSKLYTQRIERENLNIRNRLKRLNRKTLGDSKSAEMHDRIIGTFIEREHYLV

SEQ ID NO: 100388 - DNA, 393 bp, Escherichia coli O6
  CDS (1)..(393)
atgacgcttatctgcgaacttgatgaacaatggagttttgtcgaaaacaaagctcgtcagcagtggcactggtatgcgtataccaccaaatctggaggtgtgctggcttacacttttggtcctcgcactgatgaaacatgtcgtgagttgccggaactcctgaagccattctccacaggcatgataaccagagacaaccggagcagttataccagagaaatgccacaggataagcatcttgtcggcaagatatttacccggcgcattgagcgcaacaatctgacacttcgtactcacatcaaacgaccagcccggaaaacgatttgcttttcacgctccctggaaattcacgaaaagccattggttcatttatcgaaaacactgtactactga

SEQ ID NO: 100389 - protein, 130 aa, Escherichia coli O6
MTLICELDEQWSFVENKARQQWHWYAYTTKSGGVLAYTFGPRTDETCRELPELLKPFSTGMITRDNRSSYTREMPQDKHLVGKIFTRRIERNNLTLRTHIKRPARKTICFSRSLEIHEKPLVHLSKTLYY

SEQ ID NO: 100390 - DNA, 987 bp, Sulfolobus tokodaii
  CDS (1)..(987)
atgcaagggtcacgaggttatatgggggttcacgagatggacctcgtaacccttgcacaattaatacttttggttctgaggaatttaaattttaagccaagaaaacacgatttagaagaccttgcttacgcaatagcagcatacctactaggagtacaagtcaccaaactgggaataccaccatcaacactatactactacactaaaaagcttggagtaaagaggagaagagaagaaaaaccaccttgtccctcatgcaaatcaaacaaaatagtaaagaacggctcatctagaggaaaaacaaaatacaagtgcaaaacttgcgggagaacattctatcaaacacaaaaccacaagatgagtaaagaacaaaaggaaaggatactgaaagagtacactaacagaatgagtatgagaggagtagcaagggttgaaggaaaaccattaacaacaatatacagtctagtgatgaggaaggggatagaggcatacgcacacttattaatcctacaagaacaactaaagaacttcacagcaaaatccacagtaattgatgagagttggacttacgtgagggttagacacggttcaaagagggagaacttgtggatatggaacgcattaactgatggtgtacccttcttcaccacgggtgatagggattataggactttcagttacctcttgaataccctacccaagagcaaggtatattacactgatgattactcagtttatcaagtactcaacaatcatgttgtaagtaagaagtacacatacaccgtggagagttataattcttactgtagggctcaccttgctaggttggcaagggatacaagggctgttaataggagtaggaggatggttgactatactattgccttgttgaacatcatgtacccggtagtttattcaagggagaaaactcccttaaatgaggcttacttgaagggggtacaatatattagaaataaactgatataa

SEQ ID NO: 100391 - protein, 328 aa, Sulfolobus tokodaii
MQGSRGYMGVHEMDLVTLAQLILLVLRNLNFKPRKHDLEDLAYAIAAYLLGVQVTKLGIPPSTLYYYTKKLGVKRRREEKPPCPSCKSNKIVKNGSSRGKTKYKCKTCGRTFYQTQNHKMSKEQKERILKEYTNRMSMRGVARVEGKPLTTIYSLVMRKGIEAYAHLLILQEQLKNFTAKSTVIDESWTYVRVRHGSKRENLWIWNALTDGVPFFTTGDRDYRTFSYLLNTLPKSKVYYTDDYSVYQVLNNHVVSKKYTYTVESYNSYCRAHLARLARDTRAVNRSRRMVDYTIALLNIMYPVVYSREKTPLNEAYLKGVQYIRNKLI

SEQ ID NO: 100392 - DNA, 459 bp, Shigella flexneri
  CDS (1)..(459)
atgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctgggacggaagtccctgaaccgccccgggaatcctggagactaa

SEQ ID NO: 100393 - protein, 152 aa, Shigella flexneri
MSRQCTHYGRWPQHGFTSLKKLRPQSVTSRIQPGSDVIVCAEMDEHWGYVGAKSRQRWLFYAYDRIRRTVVAHVFGERTLATLERLLSLLSAFEVVVWMTDGCPLYESRLKGKLHVISKRYTQRIERHNLNLRQHLARLGRKSLNRPGNPGD

SEQ ID NO: 100394 - DNA, 390 bp, Shigella flexneri
  CDS (1)..(390)
atgggccgttggtggagatataagtggatcacttttcatccgtcgttgacacaacactggctctggtatgcgtacaacactaaaactggcggtgtgttggcttacactttcgggccacggaatgatgagacctgtcgggaactgttagccctgttgactccgttctgtatcggcatggtgaccagcgatgactggggcagctacgccagagaagtgccgaaggagaaacacctgaccggcaaaatcttcacgcaacgtattgcacgtaacaaccggaccctccgcacccgcatcaagcggctggcacgtaaaacaatctgcttctcgcgttccgtggaaatccacgaaaaagtcatcggctccttcattgaaaagcacatgttctactga

SEQ ID NO: 100395 - protein, 129 aa, Shigella flexneri
MGRWWRYKWITFHPSLTQHWLWYAYNTKTGGVLAYTFGPRNDETCRELLALLTPFCIGMVTSDDWGSYAREVPKEKHLTGKIFTQRIARNNRTLRTRIKRLARKTICFSRSVEIHEKVIGSFIEKHMFY

SEQ ID NO: 100396 - DNA, 507 bp, Pantoea agglomerans
  CDS (1)..(507)
atgcattcgttacaccgcccgagcgctacatatcagtatcaatgccgttgttcgcaccttaaaaaactctcgccgcgatgtgtaaccacactcccactggataatatccagattcagcttatctgcgaagttgatgaaatgtggtcatttgttggcaataagaagcaacagcgctggctgttatatgcatgggagcctcgtctcaaacgcattattgcccatgctttcgggggtcggagtaaaaagaggctgcgtaaattactggggttactgtcgggcttcaatattgtcttctggtgttcagataacttcagcgcttatgaactgttgccgggtaaaaatcacatcacaggcaagctttacacgcagcgcgttgagcgagaaaacctgaatcttcgtaaccggttaaaacgactcaatcgcaagactcttgggtactcaaaatcagcagaaatgcacgataaggtaatcggtacgttcatcgagcgtgagtattacgtattataa

SEQ ID NO: 100397 - protein, 168 aa, Pantoea agglomerans
MHSLHRPSATYQYQCRCSHLKKLSPRCVTTLPLDNIQIQLICEVDEMWSFVGNKKQQRWLLYAWEPRLKRIIAHAFGGRSKKRLRKLLGLLSGFNIVFWCSDNFSAYELLPGKNHITGKLYTQRVERENLNLRNRLKRLNRKTLGYSKSAEMHDKVIGTFIEREYYVL

SEQ ID NO: 100398 - DNA, 504 bp, Salmonella typhi
  CDS (1)..(504)
atgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggttacgtcggtgctaaatcacgccagcgctggttgttttacgcgtatgacaggatacggaggacggttgtggcgcacgtattcggtgaacgcacgttggccacgctggagcgtcttccgggcctgctgtcggccttcgaggtcgtggtatggatgacggatgactggccgctttatgaatcacgcctgaagggaaagctgcacgttatcagcaagcgttacactcagcgcattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 100399 - protein, 167 aa, Salmonella typhi
MPGNRPHYGRWPQHDFPPFKKLRPQSVTSRIQPGSDVIVCAEMDEQWGYVGAKSRQRWLFYAYDRIRRTVVAHVFGERTLATLERLPGLLSAFEVVVWMTDDWPLYESRLKGKLHVISKRYTQRIERHNLNLRQHLARLGRKSLSFSKSVELHDKVIGHYLNIKHYQ

SEQ ID NO: 100400 - DNA, 396 bp, Shigella dysenteriae
  CDS (1)..(396)
atggcgcttatctgcgaacttgatgagcaatggagtttcgttggcagtaaagcccggcaacactggctctggtacgcgtataacaccaaaacaggggggggactggcctacacttttggtccccgtaccgatgaaacctgccgggaactactggcactgcttacgccattcaacatcggcatgatcaccagcgacgactggggcagctatggccgggaggtgccgaaggataagcatctgaccggaaaaatattcacccaacggattgagcgcaataacctgacgctgcgcacccgcattaagcgcttggctcgtaaaacaatctgcttctcgcgttcagtagagatccacgaaaaagtcatcgggacgtttattgaaaaacacatgttctactaa

SEQ ID NO: 100401 - protein, 131 aa, Shigella dysenteriae
MALICELDEQWSFVGSKARQHWLWYAYNTKTGGGLAYTFGPRTDETCRELLALLTPFNIGMITSDDWGSYGREVPKDKHLTGKIFTQRIERNNLTLRTRIKRLARKTICFSRSVEIHEKVIGTFIEKHMFY

SEQ ID NO: 100402 - DNA, 396 bp, Escherichia coli
  CDS (1)..(396)
atggcgtttatctgcgagcttgatgagcaatggagctacgttggcagtaaagcccggcaacactggatctggtacgcgtacaacaccaaaacaggcggtgtactggcctacacttttggtccccgaaccgatcaaacgtgccgggagctactggcactgcttacacccttcaacatcggcatgctgaccagcgatgactggggcagctatggccgggaggtgccgaagaataagcatctgaccggcaaaatattcacccaatgcattgagcgtaataatctgacgctacgcacccgcattaagcggttgggtcgtaaaacaatctgcttctcacgctcagttgagatccacgaaaaagtgatcggagcgtttatcgaaaaacacatgttctactaa

SEQ ID NO: 100403 - protein, 131 aa, Escherichia coli
MAFICELDEQWSYVGSKARQHWIWYAYNTKTGGVLAYTFGPRTDQTCRELLALLTPFNIGMLTSDDWGSYGREVPKNKHLTGKIFTQCIERNNLTLRTRIKRLGRKTICFSRSVEIHEKVIGAFIEKHMFY

SEQ ID NO: 100404 - DNA, 504 bp, Escherichia coli
  CDS (1)..(504)
atgccgggcaacagcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 100405 - protein, 167 aa, Escherichia coli
MPGNSPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 100406 - DNA, 20 bp, Artificial sequence
  primer
atgccgggcaacagcccgca

SEQ ID NO: 100407 - DNA, 28 bp, Artificial sequence
  primer
ttattgatagtgttttatgttcagataa

SEQ ID NO: 100408 - protein, 119 aa, Artificial sequence
  Variant (3)..(3): xaa in position 3 is any amino acid
  Variant (5)..(6): xaa in position 5 to 6 is any amino acid
  Variant (9)..(9): xaa in position 9 is any amino acid
  Variant (11)..(13): xaa in position 11 to 13 is any amino acid
  Variant (15)..(15): xaa in position 15 is any amino acid
  Variant (18)..(18): xaa in position 18 is any amino acid
  Variant (22)..(29): xaa in position 22 to 29 is any amino acid
  Variant (31)..(32): xaa in position 31 to 32 is any amino acid
  Variant (35)..(35): xaa in position 35 is any amino acid
  Variant (37)..(39): xaa in position 37 to 39 is any amino acid
  Variant (41)..(43): xaa in position 41 to 43 is any amino acid
  Variant (46)..(46): xaa in position 46 is any amino acid
  Variant (49)..(50): xaa in position 49 to 50 is any amino acid
  Variant (52)..(58): xaa in position 52 to 58 is any amino acid
  Variant (60)..(63): xaa in position 60 to 63 is any amino acid
  Variant (65)..(75): xaa in position 65 to 75 is any amino acid
  Variant (77)..(79): xaa in position 77 to 79 is any amino acid
  Variant (81)..(82): xaa in position 81 to 82 is any amino acid
  Variant (89)..(89): xaa in position 89 is any amino acid
  Variant (92)..(92): xaa in position 92 is any amino acid
  Variant (95)..(98): xaa in position 95 to 98 is any amino acid
  Variant (101)..(101): xaa in position 101 is any amino acid
  Variant (104)..(106): xaa in position 104 to 106 is any amino acid
  Variant (109)..(109): xaa in position 109 is any amino acid
  Variant (111)..(111): xaa in position 111 is any amino acid
  Variant (113)..(113): xaa in position 113 is any amino acid
  Variant (115)..(115): xaa in position 115 is any amino acid
  Variant (117)..(117): xaa in position 117 is any amino acid
DEXWXXVGXKXXXQXWLXYAYXXXXXXXXAXXFGXRXXXTXXXLLXLLXXFXXXXXXXDXXXXYXXXXXXXXXXXHXXXKXXTQRIERXNLXLRXXXXRLXRKXXXFSXSXEXHXKXIG

SEQ ID NO: 100409 - protein, 59 aa, Artificial sequence
  Variant (1)..(1): xaa in position 1 is Tyr, Phe or Thr
  Variant (2)..(2): xaa in position 2 is Val, Ser, Phe or Met
  Variant (3)..(4): xaa in position 3 to 4 is any amino acid
  Variant (5)..(5): xaa in position 5 is Lys, Ser, Gln or Arg
  Variant (6)..(7): xaa in position 6 to 7 is any amino acid
  Variant (8)..(8): xaa in position 8 is any or no amino acid
  Variant (9)..(9): xaa in position 9 is Gln, Lys or Arg
  Variant (10)..(10): xaa in position 10 is any amino acid
  Variant (12)..(12): xaa in position 12 is Leu, His or Ile
  Variant (13)..(13): xaa in position 13 is Phe, Trp, Leu or Val
  Variant (14)..(14): xaa in position 14 is Tyr, Trp or Lys
  Variant (16)..(16): xaa in position 16 is Tyr, Trp or Val
  Variant (17)..(17): xaa in position 17 is Asp, Asn, Glu or Thr
  Variant (18)..(21): xaa in position 18 to 21 is any amino acid
  Variant (22)..(22): xaa in position 22 is Thr, Gly or Arg
  Variant (23)..(23): xaa in position 23 is any amino acid
  Variant (24)..(24): xaa in position 24 is Val, Leu or Ile
  Variant (25)..(25): xaa in position 25 is any amino acid
  Variant (26)..(26): xaa in position 26 is His, Tyr, Trp or Phe
  Variant (27)..(27): xaa in position 27 is any amino acid
  Variant (28)..(28): xaa in position 28 is Phe, Leu or Thr
  Variant (30)..(30): xaa in position 30 is any amino acid
  Variant (31)..(31): xaa in position 31 is Arg or His
  Variant (32)..(32): xaa in position 32 is Thr, Ser, Asp or Asn
  Variant (33)..(34): xaa in position 33 to 34 is any amino acid
  Variant (35)..(35): xaa in position 35 is Thr, Ser, Ala or Arg
  Variant (36)..(36): xaa in position 36 is Leu, Cys or Phe
  Variant (37)..(38): xaa in position 37 to 38 is any amino acid
  Variant (39)..(39): xaa in position 39 is Leu or Phe
  Variant (40)..(40): xaa in position 40 is Leu, Met, Pro or Trp
  Variant (41)..(41): xaa in position 41 is any amino acid
  Variant (42)..(42): xaa in position 42 is Leu, Arg or Val
  Variant (43)..(43): xaa in position 43 is Leu or Val
  Variant (44)..(45): xaa in position 44 to 45 is any amino acid
  Variant (46)..(46): xaa in position 46 is Phe or Trp
  Variant (47)..(49): xaa in position 47 to 49 is any amino acid
  Variant (50)..(50): xaa in position 50 is Val, Met, Phe or Ile
  Variant (51)..(52): xaa in position 51 to 52 is any amino acid
  Variant (53)..(53): xaa in position 53 is Thr, Ser, Pro or Arg
  Variant (55)..(55): xaa in position 55 is Gly, Asp or Asn
  Variant (56)..(56): xaa in position 56 is Trp, Tyr, Phe, Cys or Arg
  Variant (57)..(58): xaa in position 57 to 58 is any amino acid
  Variant (59)..(59): xaa in position 59 is Tyr or Asp
XXXXXXXXXXWXXXAXXXXXXXXXXXXXGXXXXXXXXXXXXXXXXXXXXXXXXDXXXXX

SEQ ID NO: 100410 - protein, 43 aa, Artificial sequence
  Variant (1)..(1): xaa in position 1 is His or Gln
  Variant (2)..(2): xaa in position 2 is Val, Leu, Ile or Gly
  Variant (3)..(4): xaa in position 3 to 4 is any amino acid
  Variant (6)..(6): xaa in position 6 is any amino acid
  Variant (7)..(7): xaa in position 7 is Tyr, Phe or Glu
  Variant (8)..(8): xaa in position 8 is Thr or Met
  Variant (9)..(10): xaa in position 9 to 10 is any amino acid
  Variant (11)..(11): xaa in position 11 is Ile or Val
  Variant (14)..(14): xaa in position 14 is any amino acid
  Variant (16)..(17): xaa in position 16 to 17 is any amino acid
  Variant (18)..(18): xaa in position 18 is Leu, Asn or Ile
  Variant (20)..(20): xaa in position 20 is any amino acid
  Variant (21)..(21): xaa in position 21 is His, Arg, Trp, Met or Tyr
  Variant (22)..(22): xaa in position 22 is Leu, Ile or Phe
  Variant (23)..(23): xaa in position 23 is Ala, Lys or Ser
  Variant (25)..(25): xaa in position 25 is Leu, Phe or Pro
  Variant (26)..(26): xaa in position 26 is any amino acid
  Variant (28)..(28): xaa in position 28 is Lys, Arg, Asp or Pro
  Variant (29)..(29): xaa in position 29 is any amino acid
  Variant (30)..(30): xaa in position 30 is Leu, Ile, Lys or Arg
  Variant (31)..(31): xaa in position 31 is any amino acid
  Variant (32)..(32): xaa in position 32 is Phe, Asp, Tyr, Val or Ile
  Variant (34)..(34): xaa in position 34 is Lys or Arg
  Variant (36)..(37): xaa in position 36 to 37 is any amino acid
  Variant (38)..(38): xaa in position 38 is Leu, Met or Ile
  Variant (39)..(39): xaa in position 39 is His, Val, Ile or Leu
  Variant (40)..(40): xaa in position 40 is Asp, Glu, Ser, Asn or Arg
  Variant (41)..(42): xaa in position 41 to 42 is any amino acid
  Variant (43)..(43): xaa in position 43 is Ile, Met or Leu
XXXXKXXXXXXERXNXXXRXXXXRXXRXXXXXSXSXXXXXXXX

SEQ ID NO: 100411 - DNA, 1287 bp, Escherichia coli K12
  CDS (1)..(1287): transl_table=11
atgtccgaagatatctttgacgccatcatcgtcggtgcagggcttgccggttcggttgccgcactggtgctcgcccgcgaaggtgcgcaagtgttagttatcgagcgtggcaattccgcaggtgccaagaacgtcaccggcgggcgtctctatgcccacagtctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaactccatccttgccgaaaaattggggatggcaaaacgcgtcaaaccgacggatgtggcggttggcgtgaaggaactgatcgagttaccgaagtcggttattgaagaccgttttcagttgcagggtaatcagggggcggcttgcctgtttgcgggatcacccaccgatggcctgatgggcggcggcttcctttataccaatgaaaacaccctgtcgctggggctggtttgtggtttgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggtccgctgcgcgatatgcgtatgtaccagaaactaccggcgttccttgataacccacgcatgtttagcggctacccggagctggcggtgggtgtggcgcgtgacctgttcaccattgatggcagcgcgccggaactgatgcgcaagaaaatcctccgccacggcaagaaagtgggcttcatcaatctaatcaaggatggcatgaaaggagtgaccgttttatga

SEQ ID NO: 100412 - protein, 428 aa, Escherichia coli K12
MSEDIFDAIIVGAGLAGSVAALVLAREGAQVLVIERGNSAGAKNVTGGRLYAHSLEHIIPGFADSAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTDVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKILRHGKKVGFINLIKDGMKGVTVL

SEQ ID NO: 100413 - DNA, 1854 bp, Danio rerio
  CDS (1)..(1854)
atgttgccagcaagtagatataccctccaagcacggaggtgtatacatgcactgaaggtggttaaagcagagcatgttgctcctcagatttactccacacgctggttctcctctgtgccacggattaccacacattacacagtttaccccagagacaaggactcgcgatgggaaggggtagaaatggaacgcttcgctgatgaggcagacgttgtcattattggtggtggtccggccggcctatcagctgcaatccggctgaagcagctggccaatcagcatgagaaggagctgcgggtttgtgtggtggaaaaggcatctcagatcggagctcacacactgtctggagcctgtctggagcccaccgcactcaacgagctcattccagactggaaggagagaggggcaccattgaacactccagttacagaggacaagttttccattttgacagaaaaataccgcattcccgtaccaatactaccaggacttccaatgaataaccatggaaactaccttgttcgcttggggcattttgtacgctggcttggggaacaggcggaagagctcggagtggagctgtatccaggctatgccgcagctgaggtgctgtttcatgaagatggaagtgtgaaaggaattgcaaccaatgatgttggcattgctaaagacggctctccaaaggatgtgtttgagagagggatggagctccacgcgaaggtcactatgtttggtgaaggctgccatggacatctggccaagcaactgtacaaacagtttaatctgagggagaagtgtgagccgcagacttatgccatcggcctcaaagagctctgggttattgatgagaagaagtggcgaccgggacgagcagagcactcagtcggctggcctctgaacaggaacacatacggaggcactttcctgtaccacctcaacgaaggagaaccactggtggccctgggctttgtcgtaggtttggactacactaatccctacatgagtccattcagggagttccagcgctggaagcatcacccttcggtgatgtccaccctggagggaggaaacaggattgcatatggagccagagccctcaatgaaggaggctttcagtcaatccctcagctgacatttccaggcggcatgttgatcggctgcagtccaggcttcatgaacgtgcccaagatcaaaggcacacacacggccatgaagagcggcatgctggcggccgagaccgccttcagcaaaatcactgatgagaatctgcagtcgcaaaccacaggtctctatattcctgaatatgaggaagctttgaaaaagtcctgggtttggaaggagctgcgttcagtgaggaacatcagaccatccttccatacgtacttcggcctctacggtgggatggtctacactgggatcttctactggatttttagaggaaaagagccatggactttaaagcatagcggctcagactatgctcagctgaagccggcgaaggactgttctcccatcgagtaccccaaacctgacgggaagatcagctttgatctgttgtcgtctgtggctttgagcgggacaaatcacgaacacgaccagccggctcacctgacgctcaaagatgacagtattcctgttagcaaaaaccttgccatttatgacggtcctgagcagaggttctgtcccgctggtgtgtacgagtatgttcctctggagacgggtgatggcatgagattacagatcaacgctcagaactgcgttcactgcaagacctgtgatatcaaagacccaagccagaacatcaactgggtggtgcccgagggcagcggaggaccagcatacaacggcatgtga

SEQ ID NO: 100414 - protein, 617 aa, Danio rerio
MLPASRYTLQARRCIHALKVVKAEHVAPQIYSTRWFSSVPRITTHYTVYPRDKDSRWEGVEMERFADEADVVIIGGGPAGLSAAIRLKQLANQHEKELRVCVVEKASQIGAHTLSGACLEPTALNELIPDWKERGAPLNTPVTEDKFSILTEKYRIPVPILPGLPMNNHGNYLVRLGHFVRWLGEQAEELGVELYPGYAAAEVLFHEDGSVKGIATNDVGIAKDGSPKDVFERGMELHAKVTMFGEGCHGHLAKQLYKQFNLREKCEPQTYAIGLKELWVIDEKKWRPGRAEHSVGWPLNRNTYGGTFLYHLNEGEPLVALGFVVGLDYTNPYMSPFREFQRWKHHPSVMSTLEGGNRIAYGARALNEGGFQSIPQLTFPGGMLIGCSPGFMNVPKIKGTHTAMKSGMLAAETAFSKITDENLQSQTTGLYIPEYEEALKKSWVWKELRSVRNIRPSFHTYFGLYGGMVYTGIFYWIFRGKEPWTLKHSGSDYAQLKPAKDCSPIEYPKPDGKISFDLLSSVALSGTNHEHDQPAHLTLKDDSIPVSKNLAIYDGPEQRFCPAGVYEYVPLETGDGMRLQINAQNCVHCKTCDIKDPSQNINWVVPEGSGGPAYNGM

SEQ ID NO: 100415 - DNA, 1851 bp, Xenopus tropicalis
  CDS (1)..(1851)
atgttaccactgtgtaagcatacactgcacgcacatcactgctttgcttacttcacggcactcaagaattgccttccttcttcctgtctaaagagatgggcttcttcctcagtgcctcgcatcacaacacactataccatctgcccacgggaccaggataaaagatgggaagggatgaacatggaaagatttgcagaagaagcagatgttgtgatagtaggaggtggtcctgcaggactctctgcagcgatacgtctcaagcagcttgcggctgaatgcgacaaagagctacgtgtgtgcctagtggagaaaggagcacagattggggcacacactttgtcaggagcttgcctcgaaccccgagccctagaagagcttttccctgactggaaggaacgaggggctcctctaaatactcctgtgactgaagataagtttggaattttaacaaaaaaacacagaatccctgtacctatccttccaggactgccaatgaataaccatggaaattacattgtacgccttgggcattttgttagctggcttggggagcaggcagaagctcttggagttgagatatatcctggatatgcagcttcagaggtactttttcatgaagatggcagtgttaagggcatagcaactaatgatgtcggcatccataaagatggctcaccaaagtctacttttgaacggggcttggaactgcatgccaaagtaactatctttggggaaggttgtcacgggcatcttgccaaacagttatacaacaaatttaatctgcgacagaactgtgagccacagacctatgcaattgggcttaaagagctgtgggttattgatgagaagaaatggaagccaggctgtgttgaacacacagtgggttggcctttggatagacacacgtatggaggttcattcctttaccaccttaatgaaggagagcctcttgtagcgcttgggcttgtggttggattagattatcaaaatcctttcataaacccctttagagaactccagagatggaaacaccaccccagtgtagtgccaacccttgaaggtggaaacaggattgcctatggagctagagcattgaatgaaggaggctttcagtctttgccaaaactcaccttccctggtggtatacttgttgggtgtagtcctggattcatgaacgtgcctaaaattaaagggacacacacagctatgaagagcggcatgctggctgcagaaaacatctttaaaaaactgacagatgagagtatccagtcgaaaactcaaggacttgatgtaccagagtatgaagaaagcctgaagaagtcatggatttggaaggagttatactcagtgcgcaatattagaccttcttgccacgggcctttgggtttgtatggtggtatggtctatactggaatcttctactggatgctacgaggaaaggagccctggacattaaagcacaaaggtttggatagtaaccagttaaaacctgccaaggactgtgtaccaattgagtatccaaaaccagatggcaagttaagctttgacctcctatcatctgttgccctcagcggtactaatcatgaccatgaccagcctgcacatcttactctaaaggatgacagtttaccagtgaataaaaatctggcaatatatgatggaccagagcagaggttctgcccagctggagtatatgaatttgttccactggaatcaggagaaggatcccggttacaaattaatgcacagaactgtgttcactgcaaaacatgtgatattaaagatccaagtcagaatataaattgggttgtaccagaaggcggcggagggcccgcatacaatggcatgtaa

SEQ ID NO: 100416 - protein, 616 aa, Xenopus tropicalis
MLPLCKHTLHAHHCFAYFTALKNCLPSSCLKRWASSSVPRITTHYTICPRDQDKRWEGMNMERFAEEADVVIVGGGPAGLSAAIRLKQLAAECDKELRVCLVEKGAQIGAHTLSGACLEPRALEELFPDWKERGAPLNTPVTEDKFGILTKKHRIPVPILPGLPMNNHGNYIVRLGHFVSWLGEQAEALGVEIYPGYAASEVLFHEDGSVKGIATNDVGIHKDGSPKSTFERGLELHAKVTIFGEGCHGHLAKQLYNKFNLRQNCEPQTYAIGLKELWVIDEKKWKPGCVEHTVGWPLDRHTYGGSFLYHLNEGEPLVALGLVVGLDYQNPFINPFRELQRWKHHPSVVPTLEGGNRIAYGARALNEGGFQSLPKLTFPGGILVGCSPGFMNVPKIKGTHTAMKSGMLAAENIFKKLTDESIQSKTQGLDVPEYEESLKKSWIWKELYSVRNIRPSCHGPLGLYGGMVYTGIFYWMLRGKEPWTLKHKGLDSNQLKPAKDCVPIEYPKPDGKLSFDLLSSVALSGTNHDHDQPAHLTLKDDSLPVNKNLAIYDGPEQRFCPAGVYEFVPLESGEGSRLQINAQNCVHCKTCDIKDPSQNINWVVPEGGGGPAYNGM

SEQ ID NO: 100417 - DNA, 1434 bp, Gallus gallus
  CDS (1)..(1434)
atgttgttttcccgttgtccgttccccagccgagcacgtcaatgctttcatgctctaaagtccataaagagagactgccttccctcactgcataaagcaggatgggcatccactgccactgtgcctcgcataaccacgcattataccattcatcctcgggacaaagacaaacgatgggaaggggtaaacatggaaagatttgcagaggaagctgatgttgtcattgttggaggaggccctgcaggtctttctgctgctattcgtctcaaacagttagcagctgagcagggcaaagaaatacgtgtctgtctggtggaaaaggcatctcagattggtgcacataccctgtctggtgcttgtcttgagccacgatccttagaagaactctttccagactggaaggagcggggggctccacttcatactcctgtaactgaagacaagtttggaattttaacaaagaaatatagaattccagtaccaattctgccaggacttccaatggttaatcatgggaattacatagtacgtctgggacactttgtgagatggttgggtgaacaagcagaagctttgggtgtggagttgtatccaggctatgcagctgctgaggttctttttcatgaagatggtagtgtgaaaggaatagcaactaacgatgtaggcattcaaaaggatggagcacctaaagctacttttgaacgaggcttggaactccatgctaaggtcactgtctttgctgaaggctgtcatggacatctagctaaacaactgtacgcaaaatacaacctaagggagaaatgccaagcccagagctatggcattgggttgaaagagttatggactattgatgaaaagaaatggaaaccaggaagagtagaacacactgtaggctggcctttagacagacacacctatggaggatcctttctttatcacttaaatgagggtgaacctttagttgctcttggatttgtggttggcttagattatcaaaatccctatttgaatccgtttagggagtttcagaggtggaagcaccatcctactatagcacctactttggagggtggaaaaaggattgcgtatggtgccagagcactgaatgaaggtggtctccagtcaatacccaagctcaccttcccaggtggactgctaattggttgcagtcctggactcatgaatgtgcctaagattaaagggacacatactgcaatgaaaagtggcatgttggcttcagaagccatctttaaccaattaaccaatgaaaatctccagtcaaagactataggacttgatgtgcaagaatatgaagagaacctgaaaaagtcctgggtctggaaagagctgtactcggttagaaacatccgaccatcctgccatagcatgcttggtgtgtatggaggaatgatttacacgggtatattttattga

SEQ ID NO: 100418 - protein, 477 aa, Gallus gallus
MLFSRCPFPSRARQCFHALKSIKRDCLPSLHKAGWASTATVPRITTHYTIHPRDKDKRWEGVNMERFAEEADVVIVGGGPAGLSAAIRLKQLAAEQGKEIRVCLVEKASQIGAHTLSGACLEPRSLEELFPDWKERGAPLHTPVTEDKFGILTKKYRIPVPILPGLPMVNHGNYIVRLGHFVRWLGEQAEALGVELYPGYAAAEVLFHEDGSVKGIATNDVGIQKDGAPKATFERGLELHAKVTVFAEGCHGHLAKQLYAKYNLREKCQAQSYGIGLKELWTIDEKKWKPGRVEHTVGWPLDRHTYGGSFLYHLNEGEPLVALGFVVGLDYQNPYLNPFREFQRWKHHPTIAPTLEGGKRIAYGARALNEGGLQSIPKLTFPGGLLIGCSPGLMNVPKIKGTHTAMKSGMLASEAIFNQLTNENLQSKTIGLDVQEYEENLKKSWVWKELYSVRNIRPSCHSMLGVYGGMIYTGIFY

SEQ ID NO: 100419 - DNA, 1851 bp, Mus musculus
  CDS (1)..(1851)
atgttggtgcgactaaccaagctgtcctgccctgcgtatcactggtttcatgccttaaaaattaagaagtgcctacctctgtgtgctccaagatgttcttcaacctctgctgtacctcagattaccactcactacactgttcatccccgggagaaagacaaaagatgggaaggagtgaatatggagaggtttgcagaagaagcagatgtggtcatagttggtgccggcccagcaggactctctgcagctattcggctaaagcagctggctgctgaacaggggaaggacatccgtgtgtgtctggtggagaaagctgctcagatcggagcacacacgctctcaggggcttgtcttgatccagctgccttcaaagagctcttcccagactggaaggagaaaggggctccacttaatactcctgtaacagaagacaggtttgccattttaacagagaaacacagaattcctgtgccaattcttccaggtcttccgatgaacaatcatggcaattacatcgtacgcctaggacatctggtgagctggatgggagaacaggcagaggctcttggagtcgaagtgtatcctgggtatgctgctgctgaggtcctttatcatgaagatggtagtgtaaaaggaatcgccactaatgatgtaggcatacaaaaggatggtgcaccaaagacaacatttgagagaggactggaactgcatgccaaagtcacagtctttgcagagggttgccatggacacctagccaagcagctttataagaaatttgatctgagggccagctgtgatgcacagacttacggaattggtttgaaggagttatggattattgatgaaaagaagtggaaacctggaagagtagatcacactgttggttggcccttggacagacatacttatggaggctctttcctttaccacttaaatgaaggtgaacctctagtagctgttggctttgtggttggcctcgactatcagaatccgtacctgagtccattccgagagttccagaggtgtaagcatcatcccagcatccagccaaccctggaaggcgggaagaggatagcctacggagcccgagcgctcaatgaaggcggcttgcagtccataccaaaactcacttttcctggtggcttactaattggttgtagtcctggtttcatgaatgtccccaagatcaaaggtacccacacggcaatgaaaagtggaagtttggcagcagaatcaatttttaagcaactaactagtgaaaatctccagtcaaagacaacaggactccatgtaactgaatatgaggacaatttgaagcaatcctgggtatggaaagagctacacgctgttcgaaatataaggccatcttgccacgggatactgggagtatatggagggatgatttacactgggatattttactggatattgagaggaatggagccatggactctaaaacataaaggctcagactctgatcagctcaaaccagccaaggattgtacacccattgagtatccgaaacctgatggacagatcagttttgacctcttatcctctgtggctttgagtggtactaatcatgaacatgaccagccagcacatttaaccttaaaggatgacagcatacctgttaatagaaacctgtcaatatacgatgggcctgagcagcgattctgccctgcaggagtttatgaatttgttcctttggaacaaggtgatggatttcgattacagataaatgctcagaactgtgtgcactgtaaaacatgtgatatcaaagacccaagtcaaaatattaactgggtggtcccagaaggaggaggagggcctgcttacaatggcatgtaa

SEQ ID NO: 100420 - protein, 616 aa, Mus musculus
MLVRLTKLSCPAYHWFHALKIKKCLPLCAPRCSSTSAVPQITTHYTVHPREKDKRWEGVNMERFAEEADVVIVGAGPAGLSAAIRLKQLAAEQGKDIRVCLVEKAAQIGAHTLSGACLDPAAFKELFPDWKEKGAPLNTPVTEDRFAILTEKHRIPVPILPGLPMNNHGNYIVRLGHLVSWMGEQAEALGVEVYPGYAAAEVLYHEDGSVKGIATNDVGIQKDGAPKTTFERGLELHAKVTVFAEGCHGHLAKQLYKKFDLRASCDAQTYGIGLKELWIIDEKKWKPGRVDHTVGWPLDRHTYGGSFLYHLNEGEPLVAVGFVVGLDYQNPYLSPFREFQRCKHHPSIQPTLEGGKRIAYGARALNEGGLQSIPKLTFPGGLLIGCSPGFMNVPKIKGTHTAMKSGSLAAESIFKQLTSENLQSKTTGLHVTEYEDNLKQSWVWKELHAVRNIRPSCHGILGVYGGMIYTGIFYWILRGMEPWTLKHKGSDSDQLKPAKDCTPIEYPKPDGQISFDLLSSVALSGTNHEHDQPAHLTLKDDSIPVNRNLSIYDGPEQRFCPAGVYEFVPLEQGDGFRLQINAQNCVHCKTCDIKDPSQNINWVVPEGGGGPAYNGM

SEQ ID NO: 100421 - DNA, 1308 bp, Mesorhizobium loti MAFF303099
  CDS (1)..(1308): transl_table=11
atgatcgaggaagaattcgacgccatcgtcgtcggggccggtatgtccggaaacgcggccgcctacaccatggcaagccagggcctgacggtgctgcagttggagcgcggcgagtatccgggctccaagaatgtccagggcgccatcatgtacgccgacatgttggagcaaatcattccggatttccgggatgatgcgcctctcgagcggcatctggtcgagcagcgattctgggtgatggacgacacctcccacaccgggatgcagtatcgatcggacgatttcaacgaggcgaagcccaatcgctacacgatcatccgcgcccaattcgacaagtggttttcgcgcaaggtgcgccaggccggcgcgacggtgctgtgcgagacgacggtgaccgaacttatccgcaatgccagcggcaaggtgatcggcgtgcgcaccgaccgggctggcgggccgatctacgcggacgtcgtcgtgctcgcagaaggtgtcaacggactgctcggtacacgggccggcctgcgcaagatgccgaagccagaaagcgtggcgctcgctgtcaaggaaatgcatttcctacccgatgaggtcattgagcagcggttcggcctccagggcgacgaaggctgcgtgatcgaagcggcgggcacgatttcccgcagcatggccggactggccttcctctacaccaacaaggagtcgatctctctcggcatcggctgcctcgtctccgatttcgcccagacaatggagagcccttacgtcctcctcgacaacttcaaaaaccatccttcgatccggccgctgatcgcgggctcggaagtcaaggagtattccgcgcatctcattcccgaaggtggctacaaggcaattccgcagctcttcggcgacggttgggtggcggtcggtgatgccgcccaactgaacaacgctattcaccgcgagggttcgaaccttgccatgacttccggtcgcatcgcgggcgaggcaatcattgagatcaagggccgcaaccagccgatgatcaggaggaacctcgccctctacaagaccatgctggacaagtccttcgtagtcaaagacctgatgaaatataaggacatgccggccctgatacacaccaattcccgcaatttcttcatgacttacccgcagttgatgtcgcaggccgcgcagaacttcatgcgggtcgacggaaccccgaaaatcgagaaggaaaaggcgaccactgctgccttcatcaaggcgcgttcgcgctgggggctgatcagcgatgtggtccgcctggcactcgcctggcgctga

SEQ ID NO: 100422 - protein, 435 aa, Mesorhizobium loti MAFF303099
MIEEEFDAIVVGAGMSGNAAAYTMASQGLTVLQLERGEYPGSKNVQGAIMYADMLEQIIPDFRDDAPLERHLVEQRFWVMDDTSHTGMQYRSDDFNEAKPNRYTIIRAQFDKWFSRKVRQAGATVLCETTVTELIRNASGKVIGVRTDRAGGPIYADVVVLAEGVNGLLGTRAGLRKMPKPESVALAVKEMHFLPDEVIEQRFGLQGDEGCVIEAAGTISRSMAGLAFLYTNKESISLGIGCLVSDFAQTMESPYVLLDNFKNHPSIRPLIAGSEVKEYSAHLIPEGGYKAIPQLFGDGWVAVGDAAQLNNAIHREGSNLAMTSGRIAGEAIIEIKGRNQPMIRRNLALYKTMLDKSFVVKDLMKYKDMPALIHTNSRNFFMTYPQLMSQAAQNFMRVDGTPKIEKEKATTAAFIKARSRWGLISDVVRLALAWR

SEQ ID NO: 100423 - DNA, 1680 bp, Mesorhizobium loti MAFF303099
  CDS (1)..(1680): transl_table=11
atgagcgatatcgaacgcgaaagcatggaattcgacgtggtcatcgtcggtgcgggtccggccggccttgccgcggccatccgcctcaagcaggtcaatcccgagctttccgtcgtcgtgctggaaaagggcggcgaggtcggcgcccatatcctctctggcgccgtggtcgatccgatcggcatcgaccgtctgctgccgggttggcgcgaggaggaaggtcatcctttcaagacgccggtcactgcggatcatttcctggtgctcggccctgccggctcgtttcgcctgcccaacatattgatgccgccgctgatgaacaatcacggcaactacatcgtctcgctcggcaatgtctgccggtggctggccggcaaggccgaggcgctcggtgtcgagatctatccgggctttgccgccgcaggcctgctctacaatgaggaaggcgcagtcaccggcgtcgtcaccggcgacatgggcgtcgagaaggacggcacgcatgggccgggcttcgcgccgggcatggcgctgatgggcaaatatgtgctgatcggcgaaggcgcgcgcggctcgctcgccaagcagttgatcgccaaatacaaactttccgacggccgcgagccaggcaaatacggcatcggtctcaaggaactctggcaagtcaagccggagaaccaccggccgggcctggtccagcattccttcggctggccgctcgacatgaagaccggcggtggctccttcctctaccatctcgaggacaaccaggtggcggtcggcttcgtcctccacctcaattacaagaacccctatctgtcgcccttcgaggaattccagcgtttcaagacccatccggcaatcaggggcacgttcgagggcgccaagcggctcggctatggcgcgcgcgccatcaccgagggcggctggcagtcggtgccgaaactgtcgttccccggcggcgcgctgatgggttgcgctgccggcttcgtcaacgtgccgcgcatcaagggctcccacaatgccgtgctgtcgggcatgctggcggccgaacatgtcgccgaggctattggcgccggccgcgccaatgacgagctctcttcctacgagcaagcctggcgggcgaccgacatcggcaaggatttgaagaaggtgcgcaacgtcaagccgctgtggtcgcgcttcggcaccatcgtcggcgtcggtcttggtggcctcgacatgtggctgaacacgctgttcggcaactcgcccttcggcacgctgaagcacggcaaggccgactatgccacgctcgagcccgccgcccagcacaagaagatcgcctatccgaagcctgatggcgtgctgaccttcgaccgcctgtcctcggtgttcctgtccaacaccaatcacgaagagaacgagccggtccatctgctggtcgccgatatggaactgcagaagcgatccgaacacgatgtctttgccgggccttcgacccgctattgcccggccggcgtctatgaatgggtcgacaaggacggcaacaccgccgccgatccggcggcgcaagacgtccgcttcgtcatcaacgcgcagaactgcgtccactgcaagacttgcgatatcaaggatccgaaccagaacatcaactgggtgccgccgcaaggcggcgagggtccggtctaccagggcatgtga

SEQ ID NO: 100424 - protein, 559 aa, Mesorhizobium loti MAFF303099
MSDIERESMEFDVVIVGAGPAGLAAAIRLKQVNPELSVVVLEKGGEVGAHILSGAVVDPIGIDRLLPGWREEEGHPFKTPVTADHFLVLGPAGSFRLPNILMPPLMNNHGNYIVSLGNVCRWLAGKAEALGVEIYPGFAAAGLLYNEEGAVTGVVTGDMGVEKDGTHGPGFAPGMALMGKYVLIGEGARGSLAKQLIAKYKLSDGREPGKYGIGLKELWQVKPENHRPGLVQHSFGWPLDMKTGGGSFLYHLEDNQVAVGFVLHLNYKNPYLSPFEEFQRFKTHPAIRGTFEGAKRLGYGARAITEGGWQSVPKLSFPGGALMGCAAGFVNVPRIKGSHNAVLSGMLAAEHVAEAIGAGRANDELSSYEQAWRATDIGKDLKKVRNVKPLWSRFGTIVGVGLGGLDMWLNTLFGNSPFGTLKHGKADYATLEPAAQHKKIAYPKPDGVLTFDRLSSVFLSNTNHEENEPVHLLVADMELQKRSEHDVFAGPSTRYCPAGVYEWVDKDGNTAADPAAQDVRFVINAQNCVHCKTCDIKDPNQNINWVPPQGGEGPVYQGM

SEQ ID NO: 100425 - DNA, 1287 bp, Thermoplasma volcanium GSS1
  CDS (1)..(1287): transl_table=11
atgagtgaatttgacgttgcggtaataggtgcagggccggcaggatcttccgctgccataaggcttgcccaaaacgggatgaatgtcctacttgttgaacgtggtgaccctccaggaacaaagaacgtatcaggtgcagttctctggggcaatgaacttgctaaggttgtcccagattgggagaggagtgcaccagttgaaagatacgttacaagaaaagaagtagccttcctcacggaaaaatccaagattgctattagttttagctcagaggaactccagaatagtaagtctggaaagattattgtcagaggcaagtttgaccagtggcttgcaaaaaaggccaaggatgctggagcgatgcttgtaaccggcgttactgtagatagactcgccatcgacaatggaaaagtaatcggcatacagcaggacaatgacgtaattactgctgatgccgtagtggtagcagaaggggccaatcctagggtacttataaactcaggccttaggccgaaattatccgaccgtgatgttgcgctcggaataaaagaaacaattaaacttcccgaaaatgtcataaacgaaaggtttaacgtcgattcaaaaagcggatttgcatctgagttcgtgcttggtttcctcgatgacggattgctttctggcggttttctctatacaaataaagatacagtctcactcggtatagttgcttcattagatcgccttagggcaaatggagtgacacattcttacgatataatgggaaagttcgaagaacatcctttcataaagaaccttataaaagatggcataccggatgaatatgcggctcatcttgtacccgaaggtggaatttcgagcatgccaaaactctatggaaatggatatcttgtggccggtgatgccgcagcattcacattcagcaatggcatggtgctgcagggaataaattatgccattacatctggcatactagctgccgatacaataatagaaaacagaaataacataaatgaaaatacactggcaaagtacgttgataaactaagggaaagttacgtactcagcgatctctacaacttcaatggcatacagaacgtaacgtggagtgattttgtacaaaaaagcctccctacccttgcggaatcagttatgatgagcctcttcgatgaaaagggaatgccgaaaaagcatcttaggcagattgtcacagacgcaatgaagagcggccacatgaagtacagcgatctcattacaaatgggtaccgtgttataaagaggatgtga

SEQ ID NO: 100426 - protein, 428 aa, Thermoplasma volcanium GSS1
MSEFDVAVIGAGPAGSSAAIRLAQNGMNVLLVERGDPPGTKNVSGAVLWGNELAKVVPDWERSAPVERYVTRKEVAFLTEKSKIAISFSSEELQNSKSGKIIVRGKFDQWLAKKAKDAGAMLVTGVTVDRLAIDNGKVIGIQQDNDVITADAVVVAEGANPRVLINSGLRPKLSDRDVALGIKETIKLPENVINERFNVDSKSGFASEFVLGFLDDGLLSGGFLYTNKDTVSLGIVASLDRLRANGVTHSYDIMGKFEEHPFIKNLIKDGIPDEYAAHLVPEGGISSMPKLYGNGYLVAGDAAAFTFSNGMVLQGINYAITSGILAADTIIENRNNINENTLAKYVDKLRESYVLSDLYNFNGIQNVTWSDFVQKSLPTLAESVMMSLFDEKGMPKKHLRQIVTDAMKSGHMKYSDLITNGYRVIKRM

SEQ ID NO: 100427 - DNA, 1311 bp, Aeropyrum pernix K1
  CDS (1)..(1311): transl_table=11
atgtcttctgggattgccgaggcaagctatgatgttgtcgtggtgggcggcggccctggagggctcgccgccgccacagtcctggctagggccgggtttaaggtcctcgtcctcgagaggggtagggagccgggggcgaagagcctcttcggcgggaaggtttatgcccagccactcagggacgtttggcccgatctagacaagaaggctccgatacacaggtgggttagggtcgagaggttcagcctcacctcgggagaccgggtggcgactatagagtataggctgggcaggcctgtggctttcaccacatacttgcccgagctcgtcaagtggatggctgggaaggcggaggaggccggagcccttgttattgatgaggtcgttgttgacgacatagttgtcaaggacggcagtgttgtgggagttaggagcggcggggacgaggttagggcgaaagttgttgtggacgcggagggagtaaacaggatgctgcttgagaggctaggcctcgtagaccctccggacccatcgcggctagctctcggcgttaaagaggttataaggctgaagccagacgagatagaggcaaggttcggcctcgacaagaaggaggggctggcctggctcatagccggagatataaccaactggatccccggcgggggcttcgtgtacactatgaacgacagcgtcagcgtcggtatagttcttagggtgtcatcagccgttgaagctgctgagaagggggtgataagagagcatgttagccgtatggtggagaggctgaggctccacccctacttcaagaggttctggacgggcggggacattgcggagtacggggggaggcttgccattgaaggcggcctcggctacatgccccgaaaactggcgaccaacggcctggtggtagttggcgacgcggcagggctactactaaatacaggctacaccataagaggggtcgacttcgcggcctacagcggcaagctggcggcggaaacgataatacaagctttgtccaagggcgacacgagcgaggccacccttaggacctatgaggagaagctgaaagcaagcttcgtatacaaggagctagttaagcatagggggatagagaaggttatgagagacccttggttcttcaaggctctacccgagatcggcgtaggagttctggctcgccttttcgaggcggactacgaggagcccacgatagccgaggccctcctggaggccgcccgagaagcagggactccactccccctggcgatagcgaagctgctcggcgtggcaggcgagctgtag

SEQ ID NO: 100428 - protein, 436 aa, Aeropyrum pernix K1
MSSGIAEASYDVVVVGGGPGGLAAATVLARAGFKVLVLERGREPGAKSLFGGKVYAQPLRDVWPDLDKKAPIHRWVRVERFSLTSGDRVATIEYRLGRPVAFTTYLPELVKWMAGKAEEAGALVIDEVVVDDIVVKDGSVVGVRSGGDEVRAKVVVDAEGVNRMLLERLGLVDPPDPSRLALGVKEVIRLKPDEIEARFGLDKKEGLAWLIAGDITNWIPGGGFVYTMNDSVSVGIVLRVSSAVEAAEKGVIREHVSRMVERLRLHPYFKRFWTGGDIAEYGGRLAIEGGLGYMPRKLATNGLVVVGDAAGLLLNTGYTIRGVDFAAYSGKLAAETIIQALSKGDTSEATLRTYEEKLKASFVYKELVKHRGIEKVMRDPWFFKALPEIGVGVLARLFEADYEEPTIAEALLEAAREAGTPLPLAIAKLLGVAGEL

SEQ ID NO: 100429 - DNA, 1902 bp, Arabidopsis thaliana
  CDS (1)..(1902)
atgcatagattccttgtaaagctatcttcttcttcttcaccattctctaatcaattgagaagcttgaagaaccagcgtctgattctccctctattaccttcttcaaaaccttttacctcctcctctgtgtcaccacctccaagtcccttgaacgcttctaatcgatttgggtatccttattccgccgatttgtttcgaaatttgtcacctttaaacccaaattcgaggattttaggagtcaatgggattactagtagtagatgtatcagcagtgaagcggtcagagaatcgattgagtacgatgttctgattgtcggagctggaccggccggtttatctgctgctatacgattgaaacaactgtctcaggagaagaacattgatctatctgtttgtgtcgttgagaaaggagcagaagttggaggacacattatatctggaaatgtttttgaacccctggcacttgatgagcttcttccacattggagacaagaacatgcacccattgagatccctgcttcttctgataaattctggtttttgacgaaagatcgtgcattttcacttccttctccgtttgataacaagggaaactacgttattagtttgagccaactggtgcgttggctaggaggaaaagctgaggagcttggaacagagatatatcctggcttttctgctagtgaggtgttatttgatgcaagtgataaagttgttgggattgcaaccaaagatatgggaatatccaaagatggttccaagaaagagaatttccagccaggtgttgacataaaagggcgagttacactgtttgcagagggatgtagaggatcattgtcagagagaataatcaaaaagtataaattaagagaagaggttaatgcacaacatcaaacatatgctttgggaatcaaggaggtctgggagatagatgaaagcaaacataaccctggagaagttattcacacattgggttggcccttggatcccaagacatatggaggttctttcttgtaccacatgaacgatagacaggttgcacttggcttggttgttgccttgaactaccacaaccctttcttgaatccgtatgaggaatttcagaaactcaaacaccatcctgctattaaaggcatcttggaaggtggtaccgtgcttcagtatggagctcgtactttaaatgaaggtggttttcagtccattccctatccagtttttcctggaggagcaataattggatgttcagctggttttctcaatgtacccaagattaagggaacacacactgcaatgaaatcaggaatgttagcagcagaggctgcatttggtgcacttcatgaaggcttaaacatgaacacgtactgggacaacttgagggattcatgggtgtggaaggagctctacgcagctcgaaactatcgtcctgcattcgagtatgggctacttcctggcttggccattagtgctatggaacactatgtactgaaaggaaaagtccctttcacgctcaagcatgggaaagcagaccacgaagcaacagatcttgctcggaaatggacaccgattgtgtatccaaagccggatggtgttttgtcgtttgatgtgccaacttctttatacaggagtaataccaatcatgatcatgatcaaccatctcatttgcgcttgagggatcctaagattccagaaaaggtaaactttccagagtatgctgcgccagagtcacgttactgcccagcccgtgtttacgaatatatcgaagacgaagagggtaagccaaaactgcagatcaacgctcaaaactgtttgcactgcaaggcatgtgacatcaaagatccaaagcagaacatagagtggacagtgcctgaaggtggtggaggccctgcctattccctcatgtag

SEQ ID NO: 100430 - protein, 633 aa, Arabidopsis thaliana
MHRFLVKLSSSSSPFSNQLRSLKNQRLILPLLPSSKPFTSSSVSPPPSPLNASNRFGYPYSADLFRNLSPLNPNSRILGVNGITSSRCISSEAVRESIEYDVLIVGAGPAGLSAAIRLKQLSQEKNIDLSVCVVEKGAEVGGHIISGNVFEPLALDELLPHWRQEHAPIEIPASSDKFWFLTKDRAFSLPSPFDNKGNYVISLSQLVRWLGGKAEELGTEIYPGFSASEVLFDASDKVVGIATKDMGISKDGSKKENFQPGVDIKGRVTLFAEGCRGSLSERIIKKYKLREEVNAQHQTYALGIKEVWEIDESKHNPGEVIHTLGWPLDPKTYGGSFLYHMNDRQVALGLVVALNYHNPFLNPYEEFQKLKHHPAIKGILEGGTVLQYGARTLNEGGFQSIPYPVFPGGAIIGCSAGFLNVPKIKGTHTAMKSGMLAAEAAFGALHEGLNMNTYWDNLRDSWVWKELYAARNYRPAFEYGLLPGLAISAMEHYVLKGKVPFTLKHGKADHEATDLARKWTPIVYPKPDGVLSFDVPTSLYRSNTNHDHDQPSHLRLRDPKIPEKVNFPEYAAPESRYCPARVYEYIEDEEGKPKLQINAQNCLHCKACDIKDPKQNIEWTVPEGGGGPAYSLM

SEQ ID NO: 100431 - DNA, 1317 bp, Thermotoga maritima MSB8
  CDS (1)..(1317): transl_table=11
atgaagatagaattcgacgttgtcgtcgttggtgctggcccttctggtctgtcctgcgcatacgttcttgccaagaatggtctcaaagttgcggtcgtggagaaaggagaatatccgggttccaaaaacgtgatgggaggggttctctacgtacatcctctgaaagagatcatgccagattttctggaaaaagcggcaaattcgaaagctcttgaaagaaacgttatagagcagaacctttggctcctcggaaatgaaggtgtcatcaagatcggtcacagaaacgtggaatggaaagaaaatccgaatgcattcactgttttgagggcaaactttgacagatggtttgcccaggaggtggaaaaagcaggtgccctgatcataccaaaaaccaaggtggaagacttcctgaggaacgaaaaaggagaaatagcaggcgtggtgacctcgagaccaaagggagaaatacacagcaaggcggttgtgatcgcggagggtgtgaatcccatcctcacgatgaaagctgggctcaggaaggaagatctgaaaccacacatggtggccgttgctgtgaaagaggtgatcagtgttcctgaagatgtggtgaacagggtcttcggtgtggagggaaacgatggagcaacgatagaacttcttggaagctggtctgaaggtatgttcggaatgggatttctttacgccaacagatcttccgtatctctgggttgtggggttctccttgaagatctcagaaaaaagaagatcaagccgtatcaacttcttgagaatttgaaaaatcaccctgtcatttccgatatgctgggagaatacagaaacaacacgatggagtatctggcacatttgatacctgaaggtggatactacgcgatgccgaaggtctatggagacagggttctggtctgtggagatgcggcaatgcttgtgaactctatacatagagaaggatcgaatcacgcgatcacatcgggaagactcgctgctgaaacacttctcgaagcttttgaaaagggagatttttctgaaaaaattctgaaaaattactacctcagattgaaagaatccttcatattgaaagacctggaaaagtacaaagatctcatgcccactatggaaaagaaccaccagttcgtggaaatctatccggatcttgcaaacgatgctttgaagagatttctacaggttgacggaactccaaagtgggacgttcaaaaacagatcgcggacatggtactttccaggagaagtttgattggaatctcccttgatctgctcagattctggagagctgtgaggtga

SEQ ID NO: 100432 - protein, 438 aa, Thermotoga maritima MSB8
MKIEFDVVVVGAGPSGLSCAYVLAKNGLKVAVVEKGEYPGSKNVMGGVLYVHPLKEIMPDFLEKAANSKALERNVIEQNLWLLGNEGVIKIGHRNVEWKENPNAFTVLRANFDRWFAQEVEKAGALIIPKTKVEDFLRNEKGEIAGVVTSRPKGEIHSKAVVIAEGVNPILTMKAGLRKEDLKPHMVAVAVKEVISVPEDVVNRVFGVEGNDGATIELLGSWSEGMFGMGFLYANRSSVSLGCGVLLEDLRKKKIKPYQLLENLKNHPVISDMLGEYRNNTMEYLAHLIPEGGYYAMPKVYGDRVLVCGDAAMLVNSIHREGSNHAITSGRLAAETLLEAFEKGDFSEKILKNYYLRLKESFILKDLEKYKDLMPTMEKNHQFVEIYPDLANDALKRFLQVDGTPKWDVQKQIADMVLSRRSLIGISLDLLRFWRAVR

SEQ ID NO: 100433 - DNA, 1656 bp, Pseudomonas aeruginosa PAO1
  CDS (1)..(1656): transl_table=11
gtggaacgcgaatacatggaattcgacgtcgtcatcgtcggcgccggccccgccggtctgtccgccgcatgccgactgaagcagaaggccgccgaagccggtcaagagatcagcgtctgcgtggtcgagaagggttccgaagtgggcgcccacatcctctccggcgcggtgttcgagccgcgcgcgctgaacgagctgttccccgactggaaggaactcggcgcgccgctcaataccccggtgaccggcgacgacatctacgtcctgaagagcgccgagagcgctaccaaggtgcccaacttcttcgtgcccaagaccatgcacaacgagggcaactatatcatctccctgggcaacctctgccgctggctggcccagcaggccgaaggactgggcgtggagatctatccgggcttcgccgcccaggaagcgctgatcgacgagaacggcgtggtccgcggcatcgtcaccggcgacctcggcgtcgaccgcgaaggcaacccgaaagaaggctactacacccccggcatggagctgcgggccaagtacaccctgttcgccgaaggctgccgcgggcacatcggcaagcaactgatcaagaaatacaacctggacagcgaggccgatgcccagcactacggtatcggcatcaaggaaatctgggacatcgacccgtccaagcacaagcccggcctggtggtccataccgccggctggccgctgaacgacgaaaataccggcggctcgttcctctaccacctggagaacaaccaggtgttcgtcggcctgatcatcgacctgtcctacagcaacccgcacctgtcgccgttcgacgagttccagcgctacaagcaccacccggtggtcaagcagtacctggaaggcggcaagcgcgtggcctacggcgcccgggccatctgcaagggcggcctgaattcgctgccgaagatggtcttccccggcggcgcgctgatcggttgcgacctcggcaccctgaacttcgccaagatcaagggcagccacaccgcgatgaagtccggcatgctcgccgccgacgcgatcgccgaggccctggccgccggccgcgaaggcggcgacgagctgtccagctacgtcgatgcgttcaaggccagctggttgtacgacgaactgttccgcagccgcaacttcggcgcggccatccacaagttcggcgctatcggcggcggcgcgttcaacttcatcgaccagaacatcttcggcggcaagatccccgtcaccctgcatgacgacaagccggactacgcctgcctgaaaaaggccagcgaagcgccgaagatcgactacccgaagccggacggcaagctcagcttcgacaagctgtcctcggtgttcctctccaataccaaccacgaggaagaccagccgatccacctcaagctggccgatgcgagcattccgatcgagaagaacctgccgctctacgacgagccggcccagcgctactgcccggcaggcgtgtacgaagtggtggccaacgacgacggcagcaagcgcttccagatcaacgcgcagaactgcgtgcactgcaagacctgcgacatcaaggacccggcgcagaacatcacctgggtggcgccggaaggtaccggcgggccgaactaccccaacatgtaa

SEQ ID NO: 100434 - protein, 551 aa, Pseudomonas aeruginosa PAO1
MEREYMEFDVVIVGAGPAGLSAACRLKQKAAEAGQEISVCVVEKGSEVGAHILSGAVFEPRALNELFPDWKELGAPLNTPVTGDDIYVLKSAESATKVPNFFVPKTMHNEGNYIISLGNLCRWLAQQAEGLGVEIYPGFAAQEALIDENGVVRGIVTGDLGVDREGNPKEGYYTPGMELRAKYTLFAEGCRGHIGKQLIKKYNLDSEADAQHYGIGIKEIWDIDPSKHKPGLVVHTAGWPLNDENTGGSFLYHLENNQVFVGLIIDLSYSNPHLSPFDEFQRYKHHPVVKQYLEGGKRVAYGARAICKGGLNSLPKMVFPGGALIGCDLGTLNFAKIKGSHTAMKSGMLAADAIAEALAAGREGGDELSSYVDAFKASWLYDELFRSRNFGAAIHKFGAIGGGAFNFIDQNIFGGKIPVTLHDDKPDYACLKKASEAPKIDYPKPDGKLSFDKLSSVFLSNTNHEEDQPIHLKLADASIPIEKNLPLYDEPAQRYCPAGVYEVVANDDGSKRFQINAQNCVHCKTCDIKDPAQNITWVAPEGTGGPNYPNM

SEQ ID NO: 100435 - DNA, 1662 bp, Neisseria meningitidis MC58
  CDS (1)..(1662): transl_table=11
atgacagaatccatcacccgcgacagtatgcaatacgatgtcgtgattgtcggcgcaggcccgtcgggtttgtctgccgccatcaaactcaagcagcttgccgaacaaaacgggcgcgaaatcagcgtttgcgtggtggagaaaggttcggaggtgggggcgcattcgctggctggcgcagttatcgatccgattgcgctgaatgagttgatttccgactggaaagaaaaaggcgcaccgctgacacgcacagtaacgcaggacaaagtgttgttcctgaccgagaaaaaagcgttcaacctgccgattaccccgaatttcgacaatcacggcaactacatcgtcagcttgggcgaagtcgtgcgctggttggcggagcaggcggaaaatatgggcgtggaaatctatccgggctttgccgccgccgaagtgctgtatcacgaagacggttcggtcaaaggcattgcaaccggcaatatgggcattggcaaagacggcgagccgaccgattcattccaacccggcatggagctttgggcgcagcaaaccctgtttgccgaaggttgtcgcggttcgctttccaaacaaatcatcgaacgtttccaactcgaccaaaacagccagccgcaaacttacggcttgggcattaaagaagtttgggaagtgccgtccgaacagcatcagcccggtttggtggtgcacagcgcaggctggccgctggacagcaaaacctacggcggcgcgtttgtttaccatttcgacgacaacaaagtcgccgtcggcttcgtggtcggtttggactatcaaaatccttatctgtcgccgtttgaagagttccaacgtttcaaaacccatcccgaaatccgcaaaacctttgaaggcggccgccgcattgcttacggcgcgcgttcgctgattgaaggcggtttgcaaagtttgccgaagctctcgttcaaaggcggcattttggtcggcgatgcggcgggtttcctcaatatgccgcgcatcaaaggcattcataccgcgatgaaatccgccatgctcgccgccgaagccgtgttccccttgttggaaaaccttgaagaagtggagggtttcgacagcggcaaagaggcggcggattatcagcaacgttttgaacaaagctggctgtatcaagagctttacgccgcgcgcaatgtccgtccgtcattcaaatggggcgtttacctcggctcaatctacaccggcatcgatcagatgattttcagaggcaaagccccgtggaccttgaaacatcacggcaaagacaacgagcagcttaaaaaagccgccgcgtgtaagccgattgattatccgaaacccgacggcgtgttgaccttcgaccgcttgagcagcgtcttccttgccaatctcgcgcacgaagaaaaccagcccgaccatttggtgctgaacaatccgcaaacgatgatagacgtgaactacaaagaatacgcctcgcccgaaacgcgctattgtccggccggcgtgtacgaaattgttgaagaaaacggcaatccgcgcctgcaaatcaacgcggcaaactgcgtgcactgcaaaacctgcgacatcaaagacccgacgcaaaacatcacttggatttgccccgaaggcgcgagcgggccgaattacggcgggatgtga

SEQ ID NO: 100436 - protein, 553 aa, Neisseria meningitidis MC58
MTESITRDSMQYDVVIVGAGPSGLSAAIKLKQLAEQNGREISVCVVEKGSEVGAHSLAGAVIDPIALNELISDWKEKGAPLTRTVTQDKVLFLTEKKAFNLPITPNFDNHGNYIVSLGEVVRWLAEQAENMGVEIYPGFAAAEVLYHEDGSVKGIATGNMGIGKDGEPTDSFQPGMELWAQQTLFAEGCRGSLSKQIIERFQLDQNSQPQTYGLGIKEVWEVPSEQHQPGLVVHSAGWPLDSKTYGGAFVYHFDDNKVAVGFVVGLDYQNPYLSPFEEFQRFKTHPEIRKTFEGGRRIAYGARSLIEGGLQSLPKLSFKGGILVGDAAGFLNMPRIKGIHTAMKSAMLAAEAVFPLLENLEEVEGFDSGKEAADYQQRFEQSWLYQELYAARNVRPSFKWGVYLGSIYTGIDQMIFRGKAPWTLKHHGKDNEQLKKAAACKPIDYPKPDGVLTFDRLSSVFLANLAHEENQPDHLVLNNPQTMIDVNYKEYASPETRYCPAGVYEIVEENGNPRLQINAANCVHCKTCDIKDPTQNITWICPEGASGPNYGGM

SEQ ID NO: 100437 - DNA, 1758 bp, Neisseria meningitidis Z2491
  CDS (1)..(1758): transl_table=11
atggttttcagacgacctttgttgtatttggtaactatatgttcccgttgtataattacggatttgcaattcaataataaatacacaggaaccgccatgacagaatccatcacccgcgacagtatgcaatacgatgtcgtgattgtcggcgcaggcccgtcgggtttgtccgccgccatcaaactcaagcagcttgccgaaaaaaacgggcgcgaaatcagcgtttgcgtggtggagaaaggttcggaggcgggcgcgcattcgctggcgggcgcggtcattgacccgattgcgctgaatgagttgattcccgactggaaagaaaaaggcgcgccgctgacgcgcacggtaacgcaggacaaggtgttgttcctgacggagaaaaaagcgttcaatctgcccattacccccaatttcgacaatcacggcaactacatcgtcagcttgggcgaagtcgtgcgctggttggcggagcaggcggaaaatatgggcgtggaaatctatcctggctttgccgctgccgaagtgctgtatcacgaagacggttcggtcaaaggcattgcgaccggcaatatgggcgtgggcaaaaacggcgagccgaccgattcattccagcccggcatggagctttgggcacagcaaaccctgtttgccgaaggttgccgaggttcgctttccaagcaaatcatcgaacgcttcaaactcgaccaaaacagccagccgcaaacttacggcttgggcattaaagaagtttgggaagtgccgtccgaacagcatcagcccggtttggtgatgcacagcgcaggctggccgctggacagcaaaacctacggcggcgcgtttgtttaccatttcgacgacaacaaagtcgccgtcggcttcgtggtcggtttggactatcaaaatccttatctgtcgccgtttgaagagttccaacgtttcaaaacccatcccgaaatccgcaaaacctttgaaggcggccgccgcatcgcttacggcgcgcgttcgctgattgaaggcggtttgcaaagtttgccgaagctctcgttcaaaggcggcgttttggtcggcgatgcggcgggtttcctcaatatgccgcgcatcaaaggcattcataccgcgatgaaatccgccatgctcgccgccgaagccgtgttccccttgttggaaaaccttgaagaagtggaaaacttcgacagcggcaaagaggcggcggattatcagcaacgttttgaacaaagctggctgtatcaagagctttacgccgcgcgcaatgtccgtccgtcattcaaatggggcgtttacctcggctcgctttataccggtatcgaccagatgattttcagaggcaaagccccgtggaccttgaaacatcacggtaaagacaacgagcagctcaaaaaagctgccgcgtgcacaccgattgattatccgaaacccgacggcgtgttgaccttcgaccgcttgagcagcgtcttccttgccaatcttgcgcacgaagaaaaccagcccgaccatttggtgctgaacaatccgcaaacgatgatagacgtgaactacaaagaatacgcctcgcccgaaacgcgctattgtccggcgggtgtgtatgaaatcgtcgaagaaaacggcagcccgcgcctgcaaatcaacgcggcaaactgcgtgcactgcaaaacctgcgacatcaaagacccgacgcaaaacatcacttggatttgtcccgaaggcgcgagcgggccgaattacggcgggatgtga

SEQ ID NO: 100438 - protein, 585 aa, Neisseria meningitidis Z2491
MVFRRPLLYLVTICSRCIITDLQFNNKYTGTAMTESITRDSMQYDVVIVGAGPSGLSAAIKLKQLAEKNGREISVCVVEKGSEAGAHSLAGAVIDPIALNELIPDWKEKGAPLTRTVTQDKVLFLTEKKAFNLPITPNFDNHGNYIVSLGEVVRWLAEQAENMGVEIYPGFAAAEVLYHEDGSVKGIATGNMGVGKNGEPTDSFQPGMELWAQQTLFAEGCRGSLSKQIIERFKLDQNSQPQTYGLGIKEVWEVPSEQHQPGLVMHSAGWPLDSKTYGGAFVYHFDDNKVAVGFVVGLDYQNPYLSPFEEFQRFKTHPEIRKTFEGGRRIAYGARSLIEGGLQSLPKLSFKGGVLVGDAAGFLNMPRIKGIHTAMKSAMLAAEAVFPLLENLEEVENFDSGKEAADYQQRFEQSWLYQELYAARNVRPSFKWGVYLGSLYTGIDQMIFRGKAPWTLKHHGKDNEQLKKAAACTPIDYPKPDGVLTFDRLSSVFLANLAHEENQPDHLVLNNPQTMIDVNYKEYASPETRYCPAGVYEIVEENGSPRLQINAANCVHCKTCDIKDPTQNITWICPEGASGPNYGGM

SEQ ID NO: 100439 - DNA, 1302 bp, Escherichia coli O157:H7 EDL933
  CDS (1)..(1302): transl_table=11
gtgttgtgttcaggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctccctcaatttcatctgaccgcgcctcttgaacgacgcatcactcacgaaagcctttccctgttaacgccggattgcgcaacgacgttttccagcttacagcccggcggtgaatcctggagtgtattacgtgcacggttcgatccgtggctggttgccgaagccgaaaaagaaggtgtcgaatgcatccctggtgcgacggtggatgcactgtatgaagaaaacggcagggtgtgtggtgtcatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcggaatctgtgatgacttacccggcggcgcatttctttatactaatcaacaaacgctctcgttagggattgtttgcccactctcttcccttacgcaaagtcgtgttccggcaagcgagctgcttgctcgctttaaaacgcatccggcagtgcgcccgcttatcaaaaacacggaatcactggagtatggtgcgcatctggtgccagaaggtggcttgcacagtatgccggtacaatacgccggtaacggctggctgctggtgggcgatgcgttgcgcagttgcgtcaataccggaatttctgtgcgcggcatggatacggcgctaactggcgcgcaggcggcggcacaaacactgataagcgcctgccagcaccgcgagccgcaaaatctgtttccgctttatcatcacaacgtagagcgcagcctgctgtgggatgttctacagcgttatcagcatgttccggtgcttttgcaacgcccgggatggtaccgtacgtggcctgcgttaatgcaggatatttcccgcgatttatgggatcagggtgataaacctgttccaccgctgcgccagttactctggcgtcatttacgtcgtcatggcttgtggaatctggcgggcgatgttatcaggagtgttcgatgtctgtag

SEQ ID NO: 100440 - protein, 433 aa, Escherichia coli O157:H7 EDL933
MLCSGYLGHDMEDDCDIIIIGAGIAGTACALRCARAGLSVLLLERAEIPGSKNLSGGRLYTHALAELLPQFHLTAPLERRITHESLSLLTPDCATTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGGICDDLPGGAFLYTNQQTLSLGIVCPLSSLTQSRVPASELLARFKTHPAVRPLIKNTESLEYGAHLVPEGGLHSMPVQYAGNGWLLVGDALRSCVNTGISVRGMDTALTGAQAAAQTLISACQHREPQNLFPLYHHNVERSLLWDVLQRYQHVPVLLQRPGWYRTWPALMQDISRDLWDQGDKPVPPLRQLLWRHLRRHGLWNLAGDVIRSVRCL

SEQ ID NO: 100441 - DNA, 1647 bp, Xylella fastidiosa 9a5c
  CDS (1)..(1647): transl_table=11
atgttggcagcggagcaggagacagaaacaaacaccatcgaacgtgacgtcatggaatatgacattgtcaccgtcggcgctggcccagcaggcttagcttttgcaatccgcctgaaacaactcaaccctgaactatcggtatgcgtgatcgaaaaatccagcacaatcggcgcacatattctctctggcgcagtgatcgaacctgcccccctggatagcctactccctggctggcgcaacgccccacctccaatctgcgtccctgcaaccgaggatgaattctggctcctgagcaaaaatggcgcacacaaatttccgatcatgccgccgagcttgcgcaaccacggtaacgtgatcgtcagccttggtgcactatgcgcctggttagcacctcaggccgaggcattgggcgtagacatttacccaggcttctccgccactgaaaccctgcacgacgcggctggccaagtcattggagtacgcattggcgacatgggtatcgccaaaaacggaacacacaaacctagcttcaccccaggcattgcaatcaatgccaaagtcaccgtactcgccgaaggcgcacgcggccacctgaccaaacacttgattaaacatttctcactagatcaaaacagtgatccgcaaacctactccatcggaatcaaagaactatggcacgtcccagaaaaacgtagctctccaggcaaaatcttacataccctcggctggccagccgatacacatacctacggaggcggcttcctctatcacctgaatgacaatcgcatcgcactcggttatgtcagcggcctggactatcacgacccaaagtacgaaccctgggaagcatttcagcaatggaaaaatcacccactcatcaaactgcttctagaaggtggtgacatcctatcgggtggcgcacgtgcgatcgtcaccggcggctggcaatccctccccaaagtggacatgccaggcgcactgttgatcggtgacactgccggcttactcaacgtccccaagatcaaaggaacacaccaagcaattcgcagcggcatgctcgctgccgaacatctcgtcgccacccaactcaccccctatggatttgatgccaaactgcgtgcttccaaggcaatgaccgaattaaaacaagtacgcaacatcaagccaggtttcaaaaaaggcttatggttgggcctactgaacgccgcctgggagaccgctacccgtggcgtttctccatggacattgaaaaacacaccagactgggccgcactgcaacggctcgacaaagaccaacaaacaaaacacgactacgtgcaacgcaccttgccaccacgcgaccgcctgcatagcgtctacttcgcggccactgtgcacaatgaagaccaacccatccacctaaaaatcaccgaccccgaacgatgcgtcactcgctgcgtagaggaatacggcaatccatgcacccgcttctgtccagccaacgtctaccaaatcattgaggaccccagctcagcaaccaacaaacgcttacacatcaatgcagccaactgcgtgcactgtaaaacctgtgacatcaaagatccgtaccagattatcgactggatcaccccagaaggcggatcaggcccaaactatcaaaacctataa

SEQ ID NO: 100442 - protein, 548 aa, Xylella fastidiosa 9a5c
MLAAEQETETNTIERDVMEYDIVTVGAGPAGLAFAIRLKQLNPELSVCVIEKSSTIGAHILSGAVIEPAPLDSLLPGWRNAPPPICVPATEDEFWLLSKNGAHKFPIMPPSLRNHGNVIVSLGALCAWLAPQAEALGVDIYPGFSATETLHDAAGQVIGVRIGDMGIAKNGTHKPSFTPGIAINAKVTVLAEGARGHLTKHLIKHFSLDQNSDPQTYSIGIKELWHVPEKRSSPGKILHTLGWPADTHTYGGGFLYHLNDNRIALGYVSGLDYHDPKYEPWEAFQQWKNHPLIKLLLEGGDILSGGARAIVTGGWQSLPKVDMPGALLIGDTAGLLNVPKIKGTHQAIRSGMLAAEHLVATQLTPYGFDAKLRASKAMTELKQVRNIKPGFKKGLWLGLLNAAWETATRGVSPWTLKNTPDWAALQRLDKDQQTKHDYVQRTLPPRDRLHSVYFAATVHNEDQPIHLKITDPERCVTRCVEEYGNPCTRFCPANVYQIIEDPSSATNKRLHINAANCVHCKTCDIKDPYQIIDWITPEGGSGPNYQNL

SEQ ID NO: 100443 - DNA, 1224 bp, Sulfolobus solfataricus P2
  CDS (1)..(1224): transl_table=11
gtgagcttcgacgctgatgttataatagtaggtggaggactagctgggctttccgctgctattactgcaaacagagagggattatcaactattgtattagaaagaggagaatattctggaagtaagaacgtttctggaggaagaatgtacactcacgcattattacaattatttcccgatgcactggagagagcaccattagagagaccggtaactaatgaaacttacgagatctattgtgaagaagaaaaaaagattactttttcgttccggcataaaactagaaatagctatactgtattgagggctaaatttgaccaatggctagctaaagaggctgaaaatgagggagttttaatatcttattcaacactggttactaatgctaggcgggaaaacgattatgtggtaatagagactaatagaggtgaacttaaggcacctttagttatagatgctggtggaattacagctccagtctccagattcttaggagttaaaaaattagagcccaagacgttaatgttaggagttaaagaggtattagacattaaacccgatatggatgatgatgagggtgaggctagaaccatagtgggattgataggaaatttgaaaggaggaggtttcgtttacactaataaagatacattatccgtaggcgttacgataaaagttgagtcgttatataattctaatataccttcgcatgaaattgtagagagatttagagagtcgttgggcttaagcgggagtatcctagaatactctgcacacttgattccatattacggttatgataagataggtaaaatctacgataagaatttaattttagtaggcgatgcagctggatttctaataaacgacggattcaacattagaggaatggatttagcaatgggctctggaattattgctggaaagtcagctaagaagattaaggagcttaacgattatagtagaactgatatctattacgagatgctcaaagaatctttcgtactaaaggatatgaagaccgccttaaggtcttttagcgtattaaatgaggaggagattttcactaaatatcctaaggtcatttgtaatgtgctgggccaattgtttacagtaacaagtgatggaaaggagaggcctataaacgtcttaattaaagaaagtaaaagcgaaaacgtaaatactacgaaaatgctaactgatatcatgaggttatttatatga

SEQ ID NO: 100444 - protein, 407 aa, Sulfolobus solfataricus P2
MSFDADVIIVGGGLAGLSAAITANREGLSTIVLERGEYSGSKNVSGGRMYTHALLQLFPDALERAPLERPVTNETYEIYCEEEKKITFSFRHKTRNSYTVLRAKFDQWLAKEAENEGVLISYSTLVTNARRENDYVVIETNRGELKAPLVIDAGGITAPVSRFLGVKKLEPKTLMLGVKEVLDIKPDMDDDEGEARTIVGLIGNLKGGGFVYTNKDTLSVGVTIKVESLYNSNIPSHEIVERFRESLGLSGSILEYSAHLIPYYGYDKIGKIYDKNLILVGDAAGFLINDGFNIRGMDLAMGSGIIAGKSAKKIKELNDYSRTDIYYEMLKESFVLKDMKTALRSFSVLNEEEIFTKYPKVICNVLGQLFTVTSDGKERPINVLIKESKSENVNTTKMLTDIMRLFI

SEQ ID NO: 100445 - DNA, 1188 bp, Sulfolobus solfataricus P2
  CDS (1)..(1188): transl_table=11
atgaaattcgatattgttgtagttggagctggacccgctggttcatctgcagctataactgcagctagagggggagctaaagtcctattattagaaaggggtccagagccaggttccaagaacgtttctggagcaatgataaggttagaggatttctcttcagtttatgacatagcttctattccaatagagagaaaagtaaagaatgttgatttgatcttactaagtgactcaaatagaacaagaataagtgtaaatgttgaatcaaatttagcaactgtcgcaaggttgaaactagataaatggatggctcaacaagcggaaaaagctggagcactactgataacaaaaacaactgtattaggagttgaaagggaaggaaacgaatataaaatatcaactgataggggtgaaataactgctgatagagtagtattagctgagggtgtgaatgccttagtttcaatgaaggctaatataaggccagatttaactccggatcatgcagcgcaaacagttaaagaggtttatagtttaaataaggatgagatcaataagagatttggatttaaggctgacgacgaaggcataagttggagaatattagggacagacccagttccctatgctggtttcctttacgtatataaggatgccgtggcaataggtgccggaattcccatgaagatacttataaagagaaaaataactccttatactgtattagacgaggtcaaggagagactgaactttaacgagttagttaagggagcgtcactaagagaatattcggcaaaggttataccagaatatggttttccttcatggaaagcttgttcaggtaaggtttatttagctggagatgcaataggtcttgtggatccattgacatttaatgggattggtcctgcagtggcttccggagtggttgcaggaaaggctgctttagaatcttatgaatgtaacaaatatgaatacgaattaatgaaaaataaggaagttagaagagttgtgaatgccagaccactagtaaaggagttaatagaagaagaaaacttcaaatattatgtgaaaactattaatgatctcctacacggttgggtttacagtgacttttctaaagttaagttagacacgtctaaactacttaaacacttattattaggtatgggggtgttaaagtcatga

SEQ ID NO: 100446 - protein, 395 aa, Sulfolobus solfataricus P2
MKFDIVVVGAGPAGSSAAITAARGGAKVLLLERGPEPGSKNVSGAMIRLEDFSSVYDIASIPIERKVKNVDLILLSDSNRTRISVNVESNLATVARLKLDKWMAQQAEKAGALLITKTTVLGVEREGNEYKISTDRGEITADRVVLAEGVNALVSMKANIRPDLTPDHAAQTVKEVYSLNKDEINKRFGFKADDEGISWRILGTDPVPYAGFLYVYKDAVAIGAGIPMKILIKRKITPYTVLDEVKERLNFNELVKGASLREYSAKVIPEYGFPSWKACSGKVYLAGDAIGLVDPLTFNGIGPAVASGVVAGKAALESYECNKYEYELMKNKEVRRVVNARPLVKELIEEENFKYYVKTINDLLHGWVYSDFSKVKLDTSKLLKHLLLGMGVLKS

SEQ ID NO: 100447 - DNA, 1155 bp, Sulfolobus tokodaii str. 7
  CDS (1)..(1155): transl_table=11
atgaaatatgatgcaattgtaataggtgccggtccttccggttcagcatcagcttacactttagcaaaaaatgggtataaagtacttttaatagagagaggctcagagccaggggcaaaaaatgtttcaggggcaatgataagggagtctgaaatttctaaagtctttgaaactaaggatatcccatttgagagaatagtaaaaagagttagactaattttcagaagtaaagatgatgaaagtgagattgtagttaaacccaagagtaagttatatacagtttcacgtttaaaatttgataaatggttagctcaaagggctgaaagtgcaggagcattattaattactaaaactactgtaactggaattgaaggtaataaggttataactgaaaggggaagtgtagaaggagataaaataataatagccgagggagctaacgctttactttcaatgtcattagggcttagaagagagttaaagaatgaggaaactgtactaggagtgaaagaggtttatgcatctacaagaaatgaagtcgagaagagatttaatttacaaggggatgaaggagaaagctggagaataataaccgattaccctcttccctcagctggtttcatttatacttataaggactcaatagctataggagttggtgctagggttgatgagattataactagaggtattagaccttttgaacttttagattcatttaagatgccgtatgcggagttggtaaagggtttctcattaagggaatactcggcaaagataattccagagaatggattcccatcatttaaaccttgtgaaggtgcaatttatgttgccggtgatgcattaggattaattgatccattaacttttgacggtatcggaccagcaattatatctggttacttagccgggaaggctgagaattgttactcctactcaaaaacgcttttcgaagctagagaaatatctaaggttataaaatcaagaccattagttaaggaattattaccaaacataggtctttactctcatcttattaacgatttcttaacaagctgggtcgaaggagatttttcaaagttaagatattataaaagtagtctaggtaagctcatgaaacatttaatcttaggtttaggggtgttagaatga

SEQ ID NO: 100448 - protein, 384 aa, Sulfolobus tokodaii str. 7
MKYDAIVIGAGPSGSASAYTLAKNGYKVLLIERGSEPGAKNVSGAMIRESEISKVFETKDIPFERIVKRVRLIFRSKDDESEIVVKPKSKLYTVSRLKFDKWLAQRAESAGALLITKTTVTGIEGNKVITERGSVEGDKIIIAEGANALLSMSLGLRRELKNEETVLGVKEVYASTRNEVEKRFNLQGDEGESWRIITDYPLPSAGFIYTYKDSIAIGVGARVDEIITRGIRPFELLDSFKMPYAELVKGFSLREYSAKIIPENGFPSFKPCEGAIYVAGDALGLIDPLTFDGIGPAIISGYLAGKAENCYSYSKTLFEAREISKVIKSRPLVKELLPNIGLYSHLINDFLTSWVEGDFSKLRYYKSSLGKLMKHLILGLGVLE

SEQ ID NO: 100449 - DNA, 1665 bp, Sinorhizobium meliloti 1021
  CDS (1)..(1665): transl_table=11
atgaccgagcaacaagaactccccgaacgcgagagcatggaattcgacgtcgtgatcgtcggggcgggaccggcggggcttgccgcggcgatccggctgaagcaggtcagtccggaactctcggtcgtggtgctggagaagggcgccgaagtgggcgcacatatcctctccggcgccgtggtcgacccgatcggcatcgaccggctcttgccgggctggcgcgacgaaccggaccacccgttcaagacggaagtcaccgacgatcagttcctctttctcggccccgcaggctctgtccgccttcccaatttcctgatgccgccgctgatgaacaatcacggcaactacgtggtatcgctgggcaatgtctgtcgctggctcgccacccaggcggaagcgctcggcgtcgagatctatccgggttttgccgcaacggaagtgctctacaatgacgagggcgcggtgatcggcgttgccaccggcgacatgggcatcgagcggaacggcgagccggggccgaacttcgcccgcggcatggagctgctcggcaagtacaccctcatcggcgagggcgtgcgtggctcgctcgccaagcagctgattgccaaatacaagctcgacgcgggctgcgacgtgccgaaattcggcatcggcctgaaggagctctgggaggtgaaaccggaaaatcataagccgggcctcgtgcagcattccttcggctggccgctcggcatgaagaccggcggcggctccttcctctatcaccttgaggacaatctggtggccgtcggtttcgtcgtccacctcaactacaagaacccgtatctctatccgttcgaggaattccagcgcttcaagacgcatccggcgatccgcggcactttcgagggtggaaaaaggctctcctacggcgcccgcgccatcaccgaaggcggctaccagtcggtgccgaagctgtctttccccggcggggcgctgatcggctgctcggccggcttcgtcaacgtgccgcgcatcaagggcagccacaatgcggtgctgtccggcattctcgccgcggagaagcttgcggcggcgatcgccgacggccgcgccaatgacgagccgatcgagatcgagcgcggctggcgcgagagcgctatcggccaggacctgaagcgggtccggaacgtcaagccgctgtggtcgaaattcggcaccgccgttggggtggcgctcggcggtctcgacatgtggaccaaccagctcttcggcttttccttcttcgggacgctgaagcacggcaagaccgatgcgcaatcgctcgagccggccgccaagcacgagaggatcgactatccgaaaccggacggggtgctgaccttcgaccggctctcctcggtgttcctgtcgaacaccaatcacgaggaggaccagccggtgcatctgcaggtgaaggactgggacctgcagaagcgctcggaatacgaggtctatgccggcccatcttcgcgctactgtccggccggcgtctatgaatgggtggagaaggacggccagcagaccttcgtcatcaacgcccagaactgcgtccactgcaagacctgcgacatcaaggacccgaaccagaacatcaactgggtgccgccacaagggggcgaagggccggtctatccgaacatgtga

SEQ ID NO: 100450 - protein, 554 aa, Sinorhizobium meliloti 1021
MTEQQELPERESMEFDVVIVGAGPAGLAAAIRLKQVSPELSVVVLEKGAEVGAHILSGAVVDPIGIDRLLPGWRDEPDHPFKTEVTDDQFLFLGPAGSVRLPNFLMPPLMNNHGNYVVSLGNVCRWLATQAEALGVEIYPGFAATEVLYNDEGAVIGVATGDMGIERNGEPGPNFARGMELLGKYTLIGEGVRGSLAKQLIAKYKLDAGCDVPKFGIGLKELWEVKPENHKPGLVQHSFGWPLGMKTGGGSFLYHLEDNLVAVGFVVHLNYKNPYLYPFEEFQRFKTHPAIRGTFEGGKRLSYGARAITEGGYQSVPKLSFPGGALIGCSAGFVNVPRIKGSHNAVLSGILAAEKLAAAIADGRANDEPIEIERGWRESAIGQDLKRVRNVKPLWSKFGTAVGVALGGLDMWTNQLFGFSFFGTLKHGKTDAQSLEPAAKHERIDYPKPDGVLTFDRLSSVFLSNTNHEEDQPVHLQVKDWDLQKRSEYEVYAGPSSRYCPAGVYEWVEKDGQQTFVINAQNCVHCKTCDIKDPNQNINWVPPQGGEGPVYPNM

SEQ ID NO: 100451 - DNA, 1287 bp, Thermoplasma acidophilum DSM 1728
  CDS (1)..(1287): transl_table=11
atgagtgaatttgatgtcatagttatcggcgctggtccggcaggatcctctgctgcaataaaacttgcgcagggtgggatgaacgtacttctggtggagaggggcgatcctccaggaacaaagaacgtttccggtgcagtcctctggggcgatgagctttcgaaagtcgtaccggattgggagagaagcgcacccatcgaacgttacgttacaagaaaggaggttgcattcctgacagagaaatcaaagatagccataagctatagttcacaggaactcatggagaagaaatctggaaagatcatcgtcaggggcaaattcgatcagtggctggcaaggaaggcaaaagatgcaggtgcaatgctcgtcaccggtataactgttgacaagctagtcatagatgggggcaaagtgataggagtgatgcaggatggcgatgtcataacctctgatgccgtaatcgtggcggagggtgcaaacccaagggttcttatcaactccggtctgaggccaaaactctcagatcatgacgttgcgctgggtataaaggagaccatcaagttgcctgaaaacgtcataaatgaacggttcaacgttgattcgaagggtggatatgcatcagaattcgtgctgggtttcctcgatgatggcctgctgtccggcggtttcctgtacacaaacagggataccatatcgttgggcattgtcacgtcgctagatcggcttagggcaaatggaatgacgcattcctatgatatcatgggcaaattcgaggatcatccgtttataaagaacctgataaaggacggaataccggatgagtacgctgcccatctggtaccagaaggtggactcgccagcatgccaaagctctatggaaatggatatcttgtcgccggagatgccgcgatgtttaccttcagcaacggcatggtgctgcaggggataaactacgcaataacgtcaggaatgctggcagccgaaacgatacttgagaacaagggcaagataagcgaggaaacgctatccacctatgtaagcaagctacgcaacagctacgtgcttagcgatctctacaccttcaatggcatacagaacgtcacctggagcgatttcacccagaagaccatgccaaagatactggacagcgttatgatgtcgatgtttgatgaacgcggtatgccaaaaaagcatctgatgcaggtactgaccgctgcagtcagatccaacggtatgaagtatacggacttgatatcaagcggctaccgcatgatgaggaagatgtga

SEQ ID NO: 100452 - protein, 428 aa, Thermoplasma acidophilum DSM 1728
MSEFDVIVIGAGPAGSSAAIKLAQGGMNVLLVERGDPPGTKNVSGAVLWGDELSKVVPDWERSAPIERYVTRKEVAFLTEKSKIAISYSSQELMEKKSGKIIVRGKFDQWLARKAKDAGAMLVTGITVDKLVIDGGKVIGVMQDGDVITSDAVIVAEGANPRVLINSGLRPKLSDHDVALGIKETIKLPENVINERFNVDSKGGYASEFVLGFLDDGLLSGGFLYTNRDTISLGIVTSLDRLRANGMTHSYDIMGKFEDHPFIKNLIKDGIPDEYAAHLVPEGGLASMPKLYGNGYLVAGDAAMFTFSNGMVLQGINYAITSGMLAAETILENKGKISEETLSTYVSKLRNSYVLSDLYTFNGIQNVTWSDFTQKTMPKILDSVMMSMFDERGMPKKHLMQVLTAAVRSNGMKYTDLISSGYRMMRKM

SEQ ID NO: 100453 - DNA, 1302 bp, Escherichia coli K12
  CDS (1)..(1302): transl_table=11
gtgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtag

SEQ ID NO: 100454 - protein, 433 aa, Escherichia coli K12
MLCSGYLGHDMEDDCDIIIIGAGIAGTACALRCARAGLSVLLLERAEIPGSKNLSGGRLYTHALAELLPQFHLTAPLERRITHESLSLLTPDGVTTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGRICDDLPGGAFLYTNQQTLSLGIVCPLSSLTQSRVPASELLTRFKAHPAVRPLIKNTESLEYGAHLVPEGGLHSMPVQYAGNGWLLVGDALRSCVNTGISVRGMDMALTGAQAAAQTLISACQHREPQNLFPLYHHNVERSLLWDVLQRYQHVPALLQRPGWYRTWPALMQDISRDLWDQGDKPVPPLRQLFWHHLRRHGLWHLAGDVIRSLRCL

SEQ ID NO: 100455 - DNA, 1677 bp, Caulobacter crescentus CB15
  CDS (1)..(1677): transl_table=11
atgagcgaagacctcgaacgcgagtcgatggagtacgacgtcgtcatcgtcggcggcggtcccgcaggcctctcggcggcgatccgtctcaagcagatggccgccaaggccggaaccgagatttcggtggccttgctcgaaaagggctcggaagtcggcgcgcatatcctgtcgggcgccgtgatcgaccccaagggcctggccgaactcttccccaactggaaggaagagggcgcgccgctggagacgccggtcaccaaggaccgcttcaagctgctgggcccgcaaggcgagctgagcctgccgatgttcgccatgccgccgttcatgcacaaccacggctgctacatcgcgtcgctggccaatctgacgcgctggctggcgggcaaggccgaggagctgggcgtcgaaatctatccgggcttcgccgcctcggacctcgtctggaacgacgacggctcggtcaagggcgtggtggtcggcgtcgtcggcatcgccaaggatggcgagaagaagccggactaccagccgggtatggagctgcacggcaagtatgtcttcatcgccgagggcgtgcgcggctcgctggccaagcaactgatcgccaagttcaagctggatgaaggcaagtcgccgcagaagtacggcatcggcatcaaggagctgtggcaagttccgcccgagcagcaccagccgggcctggccgagcacaccaccggctggccgctggatgaccagaccggcggcggcagcttcatgtaccacttcggggacaactacgtggccatcggctacgtcgtgcacctgaactacaagaacccctggctgtcgccgttcgacgagttccagcgcttcaagcagcatccgacggtccgcccgcatctggaaggtggcaagcgcatcgcctatggcgcgcgggctatcaccgagggcggctatcagtcggtgccgaagctgaccttcccgggcggcgctctgatcggctgctcggcgggctttgtgaacgtgccgcgcatcaagggcagccacaacgccgtgaaaaccggaattctggccgccgacgctgctttcgaggcggtgcaggccggccgcgccggcgacgagctgaccgcctaccagacgtcctacgacaagtcgtgggtggccaaggagctgaagatcgtccgcaacgccaagccgttgctgggcaagttcggcacggcgcttggcggcgcgctcggcatggccgacatgtgggtcaatcacctcacgggcggcgctttgggtctgttcggcacgctcaagcatgacaagaccgacgcggcgtcgaccggtctcgccaaggactacaagcccatcgtctatcccaagcccgacggcgtgatcagcttcgacaagctgagctcggtgttcctgtcggccaccaaccacgaggaagaccagccggcccacctgcgcctgaaggatccttcggtgccgatccaggtgaacctgcccaagtacggcgagccggcgcgtctctactgcccggccggcgtctatgaagtgctctacaatgagcagggcggtgatccgcgcttccagatcaatgcgcagaactgcgtccactgcaaaacctgcgacatcaaggacccgtcgcagaatatcgtctggaccacgccggaaggcggtggtggcccgaactatccgaacatgtga

SEQ ID NO: 100456 - protein, 558 aa, Caulobacter crescentus CB15
MSEDLERESMEYDVVIVGGGPAGLSAAIRLKQMAAKAGTEISVALLEKGSEVGAHILSGAVIDPKGLAELFPNWKEEGAPLETPVTKDRFKLLGPQGELSLPMFAMPPFMHNHGCYIASLANLTRWLAGKAEELGVEIYPGFAASDLVWNDDGSVKGVVVGVVGIAKDGEKKPDYQPGMELHGKYVFIAEGVRGSLAKQLIAKFKLDEGKSPQKYGIGIKELWQVPPEQHQPGLAEHTTGWPLDDQTGGGSFMYHFGDNYVAIGYVVHLNYKNPWLSPFDEFQRFKQHPTVRPHLEGGKRIAYGARAITEGGYQSVPKLTFPGGALIGCSAGFVNVPRIKGSHNAVKTGILAADAAFEAVQAGRAGDELTAYQTSYDKSWVAKELKIVRNAKPLLGKFGTALGGALGMADMWVNHLTGGALGLFGTLKHDKTDAASTGLAKDYKPIVYPKPDGVISFDKLSSVFLSATNHEEDQPAHLRLKDPSVPIQVNLPKYGEPARLYCPAGVYEVLYNEQGGDPRFQINAQNCVHCKTCDIKDPSQNIVWTTPEGGGGPNYPNM

SEQ ID NO: 100457 - DNA, 1686 bp, Salmonella typhimurium LT2
  CDS (1)..(1686): transl_table=11
atgaacgatacactttctaatacccagcaatcacgtgagacaatagaatgtgatgttcttattgtgggagcaggacccgccggattatctgcagctcttaaacttaaattacaggcaaatgacgcaggaaaagaactgtccattatcgtccttgataaaggagctgagcctggttctcatattctcagtggggcagtcatggatccccgagcgctgaatgaactaattcctgattggcaggaaagaggcgcacccattaaacagcctgttactcaggataaattactgttactgacgaatgaaaaatgtattaatttgccggatgcattgattcctgataattttcgcaaccatggaaactttatcgtaagcctcggtaatctcattaaatggctcgccggtcaggcagaaacgtcaggcgtggatatttatgcaggcttttcggcaactgagatactgtatgatcaggatactaacattatcggtgtagtaactggtgatatgggacgtcatcgggatggcagcaagaaagaggggttcctgagtggaatagaaattctggcaaaatatacaatttttgccgaaggggcccgcggtagtctggctaaagaactgatcaaaaaatttcatcttgatacaggcaaagcaccccagagttttagcataggcataaaagagttgtgggaggttccatcagaccagtcccatccggggcttgtaattcacaccacaggttggcctctggataaagagtcgttcgggggtgggtttctctatcatcttaatgataataaaattgcactaggtttggttgtgggacttgattattcaaatccctggttaagcccttttcaggaaatgcagcgcctgaaaacacacccttctatacgcaaatacattgaccggggtaagcgtattggttatggcgcaagagcaatcaataacggcgggattgcgtctatgcctgatccctgtttacctggtggtctgctgattggttgtaatgccggtacgctcaatgcaagtagaatcaagggcatccatacagctatcaaaagtggcatgatagcggctgacgctatatttaatgctttgctggacaacaggaaaaacgacatactgacagaatatcaaacattactgcgacagagctggctttggcaggaactggaaaatggtagtaatttcaaaccctggtttaaaaaagggcgtgtgataggttttattatgactggcattgagcattggctgcttccccgaatgggtataaaaaaaatcccctggcgtgtaaaaaataaccgaccggacaatatcactctgcaaccggccaacaaaagccagaaaaaactgtacgacaaacctgacggtaaactgacgtttgatattttgtcatccgtctatctcagtaacacctggcatgatgacgaccagccagtacatttgaaaatcagtgatcagaatatccctatatccattaatctggatatttatggtggccccgaagaacgatattgccctgccggagtatatgaatttttacaggatagtgaaacacaaaatatgcgtctgcaaataaattcacagaactgtattcactgtaaagtttgtgacattaaagatcctaaacaaaatataacctggactacgcctgaaggtggcaacggaccaaattatacagggatgtaa

SEQ ID NO: 100458 - protein, 561 aa, Salmonella typhimurium LT2
MNDTLSNTQQSRETIECDVLIVGAGPAGLSAALKLKLQANDAGKELSIIVLDKGAEPGSHILSGAVMDPRALNELIPDWQERGAPIKQPVTQDKLLLLTNEKCINLPDALIPDNFRNHGNFIVSLGNLIKWLAGQAETSGVDIYAGFSATEILYDQDTNIIGVVTGDMGRHRDGSKKEGFLSGIEILAKYTIFAEGARGSLAKELIKKFHLDTGKAPQSFSIGIKELWEVPSDQSHPGLVIHTTGWPLDKESFGGGFLYHLNDNKIALGLVVGLDYSNPWLSPFQEMQRLKTHPSIRKYIDRGKRIGYGARAINNGGIASMPDPCLPGGLLIGCNAGTLNASRIKGIHTAIKSGMIAADAIFNALLDNRKNDILTEYQTLLRQSWLWQELENGSNFKPWFKKGRVIGFIMTGIEHWLLPRMGIKKIPWRVKNNRPDNITLQPANKSQKKLYDKPDGKLTFDILSSVYLSNTWHDDDQPVHLKISDQNIPISINLDIYGGPEERYCPAGVYEFLQDSETQNMRLQINSQNCIHCKVCDIKDPKQNITWTTPEGGNGPNYTGM

SEQ ID NO: 100459 - DNA, 1287 bp, Salmonella typhimurium LT2
  CDS (1)..(1287): transl_table=11
atgtcggatgataaatttgacgctattgtggtgggcgcaggcgtagcaggaacggtcgccgcgtatgtgatggcaaaagcgggactggatgtactggttattgaacgcggaaacagcgcgggcagcaaaaatatgaccggtggccggctctacgctcacagtatcgaaagtattatgccgggattcgcaacgtccgcccccatcgaacgcgtcgttacccgtgaaaaaatctcctttttaaccgaagaaagcgccgtcacacttgattttcaccgcgcgccccctactccgccccttacgtcatataccgtactgcgcaacaaactggacccgtggttaatggcgcaggcggaacaggctggcgcgcagtttatcccaggtgtacgggtcgacgctctggtacgtgaaggcaatcgcgtcactggcgttcaggccggggatgatattctggatgcgaatattgtgattctcgcggacggcgtgaattccatgctgggccgttcgctggacatggtgcctgtctcttctgcgcatcactatgcagtcggcgtaaaagagttgattgggctctctccggcacttattgaagagcgctttaatctggcgtcccatgaaggcgccgcctggttattcgctggcgcgccctccaacgggctcatgggcggcgggtttctttataccaaccgcgattcggtttctctggggctggtatgtggcctgggcgacattgctcacgcgaccaaaagcgtaccgcaaatgctggaagattttaaacagcatccggcaatacgccctttgattcaggggggaacactgcttgaatactccgctcatatggtgcccgaaggcggcatagcaatgatgccggagctggcaaatgacggcgtgatgattgtcggcgacgccgccggtctttgtctgaatctcggctataccgtccgcggcatggatttagccatcgcgtccgcgcaagcggccgctcaaaccgccattgacgctaaagcgcggcaagatttttccgccgcgagtcttgccggttacaaacgcgcgctggagaaaaacggcgtgttacgcgatatgcggcatttccgcaaactccccggattaatggaaaacccacggctttttaccgagtacccgcgtatggcggcaaacattgtgggcgatctgttcaccgttgatggcggtccagtcccaccgttgcgtaaaactatcctgtcacatgcgaaaaaaattggactggtgaatctattaaaagacggcataaaaggggctacggcattatga

SEQ ID NO: 100460 - protein, 428 aa, Salmonella typhimurium LT2
MSDDKFDAIVVGAGVAGTVAAYVMAKAGLDVLVIERGNSAGSKNMTGGRLYAHSIESIMPGFATSAPIERVVTREKISFLTEESAVTLDFHRAPPTPPLTSYTVLRNKLDPWLMAQAEQAGAQFIPGVRVDALVREGNRVTGVQAGDDILDANIVILADGVNSMLGRSLDMVPVSSAHHYAVGVKELIGLSPALIEERFNLASHEGAAWLFAGAPSNGLMGGGFLYTNRDSVSLGLVCGLGDIAHATKSVPQMLEDFKQHPAIRPLIQGGTLLEYSAHMVPEGGIAMMPELANDGVMIVGDAAGLCLNLGYTVRGMDLAIASAQAAAQTAIDAKARQDFSAASLAGYKRALEKNGVLRDMRHFRKLPGLMENPRLFTEYPRMAANIVGDLFTVDGGPVPPLRKTILSHAKKIGLVNLLKDGIKGATAL

SEQ ID NO: 100461 - DNA, 1689 bp, Ralstonia solanacearum GMI1000
  CDS (1)..(1689): transl_table=11
atgaaccagcagcagctcctcgaacagtacggtccccgcgaatccatggagtacgacgtcgtgatcgtcggcggcgggccggctggcctggcgaccgcgatccgcatcaagcagcgcgcggccgagaccggcaaggacgtttccgtggtcgtgcttgagaaaggctccgagcccggcgcgcacattctctcgggcgccgtgatggacccgcgcgcgatcgacgagctgctgcccgactgtaaggcacaaggcgccccgctcaaccagcccgtcaccggcgacgatgtgctgttcctgagcgagaccggcgccacgcgcacccccgactggctggtgccgcgcaacctgcacaacgaaggctgctacgtcatctcgctgtccaacgtcgtcaaatggctggcgacgcaggccgagggcctgggcgtggagatcttccccggctttgccgccgcggaggtgctctacgacgatcgcggcgccgtgcgcggcgtggccaccggcaacatgggggtcggcaaggacggcgagccgaccgaccacttccagctcggcatggagctgctgggcaagtacaccatcttcgccgaaggcgcgcgcggccatctgggccggcagttgctcgacaagtacaagctcgatgccggcaaggacccgcagagcttcgccatcggcatcaaggagctgtgggagatcgacccggccaaggccaagcccggcctggtggtgcacaccgccggctggccgatggatgccgatacgttcggcggcggcttcctgtaccacctggaagacaacaaggtcacgctcggcttcgtgatcggcctcgactacaagaacccgtggatgagcccgttcgaagagatgcagcgctggaagacgcatccggccatccgcgcgcacatcgagggcggcaagcgcatcggctatggcgcccgcgcgatcaacaacggcacgccgcaggcactgcccaggacggtgttcccgggcggcgcgctggtcggctgcgacgccggttacctgaacgcggcgcgcatcaagggcagccacgcggccctcaagagcggcatgctgtgcggcgaggcggtgttcgaggcggtgacggcgggccgcgccggcgatgagctgtcggcctatccggcggcgttcgagcagagctggctgaaggaggagctcgaccagacgcgcaacttcaagctctggttcaagaagcatggccgcatggtcggcaatgtcatgaccggcatcgagcagtggctgctgcccaaggtcggcatcaagaccccgccctggacgctgcacagcacggcgcccgacaacgcctcgctcaagccggccggcgaatgccccaagatcgcgtatccgaagccggacggcaagctgaccttcgaccggttgtcgtcggtgttcatctcgaacaccaaccatgaagaaaaccagccggcccacctgacgctgaaggacccgaccgtccccacgcgcatcaacctgacgcagttcgccgggccggaacagcgctactgcccggccggcgtgtacgaattcgtcaagaacgacgacggcaccgagcgcctgcagatcaacgcgcagaactgcgtgcactgcaagacctgcgacatcaaggacccgacgcagaacatcgtgtgggtcacgccggaaggcggcggcggcccgaactacgtcggcatgtaa

SEQ ID NO: 100462 - protein, 562 aa, Ralstonia solanacearum GMI1000
MNQQQLLEQYGPRESMEYDVVIVGGGPAGLATAIRIKQRAAETGKDVSVVVLEKGSEPGAHILSGAVMDPRAIDELLPDCKAQGAPLNQPVTGDDVLFLSETGATRTPDWLVPRNLHNEGCYVISLSNVVKWLATQAEGLGVEIFPGFAAAEVLYDDRGAVRGVATGNMGVGKDGEPTDHFQLGMELLGKYTIFAEGARGHLGRQLLDKYKLDAGKDPQSFAIGIKELWEIDPAKAKPGLVVHTAGWPMDADTFGGGFLYHLEDNKVTLGFVIGLDYKNPWMSPFEEMQRWKTHPAIRAHIEGGKRIGYGARAINNGTPQALPRTVFPGGALVGCDAGYLNAARIKGSHAALKSGMLCGEAVFEAVTAGRAGDELSAYPAAFEQSWLKEELDQTRNFKLWFKKHGRMVGNVMTGIEQWLLPKVGIKTPPWTLHSTAPDNASLKPAGECPKIAYPKPDGKLTFDRLSSVFISNTNHEENQPAHLTLKDPTVPTRINLTQFAGPEQRYCPAGVYEFVKNDDGTERLQINAQNCVHCKTCDIKDPTQNIVWVTPEGGGGPNYVGM

SEQ ID NO: 100463 - DNA, 1665 bp, Agrobacterium tumefaciens str. C58
  CDS (1)..(1665): transl_table=11
atgacggaagcgatggaactgcccgaacgcgaagcgatggaattcgacgttgtgatcgttggcgcgggtcctgcgggtctcagcgcggcgatccggctgaagcaggtcgagccggagctttcggtcgtcgttctggaaaaaggcgcggaagttggcgcgcatattctctcgggcgccgtggtcgatcccatcggcatcgatcggctgctgcccggctggcggaaagaggaggggcatcccttcaagaccgaggtcaaggacgaccagttcatgttcttaggcccggctggctccattcgcctgccgaatttcatgatgccgcctttgatgaacaatcatggcaattacatcgtctcgcttggcctcgtctgtcgctggctggcggaaaaggcggaagcgctcggcgtcgagatctatccgggctttgccgccaccgaagtgctttataatgacgcaggcgccgttatcggcgtcgccaccggcgatatgggcatcgaaaagaacggcgagcccggccctgccttcacccgcggcatggagctgcacggcaaatatgtgcttgttggagaaggcgtgcgcggttcgctcgccaagcagttgatcgcaaagtacgacctgtcgaaggatcgcgagccgcagaaattcggcatcggcatcaaggaactctggcaggtcaagccggaacaccacaggcaaggcctcgtgcagcactccttcggctggccgctgggtttcaagaccggcggcggctcgttcctctatcatctggaagacaatctcgttgccgtcggcttcgtcgtccacctcaattacaagaacccctatctttaccccttcgaggaattccagcgcttcaagacccatcccgcgatccgcgataccttcgagggcggcaagcgcatctcctatggcgcgcgcgcgattaccgagggcggttatcagtcggtgccgaagctcaccttccccggcggcgcgctgatcggctgttccgccggtttcgtcaacgttccgcgcatcaagggcagccataatgcggtgctttcgggcatgctggcggcggaaaagatcgccgcagccctctcagcaggccgcgcccatgacgaggtagtcgagatcgaagccgaatggcgcgacggcgatatcggcaaggacctgaagcgggtgcgcaacgtcaagccgctctggtcgaaattcggcacgctggttggcgtcggcctcggcggtctggacatgtggacgaaccagctgttcggcttctcggtcttcggcacgctgaagcacggcaagacggatgcgcagagcctcgaaccggcctcgaagcacaagccgatcgcctatccgaagccggatggcgttctgaccttcgaccggctgtcgtcggtgttcctgtcttccaccaaccatgaggaggaccagccggtgcatcttcaggtgaaggacatggagttgcagaagcgctccgaacacgacatttatgccggtccctcgacccgttattgccccgccggcgtttatgaatgggtggagaaggacggcgaggaagtttacgtgatcaacgcccagaactgcgtgcactgcaagacctgcgatatcaaggaccccaaccagaatatcaactgggtgccgcctcagggcggcgaggggccggtttacgccaatatgtga

SEQ ID NO: 100464 - protein, 554 aa, Agrobacterium tumefaciens str. C58
MTEAMELPEREAMEFDVVIVGAGPAGLSAAIRLKQVEPELSVVVLEKGAEVGAHILSGAVVDPIGIDRLLPGWRKEEGHPFKTEVKDDQFMFLGPAGSIRLPNFMMPPLMNNHGNYIVSLGLVCRWLAEKAEALGVEIYPGFAATEVLYNDAGAVIGVATGDMGIEKNGEPGPAFTRGMELHGKYVLVGEGVRGSLAKQLIAKYDLSKDREPQKFGIGIKELWQVKPEHHRQGLVQHSFGWPLGFKTGGGSFLYHLEDNLVAVGFVVHLNYKNPYLYPFEEFQRFKTHPAIRDTFEGGKRISYGARAITEGGYQSVPKLTFPGGALIGCSAGFVNVPRIKGSHNAVLSGMLAAEKIAAALSAGRAHDEVVEIEAEWRDGDIGKDLKRVRNVKPLWSKFGTLVGVGLGGLDMWTNQLFGFSVFGTLKHGKTDAQSLEPASKHKPIAYPKPDGVLTFDRLSSVFLSSTNHEEDQPVHLQVKDMELQKRSEHDIYAGPSTRYCPAGVYEWVEKDGEEVYVINAQNCVHCKTCDIKDPNQNINWVPPQGGEGPVYANM

SEQ ID NO: 100465 - DNA, 1692 bp, Brucella melitensis 16M
  CDS (1)..(1692): transl_table=11
atgtctgaagcgaacgagcttcccgaacgcgagagcatggaattcgacgtcgtgattgtcggcgcaggccctgccggtcttgcagcggcgattcgtttcaaacagataaaccccgaactttccgtggtcgtgctggaaaagggtggggaagtcggcgcgcatatcctgtcgggtgcggtggtggacccggtcggtatcgaccagcttctgcccggctggcgcgaggaggaaggccatcctttcaaaacgcctgtgacggcggaccatttcctggtgctggggcctgccggttccgtgcgcctgcccaattttgccatgccgtcgctgatgaacaaccacggcaattacatcgtttcgctcggtaatgtctgccgctggctcggcacgaaggccgaggagctgggcgtggaaatctatccgggcttcgctgcgaccgaagtactctataatgacgagggcgcggtgatcggcgttgcgacgggcgacatgggcgtcgaacgcgacggcacacgtggccctaactatacgcgcggcatggcgctgctcggtaaatatgtgctgatcggcgagggcgcgcgtggttcactcgccaagcagctcattgcgaagttcaagcttgacgagggccgcgaaccggccaagtttggcatcggcctgaaggagctttggcaggttgatccgtcgaagcacaaaccgggcctcgtgcagcattcgttcggctggccgctggacatgaaaaccggcggcggctcgttcctctatcatcttgaggacaatatggttgcggtgggctttgtgctgcacctcaattacaagaacccctatctctcgccattcgaggaattccagcgtttcaagacgcatccggccatccgcgatacgttcgagggcggcaagcgcctttcctatggcgcgcgtgcaattaccgagggcggctggcaatccgtgccgaagctttccttccccggtggcgcgctcatcggctgctcggccggttttgtcaatgtgccgcgcatcaagggcagccacaatgcgatcctgtccggcattctggccgccgacaagattgcagaggcgattgccgctggccgtgccaatgacgagccgatcgagatcgagaatagctggcgggcgagcgccattggcaaggacttgaagcgcgtgcgcaacgtcaagccgctctggtcgaagttcggcaccgctatcggcattgctctgggcggcctggatatgtggaccaaccagcttttcggcttctcgttcttcggcacgatgaagcacggcaagaccgatgcgcaggcgcttgaaccggctgcaaactacaagaagatcgactatccgaagccggatggtgtgctgacttttgaccgtctgtcgtctgtgttcctgtcgaacacgaaccacgacgaaaacgagccggtgcatttgcaagtgcgtgacatggaattgcagaagacttcggaacacgatgttttcgcaggaccgtcgacgcgctattgcccggctggtgtttatgaatgggtggatgcggacggcaatgccgctgctgatccgggcgtcaaggatgtgcgtttcgtcatcaatgcgcagaactgcgtccactgcaagacctgcgacatcaaggacccaaaccagaatatcaactgggttccgccacaaggcggcgaaggaccggtctatatgaacatgtaa

SEQ ID NO: 100466 - protein, 563 aa, Brucella melitensis 16M
MSEANELPERESMEFDVVIVGAGPAGLAAAIRFKQINPELSVVVLEKGGEVGAHILSGAVVDPVGIDQLLPGWREEEGHPFKTPVTADHFLVLGPAGSVRLPNFAMPSLMNNHGNYIVSLGNVCRWLGTKAEELGVEIYPGFAATEVLYNDEGAVIGVATGDMGVERDGTRGPNYTRGMALLGKYVLIGEGARGSLAKQLIAKFKLDEGREPAKFGIGLKELWQVDPSKHKPGLVQHSFGWPLDMKTGGGSFLYHLEDNMVAVGFVLHLNYKNPYLSPFEEFQRFKTHPAIRDTFEGGKRLSYGARAITEGGWQSVPKLSFPGGALIGCSAGFVNVPRIKGSHNAILSGILAADKIAEAIAAGRANDEPIEIENSWRASAIGKDLKRVRNVKPLWSKFGTAIGIALGGLDMWTNQLFGFSFFGTMKHGKTDAQALEPAANYKKIDYPKPDGVLTFDRLSSVFLSNTNHDENEPVHLQVRDMELQKTSEHDVFAGPSTRYCPAGVYEWVDADGNAAADPGVKDVRFVINAQNCVHCKTCDIKDPNQNINWVPPQGGEGPVYMNM

SEQ ID NO: 100467 - DNA, 1275 bp, Pyrobaculum aerophilum str. IM2
  CDS (1)..(1275): transl_table=11
atgaaattcgacgtagctatcgtaggcgcaggtcctgcgggacttgccgcagcttataaactcgcctcggcgggttttaaagtcgtagtgttagagagggggagagagcccggctcaaaagagctatacggcggccgtatttatgcatattggcttgataggtacttgccggagtttcgcaaagacgcgccagtagatagatgggtgcggagggaaagagtgactttcctcactgaggacaaagcgttgacattggaatcggcggttgtacagaaggagaagactagttttattgttcccctggtatcttttgtatcttggttggctaagctggcacaaggcgccggcgccaagatagttactgaggtgacggtagacgcgttagtaaaagacgagaaaggcagagttgtgggagttcagtccggtccagacgtcttacaagcggattacgtcatagatgcagagggcgttaaccgactgctcttagagcgggctggcattgtgaaaaagcttgagccggagcttgtggctgtaggcgttaaggaggtgttgaagtttgagaataaaaagacgttagaagagaggctgggccttgaggaagacgagggcctagcttgggcaattgctgggtaccccacggagtatctgccgggcggcggttttatctacacctacaaggactcgttggcgcttggcgtagtggtgtatttaaagaactgggagaggctgaaaactcctgtttacgagttggtggaaaaactgaggctacatccctacatagcgcctctcgtgaagggcgccgctcttcaggaatatggaggccatatgactcctgtggctgggataaatatgtctcctccccgcttttattatgacggcttgttaattgtaggcgacgcggccggctttctcttacacacaggcgttttaatacgcggcgttgattttgcaattgcttcgggcgtgctggccgcggaggcggtaaaagaggcgaggagcccctcggcggaggacttgtcagtctacgagaaaaagttgagaagtagctttatcttaccgcaactggaaaagttcagaaaggccgataagttgttaggcgacgagtctttattcagagacttgacgttattttcaacagaggcgtcgtataggtattttaacatcgatgagaaccacaggactttactggaggctttacgcgaagcgtcgaagaaaactggcgttagcatgttaaagataatgataaatataataagaatggtaagaagcctatga

SEQ ID NO: 100468 - protein, 424 aa, Pyrobaculum aerophilum str. IM2
MKFDVAIVGAGPAGLAAAYKLASAGFKVVVLERGREPGSKELYGGRIYAYWLDRYLPEFRKDAPVDRWVRRERVTFLTEDKALTLESAVVQKEKTSFIVPLVSFVSWLAKLAQGAGAKIVTEVTVDALVKDEKGRVVGVQSGPDVLQADYVIDAEGVNRLLLERAGIVKKLEPELVAVGVKEVLKFENKKTLEERLGLEEDEGLAWAIAGYPTEYLPGGGFIYTYKDSLALGVVVYLKNWERLKTPVYELVEKLRLHPYIAPLVKGAALQEYGGHMTPVAGINMSPPRFYYDGLLIVGDAAGFLLHTGVLIRGVDFAIASGVLAAEAVKEARSPSAEDLSVYEKKLRSSFILPQLEKFRKADKLLGDESLFRDLTLFSTEASYRYFNIDENHRTLLEALREASKKTGVSMLKIMINIIRMVRSL

SEQ ID NO: 100469 - DNA, 1815 bp, Drosophila melanogaster
  CDS (1)..(1815)
atgtcggcactcatgaaaatgcacagagttcggagactcttcagccccgctctggctcgcagcatctccgatgtggccaaatatcccaggataaccacccactatacgctgaatccccgcgagaaggatgagcgctggacggaagtggatatggagcgttgtgttgaggaggtggacctggtcatcgtcggtggaggacctgctggaatgtcggcggctattagggcgaagcaactggcggcggaaaaggatcaggaaatccgcgtctgcgtagtggaaaaggccgccgaagttggcggacatattctctccggcgccgtcatagatccaatctcgctgaacgagcttatcccggactggcaagagcagggagctcctctaaacacacccgtgaccaaggatactttctccttcctcaccggatccggccgcatctccattccggtctttaagggctggcccatggacaaccatggcaactacgtagttcgcttgggccacttggtcaagtggcttggagatcaggcggaggctctgggcgtggagatctatcccggctgtgctgcctccgaggtgctcttccacgaggatggcagtgtcaagggcattgccaccaacgatgtgggcattgccaagagcggagctcccaaggacacctttgcacgtggcatggagttgcacgccaagactaccatctttgccgaaggctgccggggtcacctgaccaagcagattatgcagaagttcggacttaacgagggcagcgaaccacaggcctatggaatcggtctgaaagaggtctgggagattgcccccgagaagcatcaacctggtttggtggagcataccattggctggcctttggaccgcttcacatatggcggctccttcttgtaccatttgaacgagcccacacccaccattgcagtgggctttgtggtgggcttgaactacaagaacccctggctcagtcccttccaggagttccagcgtttcaagacgcatcccaaggtgcgagacgtcttcgagggcgccactcgaattgcctatggagcacgagcaatcaatgagggtggcttccaaagtctgccgcagaagctgtcctttccgggaggttgccttgtgggctgcagtgctggctttttgaatgtccctcgcattaagggctcccattacgcgatgaagagcggcatgctggcggcggagagtgcctttgaagccatcaatgcggatgcacaatcgacggctggtgtggaacccacaggctatgcggagaaaatcaaggactcctttgtatggaaggatctgtacagtgtgcgaaatgtgcacccttctttccacaatccattgggactgtacggtggtcttgtgctcagtggcttctccattttcatgggcggtcgggaaccatggaccctaaaacacggtccccaggatcacgagtccttgaagccagctagctcctgcccgcccattgtttaccccaagcccgatggcaagatctccttcgatctgctgtcttcggtagcactgacgggcacaaaccacgagggcgaccagcccgcccatctgaccctcaaggacgaccgcatccccgtggaccataatttggcgctgtacgagggacccgagcagagattctgccccgctggcgtttacgagtacgtgcccaacgaggagggcggcaacatgaagctgcaaattaacgcccagaactgcatccactgcaagacctgtgatatcaaggaccccaagcagaacatcaactgggtggtgcccgagggaggtggcggtcccgcctacaacggcatgtga

SEQ ID NO: 100470 - protein, 604 aa, Drosophila melanogaster
MSALMKMHRVRRLFSPALARSISDVAKYPRITTHYTLNPREKDERWTEVDMERCVEEVDLVIVGGGPAGMSAAIRAKQLAAEKDQEIRVCVVEKAAEVGGHILSGAVIDPISLNELIPDWQEQGAPLNTPVTKDTFSFLTGSGRISIPVFKGWPMDNHGNYVVRLGHLVKWLGDQAEALGVEIYPGCAASEVLFHEDGSVKGIATNDVGIAKSGAPKDTFARGMELHAKTTIFAEGCRGHLTKQIMQKFGLNEGSEPQAYGIGLKEVWEIAPEKHQPGLVEHTIGWPLDRFTYGGSFLYHLNEPTPTIAVGFVVGLNYKNPWLSPFQEFQRFKTHPKVRDVFEGATRIAYGARAINEGGFQSLPQKLSFPGGCLVGCSAGFLNVPRIKGSHYAMKSGMLAAESAFEAINADAQSTAGVEPTGYAEKIKDSFVWKDLYSVRNVHPSFHNPLGLYGGLVLSGFSIFMGGREPWTLKHGPQDHESLKPASSCPPIVYPKPDGKISFDLLSSVALTGTNHEGDQPAHLTLKDDRIPVDHNLALYEGPEQRFCPAGVYEYVPNEEGGNMKLQINAQNCIHCKTCDIKDPKQNINWVVPEGGGGPAYNGM

SEQ ID NO: 100471 - DNA, 1128 bp, Methanopyrus kandleri AV19
  CDS (1)..(1128): transl_table=11
atggagttcgatgtggtggtggtcggtgcgggtccggcgggttcggtggcggcgtgggccgcggcggaggccggttgtgatgtcctgatactcgagcgtaaggccgagatcggcgtccccaaacagtgcgccgaaggcatcagcgcacgagctctcgaggaggtcggaatcagacctgacgacggttggatagccgcggaaatagagcgtggtatcctctcgctaccgagtggttccaagttcgaggttgaggtcgaagggtacgtgttggagcgtcgtgtgtttgataagtggttggttgttcgggcggtggaggctggtgcggaggtcgagttgttggcgcatgctcgacgggcgttgttagatgagggtcgggtggtcggggtcgagtacgagggcgaggatggagtgcacgaggtccgagcccgcatcgtcatcgccgcagacggaatcgaatcacgcataggaagaaccgccggactggttcctcaactcgagcctgatcatatatgcacctgcgcacagtacgaggtcgtcggcgaccggtacgatccgaaggcgttcatgatccacttcgatcccgagcggatacccggcgggtacgcatgggtcttcccgaaaggggagaaccgggcgaacgtaggggtgggaatccgagggtccgaatccagtccaggtctggccttaaaaacgctcgacgagctcgtcgagggtcccttatccgagctcgtagcggggacgccagtggaggtgaacgtgggtggtgtgccggtgtgcgggcccgtcgagcggacgtacggtgacgggatcctcctcgtgggtgatgcggcccgccaggtcaacccgttaaccggtggcgggttgaacaccgcgcttatctgcggtcggatcgcgggcgaggtggcggtcgaggcgatcgaagaggacgacacgtccgcctccttcctgaaacggtaccaagaccggtgggaagaagaattcagggacacgttcgaatgtgcgcgtgaggtggcggaaatgctcccagagcttgacttgaaggaagtcgtcgagttcctatcgtcggtggaaaacttggaggaaatgctgaggacatctggtatcttggaggacgtgtggtggggttag

SEQ ID NO: 100472 - protein, 375 aa, Methanopyrus kandleri AV19
MEFDVVVVGAGPAGSVAAWAAAEAGCDVLILERKAEIGVPKQCAEGISARALEEVGIRPDDGWIAAEIERGILSLPSGSKFEVEVEGYVLERRVFDKWLVVRAVEAGAEVELLAHARRALLDEGRVVGVEYEGEDGVHEVRARIVIAADGIESRIGRTAGLVPQLEPDHICTCAQYEVVGDRYDPKAFMIHFDPERIPGGYAWVFPKGENRANVGVGIRGSESSPGLALKTLDELVEGPLSELVAGTPVEVNVGGVPVCGPVERTYGDGILLVGDAARQVNPLTGGGLNTALICGRIAGEVAVEAIEEDDTSASFLKRYQDRWEEEFRDTFECAREVAEMLPELDLKEVVEFLSSVENLEEMLRTSGILEDVWWG

SEQ ID NO: 100473 - DNA, 1257 bp, Methanopyrus kandleri AV19
  CDS (1)..(1257): transl_table=11
atgactgtggtatttgcgccaaggtttgcccgacgggcgccatcgagaacgagggggagtgaggctatggagttcgatgtggtggtggtcggtgcgggtccggcgggttcggtggcggcgtgggccgcggcggaggccggttgtgatgtcctgatactcgagcgtaaggccgagatcggcgtccccaaacagtgcgccgaaggaataagtgcacacgggctcgaacacgctggcatcgagccccaggatgagtggatcgctaccgagatctcgcgcgccctcatctacgctcccaacgggaaggagttcgaggtccccggtgacgggtacgtgttggagcgtcgtgtgtttgataagtggttggttgttcgggcggtggaggctggtgcggaggtcgagttgttggcgcatgctcgacgggcgttgttagatgagggtcgggtggtcggggtcgagtacgagggcgaggatggagtgcacgaggtccgagcccgcatcgtcatcgccgcagacggaatcgaatcacgcataggaagaaccgccggactggttccatcgctcaaacccgtagagatgtgtacctgcgcgcaatatgagatggtgggcgttgatgtggaggaggacgccacgcacttcttcgtcgacgccgagttcttcccgggagggtacttctggatcttcccgaagggcgaaggtcgggcgaacgtgggattaggtatccgagggtccgaatccgaacccggggatgcgctgaaggtactgaaccgtgccttggaggatcacgagctgatctcggaagcggtggcggacgccgtccccgtggaagtgaacgtgggtggtgtgccggtgtgcgggcccgtcgagcggacgtacggtgacgggatcctcctcgtgggtgatgcggcccgccaggtcaacccgttaaccggcggtggtcttcatacttccctggtttgcggtcggatcgcgggcgaggtggcggccgaggcgatcgaagaggacgacacgtccgcctccttcctgaaacggtaccaagaccggtgggaggaagagttcggtaagacgttcaaatacgccctgaaggcgtctaagatattctccgaaatgagtaacgaggagctcaacgcattggcggaggcgctggaccgtgaggatatcctcaggttagtgaagggagaggaagtcgtgaaggtggccaagaaggtgatcagcaggaaaccgtcgctcctgaagtacgccaagcacctcatgaaataa

SEQ ID NO: 100474 - protein, 418 aa, Methanopyrus kandleri AV19
MTVVFAPRFARRAPSRTRGSEAMEFDVVVVGAGPAGSVAAWAAAEAGCDVLILERKAEIGVPKQCAEGISAHGLEHAGIEPQDEWIATEISRALIYAPNGKEFEVPGDGYVLERRVFDKWLVVRAVEAGAEVELLAHARRALLDEGRVVGVEYEGEDGVHEVRARIVIAADGIESRIGRTAGLVPSLKPVEMCTCAQYEMVGVDVEEDATHFFVDAEFFPGGYFWIFPKGEGRANVGLGIRGSESEPGDALKVLNRALEDHELISEAVADAVPVEVNVGGVPVCGPVERTYGDGILLVGDAARQVNPLTGGGLHTSLVCGRIAGEVAAEAIEEDDTSASFLKRYQDRWEEEFGKTFKYALKASKIFSEMSNEELNALAEALDREDILRLVKGEEVVKVAKKVISRKPSLLKYAKHLMK

SEQ ID NO: 100475 - DNA, 1650 bp, Xanthomonas axonopodis pv. citri str. 306
  CDS (1)..(1650): transl_table=11
atgtcggaagcgggagtgggcgcacacgcgtcagaggcggtcgagcgtgacgtcatggaatacgacgtcgtcaccgtcggtgccggtccggccgggctgtcgttcgcgatccggctcaagcagctcgatccgaacatcagcgtctgcgtgatcgaaaaatccagcaccatcggcgcgcatatcctgtccggtgcggtgatcgagcccggcccgctggatgcactgctgccaggctggcgcgacaatccgccgccgatctgcgtggcggccaccgacgacgaattctggtttctcggcaaggacagcgcgcgcaagttcccggtggtgccaccgggcatgcgcaaccatggcaacttcatcgtcagcctgggcgcgatgtgcgcctggctggcgccgcaggccgaagcgctgggcgtggagatctaccccgggttcgccgccgccgagacgctacacgacgacagcggccaggtggtgggcgtgcgcattggcgacatgggcattgcaaaagacggctcgcacaagtccggctacaccgccggcatcgacatccgcgccaaggtgaccgtgcttgccgaaggcgcgcgtggtcacctgaccaagcgattgttgaagcgcttcgacctcaccgccgacagcgacccgcaaggctattcgatcggcatcaaggagctgtggcaggtcccggaaggccgcgtcacgcccggtaagatcgtgcacaccattggctggccagccgacaaccgtacctacggcggcagctttgtgtatcacctggacaacaaccagattgcgctcggctatgtgagcgggctggactacagcgacccgacctaccagccgtgggaagccttccagcaatggaagaaccaccccatgatcaagccgctgctggaaggtggcagcatcttgtctgccggtgcccgcgcactggtcagtggcggttggcaatcgctgccgaaagtggacatgcccggcgccttgctcattggcgacaccgccggcctgctcaacgtgcccaagatcaagggcacccaccaggcgatccgcagcggcatgctggccgccgaacacctggtgcaatcgcagctggcgccgcagggtttcgatgccacattgcgcgcctccgacgtcatggccgagctgaagcaagtccgcaacatcaaacccggtttcaagaaaggcctgtggttcggcctgctcaacgcggcctgggaaaccgcgctcaagggcgcttcgccgtggacgctgaagaacaaacccgactggtcggcgttgcacaagctcggcgagtacgagcgacccaagcgcgactacgtcacccgcgacctggccccccgcgaccgcctgcaagccgtttatttcgccgccaccgagcacgatgaagaccagccggtgcatctgaaggtgctggacaccgatgtatgcgccacccgctgcgtgacggaatacgacaacccctgcacgcgcttttgcccggccaacgtctacgaaatggtcgcagacaccgccagcccctccggcaagcgcctgcagatcaacgcggccaactgcgtgcactgcaagacctgcgacatcaaggatccgtacgaaatcatcacctgggtcacaccggagggtggttcgggcccgaactaccagaatctgtga

SEQ ID NO: 100476 - protein, 549 aa, Xanthomonas axonopodis pv. citri str. 306
MSEAGVGAHASEAVERDVMEYDVVTVGAGPAGLSFAIRLKQLDPNISVCVIEKSSTIGAHILSGAVIEPGPLDALLPGWRDNPPPICVAATDDEFWFLGKDSARKFPVVPPGMRNHGNFIVSLGAMCAWLAPQAEALGVEIYPGFAAAETLHDDSGQVVGVRIGDMGIAKDGSHKSGYTAGIDIRAKVTVLAEGARGHLTKRLLKRFDLTADSDPQGYSIGIKELWQVPEGRVTPGKIVHTIGWPADNRTYGGSFVYHLDNNQIALGYVSGLDYSDPTYQPWEAFQQWKNHPMIKPLLEGGSILSAGARALVSGGWQSLPKVDMPGALLIGDTAGLLNVPKIKGTHQAIRSGMLAAEHLVQSQLAPQGFDATLRASDVMAELKQVRNIKPGFKKGLWFGLLNAAWETALKGASPWTLKNKPDWSALHKLGEYERPKRDYVTRDLAPRDRLQAVYFAATEHDEDQPVHLKVLDTDVCATRCVTEYDNPCTRFCPANVYEMVADTASPSGKRLQINAANCVHCKTCDIKDPYEIITWVTPEGGSGPNYQNL

SEQ ID NO: 100477 - DNA, 1308 bp, Rhizobium etli
  CDS (1)..(1308): transl_table=11
atgactgaggaaaacttcgacgccatagttatcggggccggcatggccggaaacgcagctgcttacacgatgtcgaaccgcggcatgaaggtgctgcagttggagcgtggcgagtatccgggctccaagaatgtgcagggcgccatcatgtacgcggacatgctggagaaaatcctgccggatttccgggatgatgcgcctctggagcggcacttagtcgagcagcgcttctggatgatggacgactcgtcccacatcggtatgcaataccggtcggacgacttcaacgagtcgagacacaatcgctacacggtcattcgcgcccaattcgacaaatggttttcacgcaaggtgcgcgaggccggagcgacgcttctatgcgagacgaccgtgacggaactcgttcgtgatccaaagggcaaggtgattggcgttcgcaccgaccgcgccggcgacgtgattcttgctgacgtggtcgttctcgcagagggcgtcaatgggctgctcggcacgcgtgctggattgcgtgacacgccaaaaccggaaactgtcgcgctcgccgtcaaggaaatgcatttcctggccgaagaggtaattgaccagcggttcggcctccaggccaatgaaggctgcgtcatcgaggcagttggcacgatctctcgcaacatggccgggcttgccttcctctacaccaacaaagaatcgatctcgatcggcattggctgccttgtctccgaattcgcggcaacaatggaaagtccttatgatctgctcgaaaaattcaaaagccatccgtcggtaaagccgctgatcgcaggagcggaagtcaaggaatatgcggcgcatctcattccagaaggtggttacaaggcaattccgcagctttttggtgacggctgggtcgtcgtcggcgacgcggcacaacttaataatgcggtgcaccgcgaggggtccaacctcgccatgacgtcggggcgcatcgccggcgaagcaatcgtccagatcaagaatcgcaaaaagccgatggtcaaggagaacctctccctttacaagtcgatgcttgaaaagtcgttcgttatcaaagacttgcggaaatacaaggacatgcctgccctgctgcacaccaattcccgcaatttcttcacgacttatccaaggttgctgtcgcaggccgcacagaactttgtgcgagtcgatggcaccccgaagatcgacaaggaacgggcgaccacgggcaccttcatcaaggcacgctcccgctgggggctgtttggtgacgcggttcgcttggcgcgcgcgtggcgataa

SEQ ID NO: 100478 - protein, 435 aa, Rhizobium etli
MTEENFDAIVIGAGMAGNAAAYTMSNRGMKVLQLERGEYPGSKNVQGAIMYADMLEKILPDFRDDAPLERHLVEQRFWMMDDSSHIGMQYRSDDFNESRHNRYTVIRAQFDKWFSRKVREAGATLLCETTVTELVRDPKGKVIGVRTDRAGDVILADVVVLAEGVNGLLGTRAGLRDTPKPETVALAVKEMHFLAEEVIDQRFGLQANEGCVIEAVGTISRNMAGLAFLYTNKESISIGIGCLVSEFAATMESPYDLLEKFKSHPSVKPLIAGAEVKEYAAHLIPEGGYKAIPQLFGDGWVVVGDAAQLNNAVHREGSNLAMTSGRIAGEAIVQIKNRKKPMVKENLSLYKSMLEKSFVIKDLRKYKDMPALLHTNSRNFFTTYPRLLSQAAQNFVRVDGTPKIDKERATTGTFIKARSRWGLFGDAVRLARAWR

SEQ ID NO: 100479 - DNA, 1692 bp, Brucella suis 1330
  CDS (1)..(1692): transl_table=11
atgtctgaagcgaacgagcttcccgaacgcgagagcatggaattcgacgtcgtgattgtcggcgcaggccctgccggtcttgcagcggcgattcgtttcaaacagataaaccccgaactttccgtggtcgtgctggaaaagggtggggaagtcggcgcgcatatcctgtcgggtgcggtggtggacccggtcggtatcgaccagcttctgcccggctggcgcgaggaggaaggccatcctttcaaaacgcctgtgacggcggaccatttcctggtgctggggcctgccggttccgtgcgcctgcccaattttgccatgccgtcgctgatgaacaaccacggcaattacatcgtttcgctcggtaatgtctgccgctggctcggcacgaaggccgaggagctgggcgtggaaatctatccgggcttcgctgcgaccgaagtactctataatgacgagggcgcggtgatcggcgttgcgacgggcgacatgggcgtcgaacgcgacggcacacgtggccctaactatacgcgcggcatggcgctgctcggtaaatatgtgctgatcggcgagggcgcgcgtggttcactcgccaagcagctcattgcgaagttcaagcttgacgagggccgcgaaccggccaagtttggcatcggcctgaaggagctttggcaggttaatccgtcgaagcacaaaccgggcctcgtgcagcattcgttcggctggccgctggacatgaaaaccggcggcggctcgttcctctatcatcttgaggacaatatggttgcggtgggctttgtgctgcacctcaattacaagaacccctatctctcgccattcgaggaattccagcgtttcaagacgcatccggccatccgcgatacgttcgagggcggcaagcgccttgcctatggcgcgcgtgcaattaccgagggcggctggcaatccgtgccgaagctttccttccccggtggcgcgctcatcggctgctcggccggttttgtcaatgtgccgcgcatcaagggcagccacaatgcgatcctgtccggcattctggccgccgacaagattgcagaggcgattgccgctggccgtgccaatgacgagccgatcgagatcgagaatagctggcgggcgagcgccattggcaaggacttgaagcgcgtgcgcaacgtcaagccgctctggtcgaagttcggcaccgctatcggcattgctctgggcggcctggatatgtggaccaaccagcttttcggcttctcgttcttcggcacgatgaagcacggcaagaccgatgcgcaggcgcttgaaccggctgcaaactacaagaagatcgactatccgaagccggatggtgtgctgacttttgaccgtctgtcgtctgtgttcctgtcgaacacgaaccacgacgaaaacgagccggtgcatttgcaagtgcgtgacatggaattgcagaagacttcggaacacgatgttttcgcaggaccgtcgacgcgctattgcccggctggtgtttatgaatgggtggatgcggacggcaatgccgctgctgatccgggcgtcaaggatgtgcgtttcgtcatcaatgcgcagaactgcgtccactgcaagacctgcgacatcaaggatccaaaccagaatatcaactgggttccgccacaaggcggcgaaggaccggtctatgtgaacatgtaa

SEQ ID NO: 100480 - protein, 563 aa, Brucella suis 1330
MSEANELPERESMEFDVVIVGAGPAGLAAAIRFKQINPELSVVVLEKGGEVGAHILSGAVVDPVGIDQLLPGWREEEGHPFKTPVTADHFLVLGPAGSVRLPNFAMPSLMNNHGNYIVSLGNVCRWLGTKAEELGVEIYPGFAATEVLYNDEGAVIGVATGDMGVERDGTRGPNYTRGMALLGKYVLIGEGARGSLAKQLIAKFKLDEGREPAKFGIGLKELWQVNPSKHKPGLVQHSFGWPLDMKTGGGSFLYHLEDNMVAVGFVLHLNYKNPYLSPFEEFQRFKTHPAIRDTFEGGKRLAYGARAITEGGWQSVPKLSFPGGALIGCSAGFVNVPRIKGSHNAILSGILAADKIAEAIAAGRANDEPIEIENSWRASAIGKDLKRVRNVKPLWSKFGTAIGIALGGLDMWTNQLFGFSFFGTMKHGKTDAQALEPAANYKKIDYPKPDGVLTFDRLSSVFLSNTNHDENEPVHLQVRDMELQKTSEHDVFAGPSTRYCPAGVYEWVDADGNAAADPGVKDVRFVINAQNCVHCKTCDIKDPNQNINWVPPQGGEGPVYVNM

SEQ ID NO: 100481 - DNA, 1302 bp, Shigella flexneri 2a str. 301
  CDS (1)..(1302): transl_table=11
gtgttgtgttctggatatctggggcatgacatggaagacgactgcgacattattattattggtgccggtattgcaggcaccgcttgcgcgttacgctgcgcgcgagcggatttatccgttttgttactcgaacgcgctgaaatccccggcagcaaaaatctttccggcaggcggttatatacccatgcactcgcggaactcctcccgcaatttcatctgaccgcgcctcttgaacgacgcatcactcacgaaagcctttccctgttaacgccggatggcgcaacgacgttttccagcttacagcccggcggtgaatcctggagtgtattacgtgcacggttcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcggaatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcacgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcacaggcggcggcacaaacgctaataagcgcctgccagcaccgcgagccgcaaaatctgtttgcgctttatcatcacaacgtagagcgcagcctgctatgggatgttctacaacgttatcagcatgttccggcgcttttgcaacgccctggcaggtatcgggcgtggcctgcgttaatgcaggatatttcccgcgatttatgggatcagggtgataaacctgttccaccgctgcgccagttattctggcatcatttacgtcgtcatggcctgtggcatctggcgggcgatgttatcaggagtctgcgatgtctgtag

SEQ ID NO: 100482 - protein, 433 aa, Shigella flexneri 2a str. 301
MLCSGYLGHDMEDDCDIIIIGAGIAGTACALRCARADLSVLLLERAEIPGSKNLSGRRLYTHALAELLPQFHLTAPLERRITHESLSLLTPDGATTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGGICDDLPGGAFLYTNQQTLSLGIVCPLSSLTQSRVPASELLTRFKAHPAVRTLIKNTESLEYGAHLVPEGGLHSMPVQYAGNGWLLVGDALRSCVNTGISVRGMDMALTGAQAAAQTLISACQHREPQNLFALYHHNVERSLLWDVLQRYQHVPALLQRPGRYRAWPALMQDISRDLWDQGDKPVPPLRQLFWHHLRRHGLWHLAGDVIRSLRCL

SEQ ID NO: 100483 - DNA, 1650 bp, Shewanella oneidensis MR-1
  CDS (1)..(1650): transl_table=11
atggaacgcgaatcaatggaattcgatgttgttatcgtcggcgcgggccctgcgggcttggcgactgcgtgtcgattaatgcagatatcacaggattcaggtaaagaaattaccgtctgcgtggtagaaaaaggctccgaagtgggcgcgcatattctatcaggcgccgtattcgaacccagagtgttagatgagctattcagcgactggcgtgacaacggcgcccctgttaccacagcggtgacccacgatgaaatctatctactcagctcagagaccgatagcaaacttatgcccaatgcgtttgtgccaaaaaccatgcacaacgaaggcaactatattgttagcgtcggcaacctctgccgctggctcgcaacccgcgctgaagcacttggcgtagaaatattccccggctttgcggccagcgaattgctcttcaatgaggacaatagcgttaaaggtattttgattggcgacatgggcgtaggcgccgatggccaaccaaaagacagctttatgcccggcatggagctgcatgcaaaatataccgtattctcagaaggttgccgcgggcatttaggcaaacagctgatcgcgaaataccatttagataatggcaaaacgccgcaacactacggcctaggttttaaagaaatttggaaagtccccgccgagcaacacgagcaaggtaaagtggtgcatacgggtggctggccattaaccgatggcgcatcgggtggcggcttcctctatcatatggaagacaatcaaattgcagtggggttaattatcgacctcaactacaagaacccacacttaagcccgttcgatgagtttcaacgttataaaactcaccctgttatcgcgaaatatttagcaggcggcgagcgtctgacctatggcgcacgtgcaattaccaagggcggcctgaactcactgccgaagatgagcttccccggcggcctgctaattggttgcgatgcaggcaccttaaactttgccaagattaaaggcacacatacagcgatgaagagcggtatagtcgcggccgaaaccttagctaaagccatgatggccgaggtcgaaggcggtaaggatcttgactgctaccaaacccatctagaagaaagctggctgtatgaggagctgtataagtctcgtaattttggcccagcgatgcacaagtttggcaccttccttggtggcgcctttaactacatagatcaaaactggtttggcggtaagttccctatcactttgcgtgatgagcatcctgactacgcgcaaatggcgccggttagcgcctacagcaagattgattaccccaaacctgacggcaaactcagcttcgataaactctcctcagtttatctgtcgagtacctatcatgaggaagatcagccctgccacctgcgtctcaaagacaacagcattccgctcgggatcaacctgacgcaatttaacgaacccgcccagcgctactgtcctgctggcgtatacgaaattgttgaagaagcaggcaagcccaagtttgtcatcaatgcacaaaactgtatccactgcaaaacctgcgatattaaagacccaagccaaaatatcacttgggttaccccagagggtggcggtggtcctaattatccgaatatgtaa

SEQ ID NO: 100484 - protein, 549 aa, Shewanella oneidensis MR-1
MERESMEFDVVIVGAGPAGLATACRLMQISQDSGKEITVCVVEKGSEVGAHILSGAVFEPRVLDELFSDWRDNGAPVTTAVTHDEIYLLSSETDSKLMPNAFVPKTMHNEGNYIVSVGNLCRWLATRAEALGVEIFPGFAASELLFNEDNSVKGILIGDMGVGADGQPKDSFMPGMELHAKYTVFSEGCRGHLGKQLIAKYHLDNGKTPQHYGLGFKEIWKVPAEQHEQGKVVHTGGWPLTDGASGGGFLYHMEDNQIAVGLIIDLNYKNPHLSPFDEFQRYKTHPVIAKYLAGGERLTYGARAITKGGLNSLPKMSFPGGLLIGCDAGTLNFAKIKGTHTAMKSGIVAAETLAKAMMAEVEGGKDLDCYQTHLEESWLYEELYKSRNFGPAMHKFGTFLGGAFNYIDQNWFGGKFPITLRDEHPDYAQMAPVSAYSKIDYPKPDGKLSFDKLSSVYLSSTYHEEDQPCHLRLKDNSIPLGINLTQFNEPAQRYCPAGVYEIVEEAGKPKFVINAQNCIHCKTCDIKDPSQNITWVTPEGGGGPNYPNM

SEQ ID NO: 100485 - DNA, 1683 bp, Pseudomonas putida KT2440
  CDS (1)..(1683): transl_table=11
atgagtaggagagaaccagtggaacgcgaatacatggaattcgacgtggtcatcgtcggcgccggcccggcgggcctgtccgccgcctgccgcctgaagcagaaggccgccgaagccggtagcgaaatcagcgtctgcgtggtggagaaaggctctgaagtcggcgcccacatcctctctggcgcagtgttcgagccccgcgccctgaacgagctgttccccgactggaaagagctcggtgcaccgctgaacaccgaagtgaagcgcgacgacatctacgtactcaaggatgccggcagcgcgaccaaggtgcctgacctgttcgtgcccaagaccatgcacaaccatggcaactacatcatctcgctgggcaacctgtgccgctggctggcccagcaggccgaaaacctcggcgtggaaatctacccgggcttcgccgcccaggaagcgctgttcgacgacaacggcgtggttcgcggcatcgtcaccggcgacctcggtgtcgaccgcgaaggcaacccgaaagacggcctgtataccccgggcatggaactgcgtgccaagtacaccctgttcgccgaaggctgccgtgggcatatcggcaagcagctgatcaagcgcttcaacctcgacagcgagtccgacgtccagcactacggcatcggcttgaaggaaatctgggaaatcgacccggccaagcacgagcaaggcctggtggtgcacaccgccggctggccgctggacgtggtggccaaggaaaacaccggtggctcgttcctttatcacctggaaaacaaccaggtggtggtcggcctgatcgtcgacctgtcctacgccaacccctacctgtcgccgttcgacgaattccagcgcctcaagcaccacccggtgatcagccagtacctcgaaggcggcaagcgcatcagctacggcgcccgcgccttggccaagggcggcatcaactcgctgccgaaaatggtcttcaatggtggcgcgctgatcggttgcgacctgggcaccatgaacgtggccaagatcaagggcagccataccgcgatgaagtccggcatgctcgccgccgaagcagtggccgacgctttgatcgccggtagcgaaggcggcgatcaattgaacagctatgtcagcgccttcaaggccagctggctgtacgaagaactgttcgccagccgcaacttcggcccggccatgcacaagttcggcccgctgctgggcgcggcgttcaactatgtcgaccagaactggttcggtggcaagctgccgttcaccctgcatgacaccaagccggactatgcctgcctcaagctggccgccgattcgaaaaagatcgactacccgaaaccggacggcaagctcagcttcgacaagctcagctcggtattcctctccagcaccaaccacgaagaggaacaaccctgccacctgaagctgaccgatccgagcgtaccgatcgccagcaacctgccgctgtacgacgagccagcccagcgctactgcccggccggcgtgtacgaagtggtcacccaggaagacggcaacaagcgtttccagatcaacgcgcagaactgcgtgcactgcaagacctgcgacatcaaggacccggcccagaacatcacctgggtcacccctgaaggcgctggcgggccgaactatccgaacatgtaa

SEQ ID NO: 100486 - protein, 560 aa, Pseudomonas putida KT2440
MSRREPVEREYMEFDVVIVGAGPAGLSAACRLKQKAAEAGSEISVCVVEKGSEVGAHILSGAVFEPRALNELFPDWKELGAPLNTEVKRDDIYVLKDAGSATKVPDLFVPKTMHNHGNYIISLGNLCRWLAQQAENLGVEIYPGFAAQEALFDDNGVVRGIVTGDLGVDREGNPKDGLYTPGMELRAKYTLFAEGCRGHIGKQLIKRFNLDSESDVQHYGIGLKEIWEIDPAKHEQGLVVHTAGWPLDVVAKENTGGSFLYHLENNQVVVGLIVDLSYANPYLSPFDEFQRLKHHPVISQYLEGGKRISYGARALAKGGINSLPKMVFNGGALIGCDLGTMNVAKIKGSHTAMKSGMLAAEAVADALIAGSEGGDQLNSYVSAFKASWLYEELFASRNFGPAMHKFGPLLGAAFNYVDQNWFGGKLPFTLHDTKPDYACLKLAADSKKIDYPKPDGKLSFDKLSSVFLSSTNHEEEQPCHLKLTDPSVPIASNLPLYDEPAQRYCPAGVYEVVTQEDGNKRFQINAQNCVHCKTCDIKDPAQNITWVTPEGAGGPNYPNM

SEQ ID NO: 100487 - DNA, 1290 bp, Escherichia coli CFT073
  CDS (1)..(1290): transl_table=11
atgtcggatgacaaatttgatgccattgtggtcggtgcgggcgttgccggtagcgttgccgcactggtcatggcgcgagccgggctggatgtcctggtgatagaacgcggcgacagtgccggatgtaaaaacatgaccggcgggcgtctttatgcccacacacttgaagcaattattccaggctttgcagcatcagcgccggtagaacgcaaggtcacacgcgagaaaatctccttcttaaccgaagaaagcgccgttaccctcgattttcaccgcgagcaaccagatgttccgcaacacgcgtcttataccgtattgcgtaatcgtctggacccgtggttgatggaacaagccgagcaggcgggcgcgcagtttatcccgggcgtacgcgtcgatgcgctggttcgtgaaggaaacaaggtcactggcgtccaggccggggatgatattctcgaagcgaatgtggtgattctggctgatggcgttaactcgatgcttggccgctcgctgggaatggtttccgcttccgatccgcatcattacgctgttggtgttaaagaggttataggtctgacaccagaacagatcaacgatcgctttaatgttacgggcgaggaaggtgccgcctggctgtttgccggttccccttctgacggcctgatgggcggcggattcctctataccaacaaagattccgtatcgttggggctggtttgtggattgagtgatatcgcccatgcgcaaaaaagcgtgccgcaaatgctggaagattttaaacaacaccccgccattcgcccgctgattagcggcggcaaactgcttgaatattccgcgcatatggtgccggagggcggtctggcaatggtgccgcagctggttaacgatggcgtgatgatcgttggtgacgccgcaggcttctgcctgaatttgggttttacagttcgcggcatggatttagccattgcatcagctcaggctgccgccacaacggtgatcgccgccaaagaacgcgcggatttctccgccagcagtctggcgcaatacaaacgtgagctggaacaaagttgtgttatgcgcgatatgcagcatttccgcaagatcccggcgctgatggaaaacccgcgcctgtttagccaatacccacgaatggtcgccgacatcatgaacgatatgttcaccattgacggcaaaccaaaccagccggtacgcaaaatgatcatgggacacgcgaagaaaattgggctgatcaacttgctgaaagatggcattaagggagcaaccgcgctatga

SEQ ID NO: 100488 - protein, 429 aa, Escherichia coli CFT073
MSDDKFDAIVVGAGVAGSVAALVMARAGLDVLVIERGDSAGCKNMTGGRLYAHTLEAIIPGFAASAPVERKVTREKISFLTEESAVTLDFHREQPDVPQHASYTVLRNRLDPWLMEQAEQAGAQFIPGVRVDALVREGNKVTGVQAGDDILEANVVILADGVNSMLGRSLGMVSASDPHHYAVGVKEVIGLTPEQINDRFNVTGEEGAAWLFAGSPSDGLMGGGFLYTNKDSVSLGLVCGLSDIAHAQKSVPQMLEDFKQHPAIRPLISGGKLLEYSAHMVPEGGLAMVPQLVNDGVMIVGDAAGFCLNLGFTVRGMDLAIASAQAAATTVIAAKERADFSASSLAQYKRELEQSCVMRDMQHFRKIPALMENPRLFSQYPRMVADIMNDMFTIDGKPNQPVRKMIMGHAKKIGLINLLKDGIKGATAL

SEQ ID NO: 100489 - DNA, 1302 bp, Escherichia coli CFT073
  CDS (1)..(1302): transl_table=11
gtgttgtgttctggatatctggggcatgacatggaagacgactgcgacattattattatcggtgccggaattgctggcaccgcttgcgcgttacgctgcgcgcgagcgggtttatccgttttgttactggaacgagcggagattcccggcagcaaaaatctttccggcgggcggctatacacccatgcgctcgcggaactcctcccgcaatttcacctgaccgcgccccttgaacgacgcatcactcacgaaagtctttctctgttaacgccagatggcgcaacgacgttttccagcttacagcccggcggtgaatcctggagtgtattacgtgcacgattcgatccgtggctggttgccgaagccgaaaaagaaggtgtcgaatgcatccccggtgcgacggtagatgcactgtatgaagaaaacggcagggtgtgtggtgtcatttgtggtgacgatattcttcgcgcccgttatgtggtgctggcagaaggtgccaacagcgtcctggcggaacgccacgggttagtgactcgtcctgctggcgaagcgatggcattggggatcaaagaagcgctggcgctggaaccatccgctattgaagaacgttttcatctggagaataacgaaggcgcagcgttgctgttcagcggcgggatctgtgatgacttacccggcggcgcatttctttatactaatcaacaaacgctctcgttagggattgtttgcccgctctcctcccttacgcaaagtcgtgttccggcaagcgagctgctgactcgctttaaaacgcatccggcagtgcgcccgcttatcaaaaacacggaatcactggagtatggtgcgcatctggtgccagaaggtggcctgcgcagtatgccggtgcaatacgccggtaacggctggctgctggtgggcgatgcgttgcgcagttgcgtcaataccggaatttccgtgcgcggtatggatatggcgctaactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgccctggctggtatcgagtgtggcctgggttaatgcaggatatttcccgtgatttatgggatcaggggaatacacctgttccaccgctgcgccagttgctctggcgtcatttacgtcgtcacggcttgtggcatctgacgggcgatgttatcaggagtctacgatgtctgtag

SEQ ID NO: 100490 - protein, 433 aa, Escherichia coli CFT073
MLCSGYLGHDMEDDCDIIIIGAGIAGTACALRCARAGLSVLLLERAEIPGSKNLSGGRLYTHALAELLPQFHLTAPLERRITHESLSLLTPDGATTFSSLQPGGESWSVLRARFDPWLVAEAEKEGVECIPGATVDALYEENGRVCGVICGDDILRARYVVLAEGANSVLAERHGLVTRPAGEAMALGIKEALALEPSAIEERFHLENNEGAALLFSGGICDDLPGGAFLYTNQQTLSLGIVCPLSSLTQSRVPASELLTRFKTHPAVRPLIKNTESLEYGAHLVPEGGLRSMPVQYAGNGWLLVGDALRSCVNTGISVRGMDMALTGAQAAAQTLISACQHREPQNLFPLYHHNVERSLLWDVLQRYQHVPALLQRPGWYRVWPGLMQDISRDLWDQGNTPVPPLRQLLWRHLRRHGLWHLTGDVIRSLRCL

SEQ ID NO: 100491 - DNA, 1653 bp, Vibrio vulnificus CMCP6
  CDS (1)..(1653): transl_table=11
atggaattcgacgtggttatcgttggtgcggggccagctggtctgtcagccgcttgtcgtttggcgcaactcgcccaagcctccaatcaaagcctctccatttgtgtgttagaaaagggctcagaagtgggtgcgcatatcctttctggcgcactgtttgaaactcgcgcattggcagaactttttcccgattggcaggatcaaggggcgccagtcgacacgcccatcacgcaagatcgcctgctttacctcactaccgagcataaccacattgaagtgcctgcctttctggtgcctaaatcacttcataatagcagtgacaactatgtggtcagtttgggtaatctctgccgctggttggccaaacaagcagaagccctcggtgtagaggtgtttgctggctttcccgctaaagaggtggtaattaatgaaagtgacattgtcactggtgtcattaccaccgacatgggcctagacaagcaatctcagcctaaagcaggatttgaagcgggcatcgagctaaaagcgcgctttaccgtgtttgccgaaggcgcgcgtggtcatttgggtaaacaactgattgagcactttgctctcgaccaaggaaagccgccacaacactacgctctagggatcaaagaaatttggcaactgcctcaagagaacccagcctatcaagcaggccacgtcacccactttgctggctggcctttaagtgacactgacagccaaggggggggctttctataccatatggataatcatcaagtttgcgttggtttgatcacagacctgaactacagcaacccctacctcagtccatttgaagaatttcaacgcatgaagcatcaccccgctatcgcctcgctattgcaaggcgcggagcgcgtcgcttacggtgccagagccatcaccaagggcgggctgcattcactgcccaagcagcagtttgctggaggattactgattggttgcgatgctggcaccctaaatagtggcaagatcaagggctgccatacggcgatgaaatcgggcatgctcgccgctgaggccattttcaaggcgtggcaatcgcccgagcaaaatactgaagcggactatcaaagtgaatttgaacaatcttggctttttgatgagctcgcgcagacgaaaaacttctctgccgccctacatcgctacgggccgctcgttggtggggctctgaatacctttgaacaaaatctctggtatcctctcaccgggcaggcccccagttggcatattgtggatgatagagcggatcacctttgtttggatgagtgcgccgttgtcactcccattgcgtacccaaaagcggatggagtattgagctttgacaaaccctcatcactttatctttccgccactcagcatgaggaaaatcagccctgccacctgatggtaaacgatctcgacacggcactcaaacgccacctgaatttgtacgatgagcctgcacaacgctattgccccgctggtgtgtatgaggttatcgaaggcgaaagtggtccctatttgcaaattaatgccgccaactgtttacactgtaaaacctgcgacatcaaagatccgtcagggaacattacgtggacaccaccagaaggcggtggtggaccgaactaccaaaatatgtaa

SEQ ID NO: 100492 - protein, 550 aa, Vibrio vulnificus CMCP6
MEFDVVIVGAGPAGLSAACRLAQLAQASNQSLSICVLEKGSEVGAHILSGALFETRALAELFPDWQDQGAPVDTPITQDRLLYLTTEHNHIEVPAFLVPKSLHNSSDNYVVSLGNLCRWLAKQAEALGVEVFAGFPAKEVVINESDIVTGVITTDMGLDKQSQPKAGFEAGIELKARFTVFAEGARGHLGKQLIEHFALDQGKPPQHYALGIKEIWQLPQENPAYQAGHVTHFAGWPLSDTDSQGGGFLYHMDNHQVCVGLITDLNYSNPYLSPFEEFQRMKHHPAIASLLQGAERVAYGARAITKGGLHSLPKQQFAGGLLIGCDAGTLNSGKIKGCHTAMKSGMLAAEAIFKAWQSPEQNTEADYQSEFEQSWLFDELAQTKNFSAALHRYGPLVGGALNTFEQNLWYPLTGQAPSWHIVDDRADHLCLDECAVVTPIAYPKADGVLSFDKPSSLYLSATQHEENQPCHLMVNDLDTALKRHLNLYDEPAQRYCPAGVYEVIEGESGPYLQINAANCLHCKTCDIKDPSGNITWTPPEGGGGPNYQNM

SEQ ID NO: 100493 - DNA, 1662 bp, Bradyrhizobium japonicum USDA 110
  CDS (1)..(1662)
atgagcaccgaagaacttcccccgcgcgaatccatggaattcgacgtcgtcattgtcggcgccggcccctcgggcctgtcggccgcgatccggctgaagcagctcaacgccgatctcaacgtcgtcgtggtggagaagggctccgaggtcggcgcgcatattctctccggcgccgtgatcgatccggccgggctcgacaagcttgttcccgactggcgcgaggattccgactgtccgctgaagacgcaggtgaaggacgaccgcttctactggatgacgggcggcggcgcgatcaagctgccgaacttcatgatgccgcccctgatggacaaccatcactgctacatcggttcgctcggcaatgtctgccgctggctggcgcgcaaggccgaggcgctcggcgtcgagatctatccgggcttcgccgcggccgaggtgctctatgacgaggagggcagggtcaggggtatcgccaccggcgacatgggcatcggccgcgacggcaagccgaaggactcctttacccgcggcatggaattgctaggaaaatacacgctgttcgccgaaggcgcccgaggcagcctgaccaagcagctgattgcgaagttcgcgctcgacgccaagagcgagccggcgaagttcggtatcgggttgaaggaagtctggcagatcgatcccgccaagcaccagaagggtatgatccagcattcattcggctggccgctcgacctgaagaccggcggtggttcgttcctctatcactacgacgacaatctcgtcgccgtcggcttcgtcgtgcatctgaactacgacgatccctatttgtcgccgttcgacgagttccagcgcttcaagacccatccgtcgatccgcggcaccttcgagggcggcaagcggctcgcctatggcgcgcgcgccatcaccgagggcggctatcagtcagtgccgaaactgagcttccccggcggcgcgctgatcggctgcgcggccggcttcgtcaacgtcccgcgcatcaagggcgtgcacaatgcgatgggcaccggcatgctggccgccgagcatgtcgcagcagcgcttgcggccgatcgcgccaatgacgagatcgtcgagtacgagaacgcgtggcgttcctcctccgtgggcaaggacctctttctggtccgcaacgtcaaaccgctgtggtcgaagttcggcaccgtgctcggcgtcgcgctcggcggactcgacatgtggtgcaacacgctgttcggcgcctcgctgttcggtacccagtcgcattccaagcccgatcgcgcgacgctcgatccggccaagagccacgcgccgaggaactacccgaagccggacggcaagatctcgttcgacaagctgtcgtcggtattcctgtccaacaccaatcacgaggaggaccagccggtccatctccgggttgccgacatgaacctccagaagacctccgagcacgacgtgttcgccggtccctcgaatcgctattgcccggccggcgtctacgagtgggtcgaggagggtgcgagcccgcgctaccagatcaacgcccagaactgcgtccactgcaaaacctgcgacgtgaaggaccccaacggcaacatcacctgggttcccccggagggcggcggcggtccgaactacgaggcgatgtaa

SEQ ID NO: 100494 - protein, 553 aa, Bradyrhizobium japonicum USDA 110
MSTEELPPRESMEFDVVIVGAGPSGLSAAIRLKQLNADLNVVVVEKGSEVGAHILSGAVIDPAGLDKLVPDWREDSDCPLKTQVKDDRFYWMTGGGAIKLPNFMMPPLMDNHHCYIGSLGNVCRWLARKAEALGVEIYPGFAAAEVLYDEEGRVRGIATGDMGIGRDGKPKDSFTRGMELLGKYTLFAEGARGSLTKQLIAKFALDAKSEPAKFGIGLKEVWQIDPAKHQKGMIQHSFGWPLDLKTGGGSFLYHYDDNLVAVGFVVHLNYDDPYLSPFDEFQRFKTHPSIRGTFEGGKRLAYGARAITEGGYQSVPKLSFPGGALIGCAAGFVNVPRIKGVHNAMGTGMLAAEHVAAALAADRANDEIVEYENAWRSSSVGKDLFLVRNVKPLWSKFGTVLGVALGGLDMWCNTLFGASLFGTQSHSKPDRATLDPAKSHAPRNYPKPDGKISFDKLSSVFLSNTNHEEDQPVHLRVADMNLQKTSEHDVFAGPSNRYCPAGVYEWVEEGASPRYQINAQNCVHCKTCDVKDPNGNITWVPPEGGGGPNYEAM

SEQ ID NO: 100495 - DNA, 1647 bp, Xylella fastidiosa Temecula1
  CDS (1)..(1647): transl_table=11
atgttggcagcgaaacaggagacagaaacaaacaccattgagcgtgacgtcatggaatacgacgttgtcaccgtcggctctggcccagcaggcttagcttttgcaatccgcctgaaacaactcaaccctgccttgtcggtatgcgtgatcgaaaaatccagcacaatcggcggacatattctctctggcgcagtgatcgaacctgcccccctggatagcctactccctggctggcgcaacgccccacctccaatctgcgtccctgcaaccgaggacgaattctggctcctgagcaaaaatggcgcatacaaatttccgatcatgccgccgagcttgcgcaaccacggtaacgtgatcgtcagccttggcgcactatgcgcctggttagcacctcaagccgagacactgggcgtagacatttacccaggcttctccgccactgaaaccctgcacgacgcggctggccaagtcattggagtgcgcattggcgacatgggtatcgctaaaaacggaacacacaaacctagcttcaccccaggcattgcaatcaaggcaaaggtcacagtacttgccgaaggcgcacgcggccacctgaccaaacacctgattaaacatttctcactagatcaaaacagtgatccgcaaacctactccatcggaatcaaagaactatggcacgtcccagaaaaacgtagctctccaggcaaaatcttacataccctcggctggccagccgatacacatacctacggaggtggctttctctatcacctgaatgacaatcgcatcgcactaggttatgtcagcggcctggactatcacgacccaaggtacgaaccctgggaagcattccagcaatggaaaaaccacccactcatcaaaccgcttctggaaagtggtgacctcctatcgggcggcgcacgtgcaatcgtcactggcggctggcaatccctccccaaagtggacatgccaggcgcactgttgatcggtgacactgccggcttactcaacgtccctaagatcaagggaacacaccaagcaatccgcagcggcatgctcgccgccgaacatctcgtcgccacccaactcatcccctatggatttgatgccaaactgcgtgcttcaaaggcaatgaccgaattaaaacaagtacgcaatatcaagccaggtttcaaaaaaggcttatggttgggcctactgaacgccgcctgggagacagctacccgtggcgcttctccatggacattgaaaaacacaccagactgggccgcactgcaacggctcgacaaaaaccaacaaacaaaacacgactacgtacaacgcaccttaccgccacgcgaccgcctgcatagcgtctacttcgcggccactgtgcacaatgaagatcaacccatccatctaaaagtcaccgaccccgaacgatgcgtcacacgctgcgtagaggaatacggcaatccatgcacccgcttctgtccggccaacgtctaccaaatcattgaggaccccaactcagcaaccaacaaacgcttacacatcaatgcagccaactgcgtgcactgtaaaacctgtgacatcaaagatccgtaccagattatcgactggatcaccccagaaggcggatcaggcccaaattatcaaaacctataa

SEQ ID NO: 100496 - protein, 548 aa, Xylella fastidiosa Temecula1
MLAAKQETETNTIERDVMEYDVVTVGSGPAGLAFAIRLKQLNPALSVCVIEKSSTIGGHILSGAVIEPAPLDSLLPGWRNAPPPICVPATEDEFWLLSKNGAYKFPIMPPSLRNHGNVIVSLGALCAWLAPQAETLGVDIYPGFSATETLHDAAGQVIGVRIGDMGIAKNGTHKPSFTPGIAIKAKVTVLAEGARGHLTKHLIKHFSLDQNSDPQTYSIGIKELWHVPEKRSSPGKILHTLGWPADTHTYGGGFLYHLNDNRIALGYVSGLDYHDPRYEPWEAFQQWKNHPLIKPLLESGDLLSGGARAIVTGGWQSLPKVDMPGALLIGDTAGLLNVPKIKGTHQAIRSGMLAAEHLVATQLIPYGFDAKLRASKAMTELKQVRNIKPGFKKGLWLGLLNAAWETATRGASPWTLKNTPDWAALQRLDKNQQTKHDYVQRTLPPRDRLHSVYFAATVHNEDQPIHLKVTDPERCVTRCVEEYGNPCTRFCPANVYQIIEDPNSATNKRLHINAANCVHCKTCDIKDPYQIIDWITPEGGSGPNYQNL

SEQ ID NO: 100497 - DNA, 1662 bp, Vibrio parahaemolyticus RIMD 2210633
  CDS (1)..(1662): transl_table=11
atggaacgtgaatgcatggagtttgatgtggtgatcgtcggagctggccctgcggggttaagtgcagcatgtcgattagcacagttgaaccaagatcgtgaaggcgaagcgctgtcaatttgtgtggtagaaaaaggctctgaggtcggcgcacatatattatctggcgcggtgtttgaaactcgcgccttagatgagctcttcccaaattggaaggaaatgggagcacccgtttctgcccccgttcaacatgatgattttctctatctaacgacggagcttaatcatatacgtgtgccccacttcctcacgcctaaacccatgcataatgacgaaaacaatcacgttattagccttgctaatctgtgtcgctggcttgctactcaagctgagcagctcggtgttgaagtatttcctggttttgccgctgcgagcgttaactacgatgaatcaggtgccgttactggaatcaccaccagcgatatggggctggataaaaacggacaagagaaagccaatttcgaaccgggcattgagcttaaagccaaatacacgctgtttgctgaagggtgccgtgggcatttaggaaaagagctcattcgtcatttcgatttggatgcaggcaaacaacctcagcattacgcattaggcttgaaagagatttgggagctgccggctgatgcgaaagattttactggcaacgtcatccactccgccggttggccattgagcgaaaccaacgcaactggtggtggattcctctatcacttggaaaaccgccaaattgcggtcgggttgattgtcgatcttaactatcgcaatccccacttgagcccattcgatgagtttcagcgctttaaacaccaccctgcaatcaaaaaatacattaaaggagcgcagcgcatcgcttatggcgcaagagccatcgcaaaaggtgggttatcttctttacctaaacaacaatttcccggcggtttattaattggctgtgacgcaggaacacttaacgttgcgaagataaaaggcagccacaccgcaatgaaatcaggcttactagcagcagaagccattcatcaagcattacaagactcaaggtgtgaacctgattatcaatcgcgatttgaagcctcttggcagtacgatgaactcgccgaaacgcgtaactttggagcgaacctgcataagttcggtagcctgtttggcggagctctttctaccttcgaacacaacttgtggcttcctctgattaaaaagccaataccgtggacagtgaaagaccattcccacgatcacgaacagttaaaacccaaaaatgaatgcccgccgattgagtatccaaaaccggatggagaaatcagctttgataaaccatcttcggtgtttttatccggcacacaacatgaagaaaaccaaccctgccatcttgttttgacttatcctcatatccccatcgatgtgcacctcgggttgtttgatgagccaagccagcgttactgccctgccggggtttacgaagtggtcgaaattgatgggaaagtgaagtttcaaatcaacgctgcgaactgcgtacattgtaaaacgtgcgatataaaagatccgtcacaaaacattacgtggaagacgcctgaaggcggtggcgggcctaattatcagaatatgtag

SEQ ID NO: 100498 - protein, 553 aa, Vibrio parahaemolyticus RIMD 2210633
MERECMEFDVVIVGAGPAGLSAACRLAQLNQDREGEALSICVVEKGSEVGAHILSGAVFETRALDELFPNWKEMGAPVSAPVQHDDFLYLTTELNHIRVPHFLTPKPMHNDENNHVISLANLCRWLATQAEQLGVEVFPGFAAASVNYDESGAVTGITTSDMGLDKNGQEKANFEPGIELKAKYTLFAEGCRGHLGKELIRHFDLDAGKQPQHYALGLKEIWELPADAKDFTGNVIHSAGWPLSETNATGGGFLYHLENRQIAVGLIVDLNYRNPHLSPFDEFQRFKHHPAIKKYIKGAQRIAYGARAIAKGGLSSLPKQQFPGGLLIGCDAGTLNVAKIKGSHTAMKSGLLAAEAIHQALQDSRCEPDYQSRFEASWQYDELAETRNFGANLHKFGSLFGGALSTFEHNLWLPLIKKPIPWTVKDHSHDHEQLKPKNECPPIEYPKPDGEISFDKPSSVFLSGTQHEENQPCHLVLTYPHIPIDVHLGLFDEPSQRYCPAGVYEVVEIDGKVKFQINAANCVHCKTCDIKDPSQNITWKTPEGGGGPNYQNM

SEQ ID NO: 100499 - DNA, 1638 bp, Vibrio parahaemolyticus RIMD 2210633
  CDS (1)..(1638): transl_table=11
atggaaagagactgcatggagtttgatgttctgattgttggtgcgggcccggcgggcttgtctgctgcctgtcgcgtcaaacagttggcaatggaaaaagaccaagaaatctcagtttgtgttgtagagaaaggttcggaagtgggggcgcacattctctctggcgcggtgtttgaaacgcgcagtttggatgagttgtttccggattggaaagaaaaggacgcgccgctcaataccaaagtcaatcaagataaaacttactatttaagtaacgaacttaatggccatgaactgccaacgtgggcggtgccgaatacgctgcataacgatggtaattacatcatcagtttaggtaatttgtgccgttggatggcatcgcaagcagaaaacctaggcgtagaaatctaccctggctttagtgctaaccgagccattattgatgaacaaaaccgtgtttgtggcgtgatcacaggagatatggggctcgacaaaaacggcgagcaaaaagccaatttcgagccgggtatcgaacttcgcgctaagtttacgctgtttgccgaaggtgccagaggtcatattggtaagcaattgattaacaaatttaatctcgctgaagataaaacgccacagcactatgcgattggctttaaagagctgtgggaaatacctgcagagcaacatcagcaaggattggttgttcatggattaggttggccgttggcaaacgaagcaattggtggcagttatctttatcatcttgagggcaaccaagtcgcagttggcctgattgttgaccttaattacgaaaatccccacctgagtccgtttgacgaatttcaacgttttaaacatcacccgatgattgaacagtacctgaaacacggtaagcgcatcagctatggggctagggcgattgccaaaggcggctttcattcccttccgacccaacaatttgcgggtggactattgattggctgtgatgctggcacgctcaatagcgcgaaaatcaaaggcacgcataccgcgatgaagtcgggaatactcgccgctgaagccgtttttgaagcggtttcaaatcaatcggttattgccgactaccaaagccatttcaaacagtcctggctatatgaagagctttatcaagcacgcaatttctctagcggaatacaccgttttggatcttggttaggtggtggtttagcgatgttggaacacaacgtgttaaaaggcaaagcaaagtggaatgtacgttgtgaacatcccgatcatcagtctttgattctggcggaaaacagcgatgagatcctctatccgaagcctgatggcgtgttgagttttgaccgtctttcttccgtctatttatccaatattttccatgaagaagaccaaccgtgtcatttgcagcttgccagccagcgcattcctatcgaacagaacttggcgctctatgccgagcccgctcaacgctactgtcctgctggggtgtatgaaattgtagaaggtgcagagcaagccgaattacagattaatgcggcgaactgtattcactgtaaaacctgcgatatcaaagacccaagtcaaaacatcacctggacgcctcctgaaggcggtggtggtcccaactacccaaatatgtag

SEQ ID NO: 100500 - protein, 545 aa, Vibrio parahaemolyticus RIMD 2210633
MERDCMEFDVLIVGAGPAGLSAACRVKQLAMEKDQEISVCVVEKGSEVGAHILSGAVFETRSLDELFPDWKEKDAPLNTKVNQDKTYYLSNELNGHELPTWAVPNTLHNDGNYIISLGNLCRWMASQAENLGVEIYPGFSANRAIIDEQNRVCGVITGDMGLDKNGEQKANFEPGIELRAKFTLFAEGARGHIGKQLINKFNLAEDKTPQHYAIGFKELWEIPAEQHQQGLVVHGLGWPLANEAIGGSYLYHLEGNQVAVGLIVDLNYENPHLSPFDEFQRFKHHPMIEQYLKHGKRISYGARAIAKGGFHSLPTQQFAGGLLIGCDAGTLNSAKIKGTHTAMKSGILAAEAVFEAVSNQSVIADYQSHFKQSWLYEELYQARNFSSGIHRFGSWLGGGLAMLEHNVLKGKAKWNVRCEHPDHQSLILAENSDEILYPKPDGVLSFDRLSSVYLSNIFHEEDQPCHLQLASQRIPIEQNLALYAEPAQRYCPAGVYEIVEGAEQAELQINAANCIHCKTCDIKDPSQNITWTPPEGGGGPNYPNM

SEQ ID NO: 100501 - DNA, 1626 bp, Coxiella burnetii RSA 493
  CDS (1)..(1626): transl_table=11
atggaaaaaacttttcaacgagaatcattagaatttgacgttttgatcgtgggcgcggggccggcgggtttgagtgcggcgattcgactggctcaagaaaaccgttcgctttccatcgccgttcttgaaaaaggcgcctccgttggagcgcatattttatctggggccattttagaacctcgcgctttaaacgagcttattcctgattggagtaaacgcaatgcccccgttcatgtggccgttcaagaagaccaattttatttactcaccgcgaaaaaatcttttcgtttaccaaccccaattaccatgagaaattctggaaattatatcattagcttagggcgattttgtcaatggttaggtgaacaagcggaaagttttggggttaatgtttttcccggatttgccgctgccaaagtgctttttgatccgaacggggctgtaattggcgtacaaacaggggatatgggcttagataaagaaggccgaccgaccgacagctaccaacctgggcttaatttatacgcgaaacaaactttatttgccgaaggatgccgaggctcgctaacggaagaactgatccgtcattttaacttgcgaaaaaattcagatcctcaaacttatggtattggaatcaaagaattatggaaaatttctcctgaaaaatataaaaagggactcgtcgtccacactgtcggttggccgttggattccaaaacctatggtggttcttttgtttatcattacgaaaataaccttttggccattggtcttgttgttggtctggattatcaaaacccttaccttgacccttttaaagagtttcaacgttttaaaacccacccgctcattcgtcacttacttgaggatggcgaatgcattggctacggagcgcgcgctttaaacgaagggggttttcaatccattcccacgcttacttttcccggtggaatgctcatcgggtgttctgcgggatttttaaacgtaggtaaaataaaaggttctcataccgccatgaaatcgggcatgctcgcagcagaaacgcttttgcaaacaaagactttagaaccggcccaagaattaaaaaattattccactgctcttaagcgctcatgggtttacaaggaattaaatcgcgttcgcaacctccgacccgcttttcgaaaagggttatgggcgggattgttgtattccgctttcgaccaatttatcttgcgcggaaaagcgccgtggatttttcaccaccaacctgattatcgtgctttaaaacccgcaaaaatctgccgcaaaattgcctattccaaaccggacggcaaattgacttttgataaattaacacaagtctatttaaccgggacgcaacatcgcgaaaatgagccctgccatctttgggttaaaaatcaaaaagtagaaacggatatcaccatccccgtctatgccgcccctgaacagcgctattgtcccgccaatgtttatgaaattattgaaaaaaatggaaaaccctgcttgcatattaatgcttctaactgcattcattgcaaaacttgcgatattaaagatccttcgcaaaatattcgctgggtggtgcccgaaggtggcgatgggccgaattattctaatttatga

SEQ ID NO: 100502 - protein, 541 aa, Coxiella burnetii RSA 493
MEKTFQRESLEFDVLIVGAGPAGLSAAIRLAQENRSLSIAVLEKGASVGAHILSGAILEPRALNELIPDWSKRNAPVHVAVQEDQFYLLTAKKSFRLPTPITMRNSGNYIISLGRFCQWLGEQAESFGVNVFPGFAAAKVLFDPNGAVIGVQTGDMGLDKEGRPTDSYQPGLNLYAKQTLFAEGCRGSLTEELIRHFNLRKNSDPQTYGIGIKELWKISPEKYKKGLVVHTVGWPLDSKTYGGSFVYHYENNLLAIGLVVGLDYQNPYLDPFKEFQRFKTHPLIRHLLEDGECIGYGARALNEGGFQSIPTLTFPGGMLIGCSAGFLNVGKIKGSHTAMKSGMLAAETLLQTKTLEPAQELKNYSTALKRSWVYKELNRVRNLRPAFRKGLWAGLLYSAFDQFILRGKAPWIFHHQPDYRALKPAKICRKIAYSKPDGKLTFDKLTQVYLTGTQHRENEPCHLWVKNQKVETDITIPVYAAPEQRYCPANVYEIIEKNGKPCLHINASNCIHCKTCDIKDPSQNIRWVVPEGGDGPNYSNL

SEQ ID NO: 100503 - DNA, 1206 bp, Streptomyces avermitilis MA-4680
  CDS (1)..(1206)
atgagcagcgagaactcttcgacggacgacgcgcagcaggtttgggatgtcgtcgtggtcggcgcggggcccgcgggcgcctcggccgcctatgcggcagcggtcgcgggacgcagtgtcctgctcctcgagaaggcggagctgccccgttacaagacgtgcggcggcggcatcatcggcccttcgcgtgacgcgttgccacccggcttcgagctgcccttccaggaccgggtgcacgcggtcacgttctcgaacaacggccggttcacgcgcacccgtcgctccaagcagatgctgttcggcctgatcaaccggcccgagttcgaccagcagctcgtcgagcacgcacagaaggcgggcgccgaactccgtacgggtgtcacggtctcgcgggtcgagcagcacgggtccgccgtaccggaccgccgcacggtcgccgtcgtccttcagggcggcgattccctgctcgcgcgggccgtcgtcggggcggacggcagcgccagccggataggcgcgcatgtcggtgtgaagctcgaccaggtcgacctcggcctggaggtggagatcccggtgccggagaccgtcgccgaggattggcaggggcgggtcctgatcgactgggggccgatgcccggcagttacggctgggtgttccccaagggggacacgctcaccgtcggtgtgatctcggcgcgaggtgaaggtgccgccaccaagcggtacttggaggacttcatcgcccggctcggcctcgccggtttcgaaccgagcatctcctcaggtcacttgacccgctgccgtgccgacgactcgccgctgtcgcgcgggcgggtgctggtgtgcggtgacgcggccgggctcctcgagccgtggacccgggagggcatctccttcgcgctgcggtcgggacggctggcgggggagtgggcggtccgtatcgccgaggcccacgacgccgtggacacgcggcgccaggccctgaactacgccttcgcgatcaaggcggggctgggcgtcgaaatgagcgtcggcaagcgcatgctcacggcgttcgagcgccgtcccggcatgttccacgcggcgctcaccggcttcaggcccgcctggaaggcgttcgcgcagatcacccggggtgccacctcgctcggcgaactcgtccgcagccacccgatggcggggcgtgtcctgacctcgctggatcggtag

SEQ ID NO: 100504 - protein, 401 aa, Streptomyces avermitilis MA-4680
MSSENSSTDDAQQVWDVVVVGAGPAGASAAYAAAVAGRSVLLLEKAELPRYKTCGGGIIGPSRDALPPGFELPFQDRVHAVTFSNNGRFTRTRRSKQMLFGLINRPEFDQQLVEHAQKAGAELRTGVTVSRVEQHGSAVPDRRTVAVVLQGGDSLLARAVVGADGSASRIGAHVGVKLDQVDLGLEVEIPVPETVAEDWQGRVLIDWGPMPGSYGWVFPKGDTLTVGVISARGEGAATKRYLEDFIARLGLAGFEPSISSGHLTRCRADDSPLSRGRVLVCGDAAGLLEPWTREGISFALRSGRLAGEWAVRIAEAHDAVDTRRQALNYAFAIKAGLGVEMSVGKRMLTAFERRPGMFHAALTGFRPAWKAFAQITRGATSLGELVRSHPMAGRVLTSLDR

SEQ ID NO: 100505 - DNA, 1290 bp, Shigella flexneri 2a str. 2457T
  CDS (1)..(1290): transl_table=11
atgtcggatgacaaatttgatgccattgtggtcggtgcgggcgttgctggtagcgttgccgcactggtcatggcacgagccgggttggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgggcaaccagatgttcctcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatggccgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccaacagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccattgacggcaaaccaaaccagccggtacgcaaaatgatcatgggacacgcgaagaaaattgggctgatcaacttgctgaaagatggcattaagggagcaaccgcgctatga

SEQ ID NO: 100506 - protein, 429 aa, Shigella flexneri 2a str. 2457T
MSDDKFDAIVVGAGVAGSVAALVMARAGLDVLVIERGDSAGCKNMTGGRLYAHTLEAIIPGFAVSAPVERKVTREKISFLTEESAVTLDFHRGQPDVPQHASYTVLRNRLDPWLMEQAEQAGAQFIPGVRVDALVREGNKVTGVQAGDDILEANVVILADGVNSMLGRSLGMVPASDPHHYAVGVKEVIGLTPEQINDRFNITGEEGAAWLFAGSPSDGLMAGGFLYTNKDSISLGLVCGLGDIAHAQKSVPQMLEDFKQHPAIRPLISGGKLLEYSAHMVPEGGLAMVPQLVNEGVMIVGDAAGFCLNLGFTVRGMDLAIASAQAAATTVIAAKERADFSANSLAQYKRELEQSCVMRDMQHFRKIPALMENPRLFSQYPRMVADIMNEMFTIDGKPNQPVRKMIMGHAKKIGLINLLKDGIKGATAL

SEQ ID NO: 100507 - DNA, 1629 bp, Bordetella pertussis Tohama I
  CDS (1)..(1629): transl_table=11
atggaatatgacgtggtcgtggtcggtggcgggccggctgggctggccgcggccatccgcctcaagcagcttgccgcggaaaagaaccacgaagtcagcgtctgtgtcctggagaagggctccgagctcggcgcgcatattctgtcgggcgccgtcatggacccgcaggccctgaccgaactgatccccgactggaaggaaaagggcgcgccgctgaacgtgcccgtgacgcaggacaaattcctcttcctgagcgccaccggcgcgcgctccacgcccaactggctgctgccggcctgtttccacaacgaaggcaactacatcgtgcgcctgggcgacgtggtgaagtggctgggcgaacaggccgaagcgctcggcgtggacattttccccggtttcgcggcggccgaagtgctgtacgacgaaaacggcgcggtgcacggcgtagccaccggcgacatgggcgtggcgcgcgacggcacgcacaccgaccactaccagcccggcatggaactgctggcgcgctacacgctatttgccgaagggtcgcgcggccagctgggccgccagctgatcggccgctacaagctggacgagggccgcaacccgcaatcgtacggcatcggcatcaaggaaatgtgggaggtcgacccggcccagtcgcgtccgggcctggtggtgcataccgccggctggccgctggactccgacacctacggcggctcgttcctctatcacctggacaacaacgtggtggtggtcggcctgatcgtgggcctggactacgccaatccgtggctgtcgccgttcgaggaattccagcgctacaagacccaccctgccatccgcggcaccttcgaaggcggcaagcgcatcgcctatggcgcgcgggccatcaccgcgggcggactgctgtcgctgcccaagctggccttcccgggcggcgcgctgatcggctgcgaagccgggttcctgaatgcatcgcgcatcaagggcagccacgccgccatcaagagcggcaagatggcggccgaggcggccttcgacgccgtggcgagcgatcgcagccacgacgagctggccagctacgccagcgccttcgagtcttcgtggctgcacgccgagctgaacaaggcgcgcaacttcaagcagtggttcaagaagggccgcaccgtcggcaccttcatgaccggtatcgagcagtggctgctcaagggcaagttcccctggaccctgcgccacaacaagcctgaccatgcctgcctgcagccggcatcgcagtgcgcccgcatcgactaccccaagcccgacggcaagctgaccttcgacaagctgagctcggtgttcatctccaacaccaaccacgaagagaaccagccggtgcacttgacgctgaaggacgacagcgtaccggtggcggtcaatctggccaagtatggcggccccgagtcgcgctactgtccggccggcgtgtacgagttcatcaaggacgaccacggcgccgaccgcttgcagatcaacgcgcagaactgcgtgcactgcaagacctgcgacatcaaggaccccacccagaacatcgtctgggtcgcgccgcaaggcggcgagggaccggtctacagcggcatgtaa

SEQ ID NO: 100508 - protein, 542 aa, Bordetella pertussis Tohama I
MEYDVVVVGGGPAGLAAAIRLKQLAAEKNHEVSVCVLEKGSELGAHILSGAVMDPQALTELIPDWKEKGAPLNVPVTQDKFLFLSATGARSTPNWLLPACFHNEGNYIVRLGDVVKWLGEQAEALGVDIFPGFAAAEVLYDENGAVHGVATGDMGVARDGTHTDHYQPGMELLARYTLFAEGSRGQLGRQLIGRYKLDEGRNPQSYGIGIKEMWEVDPAQSRPGLVVHTAGWPLDSDTYGGSFLYHLDNNVVVVGLIVGLDYANPWLSPFEEFQRYKTHPAIRGTFEGGKRIAYGARAITAGGLLSLPKLAFPGGALIGCEAGFLNASRIKGSHAAIKSGKMAAEAAFDAVASDRSHDELASYASAFESSWLHAELNKARNFKQWFKKGRTVGTFMTGIEQWLLKGKFPWTLRHNKPDHACLQPASQCARIDYPKPDGKLTFDKLSSVFISNTNHEENQPVHLTLKDDSVPVAVNLAKYGGPESRYCPAGVYEFIKDDHGADRLQINAQNCVHCKTCDIKDPTQNIVWVAPQGGEGPVYSGM

SEQ ID NO: 100509 - DNA, 1647 bp, Bordetella parapertussis 12822
  CDS (1)..(1647)
atgtccgaacgtgagtcaatggaatatgacgtggttgtggtcggtggcgggccggctgggctggccgcggccatccgcctcaagcagcttgccgcggaaaagaaccacgaagtcagcgtctgtgtcctggagaagggctccgagctcggcgcgcatattctgtcgggcgccgtcatggacccgcaggccctgaccgaactgatccccgactggaaggaaaagggcgcgccgctgaacgtgcccgtgacgcaggacaaattcctcttcctgagcgccaccggcgcgcgctccacgcccaactggctgctgccggcctgtttccacaacgaaggcaactacatcgtgcgcctgggcgacgtggtgaagtggctgggcgaacaggccgaagcgctcggcgtggacattttccccggtttcgcggcggccgaagtgctgtacgacgaaaacagcgcggtgcgcggcgtagccaccggcgacatgggcgtggcgcgcgacggcacgcacaccgaccactaccagcccggcatggaactgctggcgcgctacacgctatttgccgaagggtcgcgcggccagctgggccgccagctgatcggccgctacaagctggacgagggccgcaacccgcaatcgtacggcatcggcatcaaggaaatgtgggaggtcgacccggcccagtcgcgtccgggcctggtggtgcataccgccggctggccgctggactccgacacctacggcggctcgttcctctatcacctggacaacaacgtggtggtggtcggcctgatcgtgggcctggactacgccaatccgtggctgtcgccgttcgaggaattccagcgctacaagacccaccctgccatccgcggcaccttcgaaggcggcaagcgcatcgcctatggcgcgcgggccatcaccgcgggcggactgctgtcgctgcccaagctggccttcccgggcggcgcgctgatcggctgcgaagccgggttcctgaatgcatcgcgcatcaagggcagccacgccgccatcaagagcggcaagatggcggccgaggcggccttcgacgccgtggcgagcgatcgcagccacgacgagctggccagctacgccagcgccttcgagtcttcgtggctgcacgccgagctgaacaaggcgcgcaacttcaagcagtggttcaagaagggccgcaccgtcggcaccttcatgaccggtatcgagcagtggctgctcaagggcaagttcccctggaccctgcgccacaacaagcctgaccatgcctgcctgcagccggcatcgcagtgcgcccgcatcgactaccccaagcccgacggcaagctgaccttcgacaagctgagctcggtgttcatctccaacaccaaccacgaagagaaccagccggtgcacttgacgctgaaggacgacagcgtaccggtggcggtcaatctggccaagtatggcggccccgagtcgcgctactgtccggccggcgtgtacgagttcatcaaggacgaccacggcgccgaccgcttgcagatcaacgcgcagaactgcgtgcactgcaagacctgcgacatcaaggatcccacccagaacatcgtctgggtcgcgccgcaaggcggcgagggaccggtctacagcggcatgtaa

SEQ ID NO: 100510 - protein, 548 aa, Bordetella parapertussis 12822
MSERESMEYDVVVVGGGPAGLAAAIRLKQLAAEKNHEVSVCVLEKGSELGAHILSGAVMDPQALTELIPDWKEKGAPLNVPVTQDKFLFLSATGARSTPNWLLPACFHNEGNYIVRLGDVVKWLGEQAEALGVDIFPGFAAAEVLYDENSAVRGVATGDMGVARDGTHTDHYQPGMELLARYTLFAEGSRGQLGRQLIGRYKLDEGRNPQSYGIGIKEMWEVDPAQSRPGLVVHTAGWPLDSDTYGGSFLYHLDNNVVVVGLIVGLDYANPWLSPFEEFQRYKTHPAIRGTFEGGKRIAYGARAITAGGLLSLPKLAFPGGALIGCEAGFLNASRIKGSHAAIKSGKMAAEAAFDAVASDRSHDELASYASAFESSWLHAELNKARNFKQWFKKGRTVGTFMTGIEQWLLKGKFPWTLRHNKPDHACLQPASQCARIDYPKPDGKLTFDKLSSVFISNTNHEENQPVHLTLKDDSVPVAVNLAKYGGPESRYCPAGVYEFIKDDHGADRLQINAQNCVHCKTCDIKDPTQNIVWVAPQGGEGPVYSGM

SEQ ID NO: 100511 - DNA, 1629 bp, Bordetella bronchiseptica RB50
  CDS (1)..(1629)
atggaatatgatgtggtcgtggtcggtggcgggccggctgggctggccgcggccatccgcctcaagcagcttgccgcggaaaagaaccacgaagtcagcgtctgtgtcctggagaagggctccgagctcggcgcgcatattctgtcgggcgccgtcatggacccgcaggccctgaccgaactgatccccgactggaaggaaaagggcgcgccgctgaacgtgcccgtgacgcaggacaaattcctcttcctgagcgccaccggcgcgcgctccacgcccaactggctgctgccggcctgtttccacaacgaaggcaactacatcgtgcgcctgggcgacgtggtgaagtggctgggcgaacaggccgaagcgctcggcgtggacattttccccggtttcgcggcggccgaagtgctgtacgacgaaaacggcgcggtgcgcggcgtggccaccggcgacatgggcgtggcgcgcgacggcacgcacaccgaccactaccagcccggcatggaactgctggcgcgctacacgctatttgccgaagggtcgcgcggccagctgggccgccagctgatcggccgctacaagctggacgagggccgcaacccgcaatcgtacggcatcggcatcaaggaaatgtgggaggtcgacccggcccagtcgcgtccgggcctggtggtgcataccgccggctggccgctggactccgacacctacggcggctcgttcctctatcacctggacaacaacgtggtggtggtcggcctgatcgtgggcctggactacgccaatccgtggctgtcgccgttcgaggaattccagcgctacaagacccaccccgccatccgcggcaccttcgaaggcggcaagcgcatcgcctatggcgcgcgggccatcactgcgggcggactgctgtcgctgcccaagctggccttcccgggcggcgcgctgatcggctgcgaagccgggttcctgaatgcatcgcgcatcaagggcagccacgccgccatcaagagcggcaagatggcggccgaggcggccttcgacgccgtggcgagcgatcgcagccacgacgagctggccagctacgccagcgccttcgagtcttcgtggctgcacgccgagctgaacaaggcgcgcaacttcaagcagtggttcaagaagggccgcaccgtcggcaccttcatgaccggtatcgagcagtggctgctcaagggcaagttcccctggaccctgcgccacaacaagcctgaccatgcctgcctgcagccggcatcgcagtgcgcccgcatcgactaccccaagcccgacggcaagctgaccttcgacaagctgagctcggtgttcatctccaacaccaaccacgaagagaaccagccggtgcacttgacgctgaaggacgacagcgtaccggtggcggtcaatctggccaagtatggcggccccgagtcgcgctactgtccggccggcgtgtacgagttcatcaaggacgaccacggcgccgaccgcttgcagatcaacgcgcagaactgcgtgcactgcaagacctgcgacatcaaggaccccacccagaacatcgtctggatcgcgccgcaaggcggcgagggaccggtctacagcggcatgtaa

SEQ ID NO: 100512 - protein, 542 aa, Bordetella bronchiseptica RB50
MEYDVVVVGGGPAGLAAAIRLKQLAAEKNHEVSVCVLEKGSELGAHILSGAVMDPQALTELIPDWKEKGAPLNVPVTQDKFLFLSATGARSTPNWLLPACFHNEGNYIVRLGDVVKWLGEQAEALGVDIFPGFAAAEVLYDENGAVRGVATGDMGVARDGTHTDHYQPGMELLARYTLFAEGSRGQLGRQLIGRYKLDEGRNPQSYGIGIKEMWEVDPAQSRPGLVVHTAGWPLDSDTYGGSFLYHLDNNVVVVGLIVGLDYANPWLSPFEEFQRYKTHPAIRGTFEGGKRIAYGARAITAGGLLSLPKLAFPGGALIGCEAGFLNASRIKGSHAAIKSGKMAAEAAFDAVASDRSHDELASYASAFESSWLHAELNKARNFKQWFKKGRTVGTFMTGIEQWLLKGKFPWTLRHNKPDHACLQPASQCARIDYPKPDGKLTFDKLSSVFISNTNHEENQPVHLTLKDDSVPVAVNLAKYGGPESRYCPAGVYEFIKDDHGADRLQINAQNCVHCKTCDIKDPTQNIVWIAPQGGEGPVYSGM

SEQ ID NO: 100513 - DNA, 1620 bp, Chromobacterium violaceum ATCC 12472
  CDS (1)..(1620): transl_table=11
atggaatacgacgtggtgatcgtcggcggcggtccttccggcctgtccgcggcgatccgtttgaaacagctggcggccgagcagggccgcgacatcagcgtgtgcctgctggagaagggctcagagatcggcgcccacatcctgtccggcgcggtgatcgaaaccggcgcgctggccgagttgctgcccaactggaaagagctggacgcgccgctgaacacgccggcgctgtccgaccgcttcctctatctgaccgagaccgagtccatccagctgcccaccccgccgcagatgcacaaccagggcaactacatcgtcagcctgggcaacttctgccgctggctggcgcagcaggccgagaacctgggcgtggagatctacccgggcttcgccgccgccgaggtgctgtaccacgcggacggctcggtcaagggcgtggccaccggcaatgtcggcaccggcaagaacggcgaccaggaaggcgagccgggcatggagctgtgggcgaagcagaccatcttcgccgaaggctgtaggggctcgctgaccaaggggctgctgtcgcgcttccgcctgaccgacggctcggatccgcagaccttcggcatcggcatcaaggaattgtgggaagtgaagccggaaaaccaccagcccggccacatcacccacaccgtgggttggccgatggacaccgccacctacggcggttccttcctttaccacctggaagacaatctggtggctgtcggcttcgtggtcggcctggattataaaaatccctatctgtcgccgttcgaggagttccagcgcttcaagacccatccggcgatcaagaagaccttcgaaggcggccgccgcgtgtcctacggcgcgcgcgcgctggccgagggcggcctgcaaagcctgcccaagctgaccttccccggcggcgtgctggtcggcgacaccgccggcttcctcaacgtgcccaagatcaagggcacccataccgcgatgaagtcggccatgctggcggcggaggcggtgttcgagctgctgggcgacgacgcgcaggcgcagggcggcgaggccaagtcctactcggccaagttccagcagagctgggtacgcgacgagctgcacaaggtgcgcaatatccgcccatcgttccgctggggcctgtggccggcgatgatctactcggccatcgacaccttcctgttccgcggccgcgcgccgtggacgctgcatcaccagcacgccgacaacgaggcgctgcgtcctgcctacgaattcagccccatcgcctatcccaagccggacggggtgctgaccttcgaccgcctgtcgtcggtgttcatttccaacgccaaccatagcgaagaccagccggcccatctgaagctgaaggacgcgtcggtgccgatcgcagtcaacctggccaagtacgacgcccccgagcagcgctactgcccggccggcgtctacgagatcgtcggccaggacgaaggcgcgccgcggctgcagatcaacgcgcagaactgcgtgcactgcaagacctgcgacatcaaggatccgacccagaacatcaactgggtgacgccggaaggcggcggcgggccgaattatcccaacatgtga

SEQ ID NO: 100514 - protein, 539 aa, Chromobacterium violaceum ATCC 12472
MEYDVVIVGGGPSGLSAAIRLKQLAAEQGRDISVCLLEKGSEIGAHILSGAVIETGALAELLPNWKELDAPLNTPALSDRFLYLTETESIQLPTPPQMHNQGNYIVSLGNFCRWLAQQAENLGVEIYPGFAAAEVLYHADGSVKGVATGNVGTGKNGDQEGEPGMELWAKQTIFAEGCRGSLTKGLLSRFRLTDGSDPQTFGIGIKELWEVKPENHQPGHITHTVGWPMDTATYGGSFLYHLEDNLVAVGFVVGLDYKNPYLSPFEEFQRFKTHPAIKKTFEGGRRVSYGARALAEGGLQSLPKLTFPGGVLVGDTAGFLNVPKIKGTHTAMKSAMLAAEAVFELLGDDAQAQGGEAKSYSAKFQQSWVRDELHKVRNIRPSFRWGLWPAMIYSAIDTFLFRGRAPWTLHHQHADNEALRPAYEFSPIAYPKPDGVLTFDRLSSVFISNANHSEDQPAHLKLKDASVPIAVNLAKYDAPEQRYCPAGVYEIVGQDEGAPRLQINAQNCVHCKTCDIKDPTQNINWVTPEGGGGPNYPNM

SEQ ID NO: 100515 - DNA, 1611 bp, Oryza sativa (japonica cultivar-group)
  CDS (1)..(1611)
atgagctacgacgtggtggtcgtgggggctgggcccgcggggctcgccgcggccatccggctgaagcagctctgccgcgacgccgacaccgacctctccgtctgcgtcctcgagaagggctccgaagtcggtgcgcatgtattgtcggggaacgtgttcgagccacgagcgttggatgaactcatcccgaagtggaggcaagaggataccccaataagagtccccgtctcatctgacaagttctggctgttgacaaagaataaggcatggacacttccatctcctttcgataacaagggaaactatgtgataagcttgagccaaatggtgcgatggatggcctccaaagctgaagaattgggtgttgaagtatatccaggttttgctgcgagtgagatcctttatgatgaaaatcaaatagttacaggcgttgcaaccaatgatgttggtattgctaaagatggttccaaaagggaaacttttcaacctggtgttgaactaagagggcgaatgacactgttggccgagggttgccgaggttcattatcagagaaaataataaggaaccacaagctcagagagagtgggcaaggccagcatcagacatatgctcttggaattaaggaggtttgggagatcgaggaaggaaagcacaagccaggttctgtgattcatactgtagggtggcctttggactcgaaaacatatggaggatcatttatgtatcaccttgatgatagacagttagcgataggtctggttgttgccttgaactatcaaaatcctttcatgagcccatacgatgaattccagaaattcaagcaacaccctgctgtcaggacaattttggatggtggaacagttcttcagtatggtgctcgtacgttgaatgaaggtggttttcaatcaataccaaatccagttttccctggaggtgcaattattggatgctctgcagggttccttaatgttcccaaaataaaaggaactcatacagccatgaagtcaggtatgctggctgcagaagcaactttcaaaactcttgttgaaggatcttcgatggaactctattgggagaatctcaagaagtcatggatatgggaagagctttatagagctcggaattacagaccagcatttgaatatggatttattccaggcattgccttgtctgcactggaacgatacgtattcaaaggaaagtccccctttaccttaaagcacgggatacctgaccatgaagcaacagatatggccagtttgcactcgcctattcaatatccgaaaccagatggtcaaatatcctttgacgtaccaacttctttatacaggagcagcacaaaccatgagcatgatcaacctcctcatctccgtttgagggatcctacagtaccggagagagtaaatcttcctctgtatgctggaccagagtcacattattgtccagctcgagtttacgagtatgtcaccgacgagaaaggtgaccagaagcttcacataaatgctcaaaattgtcttcattgcaaggcttgtgacatcaaagatccaaagcaaaacatcgaatggaccgttccagaaggtggaggcggtccagggtacacagtaatgtag

SEQ ID NO: 100516 - protein, 536 aa, Oryza sativa (japonica cultivar-group)
MSYDVVVVGAGPAGLAAAIRLKQLCRDADTDLSVCVLEKGSEVGAHVLSGNVFEPRALDELIPKWRQEDTPIRVPVSSDKFWLLTKNKAWTLPSPFDNKGNYVISLSQMVRWMASKAEELGVEVYPGFAASEILYDENQIVTGVATNDVGIAKDGSKRETFQPGVELRGRMTLLAEGCRGSLSEKIIRNHKLRESGQGQHQTYALGIKEVWEIEEGKHKPGSVIHTVGWPLDSKTYGGSFMYHLDDRQLAIGLVVALNYQNPFMSPYDEFQKFKQHPAVRTILDGGTVLQYGARTLNEGGFQSIPNPVFPGGAIIGCSAGFLNVPKIKGTHTAMKSGMLAAEATFKTLVEGSSMELYWENLKKSWIWEELYRARNYRPAFEYGFIPGIALSALERYVFKGKSPFTLKHGIPDHEATDMASLHSPIQYPKPDGQISFDVPTSLYRSSTNHEHDQPPHLRLRDPTVPERVNLPLYAGPESHYCPARVYEYVTDEKGDQKLHINAQNCLHCKACDIKDPKQNIEWTVPEGGGGPGYTVM

SEQ ID NO: 100517 - DNA, 1719 bp, Gloeobacter violaceus PCC 7421
  CDS (1)..(1719): transl_table=11
atgtcgccacccattcgctatgatttgctgctggtcgggggcagcgcttcgaatctgatccttgcccaccgcctgttggatctggccggcaaaagcggcctgcccctcaccatcgccctggtcgaaaaaagcgcccagttcggcgcccacatcgtcagcggtgcgctcaccaagacccacgtcctcgaaaaagtcttccccgacttcaagacaaacggctttccaatcgagggctatgtcacccatagccacctgagcgtgctgggctccgaggagcgctgggatctgccccacgccatcgtacccaaaggttttcgcaaagagggccacgccatcttgaccctgagccatgccatccgctggctggcggagcaactgcaggccaaagccaaagagcttccgaacgttctgctggacgtctttccggggttcgccgcccaggagatcctctacgaggaccagcgggtcgcgggtgtgcgggtgagcgcctcgggcgacgtgttcgaggatgccatcttcgccgaattcacctgcttcggcgacaagggattcctctccaaagacttggtggagcgtttcgccttgcgccccaatccccaattgtggtcggtgggaatcaaagaagtctgggaagtcgacctcgactgtcggggcgtcgtctggcacaccctgggctatccgattctggacggcaccttcagcggcggtttcgtctacggcctgggccacaagaaactggccatcggcctggtgatcagcctggacagcaaaaaccccaacctcaacccgcaattgcgcctgcaacagttcaaggcccatccctggatacaggaactgatccaaggcgggcggctgctcaagtacggcgccgcggtgatccccgaggggggctactacagcctgcccacccgctttggcgtcgaaggggcgttgctgttgggcgatgcgttgggtgtcctcgatgcggccagtctttccggtctcgacaaatcgatggagaccggttacgtcgccgccgaactgttgcacggcgcgtttgtcgaccgcaacttcgaaggtctgaccgaacgctacaaaagtgccgtcatggacggtttcatcggtcaggaactttacgcgagccgccacttccgccgggcttttctcgaaaacgaccggcttttgggcgagtacctgcccgccgtctgccagagcgtcgatcagggccacccctggctgggcagtctcaaattcggtctcggtaaaccgatccagcgctccaccgatacgttccaggctttgggactgatcctggggcgcatcagcggcgacaagatcttccgctacaccccttgccacgagaatatcgaaccggccttcacccagcctgctgtggcggtcagcacccaggcgcggcccgagacgctcttgagccgtcccgacgcggtcttctttgcggcccctcgctaccacgagggcaaccgccacatcgaagaattcgatgccgatacctgccgccgctgcatcgccgtttacgaccggctgggcaaacccaccccctgcatcgccgactgcaccgccgaggtgcaccgcatcgacgaagcgggcggtgtgcgtgtccacggtatgtccctcgaaaactgcatccagtgccgcacctgcgagattgtctgtccgtcggtgaatttgcgggtcaacccgacctacgaaggctccggcccggatttctacggcctgtag

SEQ ID NO: 100518 - protein, 572 aa, Gloeobacter violaceus PCC 7421
MSPPIRYDLLLVGGSASNLILAHRLLDLAGKSGLPLTIALVEKSAQFGAHIVSGALTKTHVLEKVFPDFKTNGFPIEGYVTHSHLSVLGSEERWDLPHAIVPKGFRKEGHAILTLSHAIRWLAEQLQAKAKELPNVLLDVFPGFAAQEILYEDQRVAGVRVSASGDVFEDAIFAEFTCFGDKGFLSKDLVERFALRPNPQLWSVGIKEVWEVDLDCRGVVWHTLGYPILDGTFSGGFVYGLGHKKLAIGLVISLDSKNPNLNPQLRLQQFKAHPWIQELIQGGRLLKYGAAVIPEGGYYSLPTRFGVEGALLLGDALGVLDAASLSGLDKSMETGYVAAELLHGAFVDRNFEGLTERYKSAVMDGFIGQELYASRHFRRAFLENDRLLGEYLPAVCQSVDQGHPWLGSLKFGLGKPIQRSTDTFQALGLILGRISGDKIFRYTPCHENIEPAFTQPAVAVSTQARPETLLSRPDAVFFAAPRYHEGNRHIEEFDADTCRRCIAVYDRLGKPTPCIADCTAEVHRIDEAGGVRVHGMSLENCIQCRTCEIVCPSVNLRVNPTYEGSGPDFYGL

SEQ ID NO: 100519 - DNA, 1668 bp, Vibrio vulnificus YJ016
  CDS (1)..(1668): transl_table=11
atggaaagagaatgcatggaattcgacgtggttatcgttggtgcggggccagctggtctgtcagccgcttgtcgtttggcgcaactcgcccaagcctccaatcaaagcctctccatttgtgtgttagaaaaaggctcggaagtgggtgcgcatatcctctctggcgcattgtttgaaactcgcgcattggcagaactttttcccgattggcaggatcaagccgcaccagtcgacacgcccatcacgcaagatcgcttgctttacctcactaccgaacataaccacattgaagtgcctgcctttctggtgcctaaatcacttcataatagcagtgacaactatgtgatcagcttgggtaatctctgccgctggttggccaaacaagcagaagccctcggtgtagaggtgtttgctggctttcccgctaaagaggtggtaattaacgaaagtgacattgtcactggtgtcattaccaccgacatgggcctagacaagcaatctcagcccaaagcaggatttgaagccggcatcgagctaaaagcacgctttaccgtgtttgccgaaggcgcgcgtggccatttgggtaaacaactgattgaacactttgctctcgaccaaggaaagccgccacaacactacgctctagggatcaaagaaatttggcaactgcctcaagagaacccagcctatcaagcaggccacgtcacccacttcgctggctggcctttgagtgacactgacagccaaggggggggctttctataccatttggataatcatcaagtttgcgttggtttgatcaccgacctgaactacagcaacccctacctcagtccatttgaagaatttcaacgcatgaagcatcaccccgctatcgcctcgctattgcaaggcgcggagcgcgtcgcttacggtgccagagccatcaccaagggcgggctgcattcactgcccaagcagcagtttgctggaggattactgattggttgcgatgctggcaccctaaatagtggcaagatcaagggctgtcatacggcgatgaaatcgggcatgctcgccgctgaggccattttcaaagcgtggcaatcgcccgagcaaaatactgaagcggactatcaaagtgaatttgaacactcttggctctatgatgagctcgcgcagacgaaaaacttctctgccgccctacatcgctatgggccgctcgttggtggggctctgaatacctttgaacaaaatctttggtatcctctcaccgggcaagcccccagttggcatattgtggatgatagagccgatcacctttgtttggatgagtgcgccgttgtcactcccattgtgtacccaaaagcagacggcgtattgagctttgacaagccttcatcactctatctttccgccactcagcatgaggaaaatcagccctgccacctgatggtgaacgatctcgacacagcactcaaacgccatctgaatttgtacgacgagcctgcacaacgctattgccccgctggtgtgtatgaggttatcgaaggcgaaagtggtccctatttgcaaattaatgccgccaactgtttacactgtaaaacctgcgacatcaaagatccgtcagggaacattacgtggacaccgccagaaggcggtggtggaccgaactaccaaaatatgtaa

SEQ ID NO: 100520 - protein, 555 aa, Vibrio vulnificus YJ016
MERECMEFDVVIVGAGPAGLSAACRLAQLAQASNQSLSICVLEKGSEVGAHILSGALFETRALAELFPDWQDQAAPVDTPITQDRLLYLTTEHNHIEVPAFLVPKSLHNSSDNYVISLGNLCRWLAKQAEALGVEVFAGFPAKEVVINESDIVTGVITTDMGLDKQSQPKAGFEAGIELKARFTVFAEGARGHLGKQLIEHFALDQGKPPQHYALGIKEIWQLPQENPAYQAGHVTHFAGWPLSDTDSQGGGFLYHLDNHQVCVGLITDLNYSNPYLSPFEEFQRMKHHPAIASLLQGAERVAYGARAITKGGLHSLPKQQFAGGLLIGCDAGTLNSGKIKGCHTAMKSGMLAAEAIFKAWQSPEQNTEADYQSEFEHSWLYDELAQTKNFSAALHRYGPLVGGALNTFEQNLWYPLTGQAPSWHIVDDRADHLCLDECAVVTPIVYPKADGVLSFDKPSSLYLSATQHEENQPCHLMVNDLDTALKRHLNLYDEPAQRYCPAGVYEVIEGESGPYLQINAANCLHCKTCDIKDPSGNITWTPPEGGGGPNYQNM

SEQ ID NO: 100521 - DNA, 1851 bp, Rattus norvegicus
  CDS (1)..(1851)
atgttggtgcgactaaccaagctgtcctgccctgcatatcagtggtttcatgccttaaaaattaaaaagtgcctacctctgtgtgctccaagatgctcttcaacctctgctgtacctcagattaccactcactacactattcatccccgggaaaaagacaaaagatgggaaggagtgaatatggagagatttgcagaagaagcagatgtggtaatagttggtgccggcccagcagggctctctgcagctattcggctaaagcagctggctgctgaacaggaaaaggacatccgtgtgtgtctggtggagaaagctgctcagataggagctcatacgctctcaggggcttgccttgatccagctgcttttaaagagctcttcccagactggaaggagaagggggctccacttaacactcctgtaacagaagacaggtttgcgattttaacagagaaacacagaattcctgtgccaattcttccaggtcttccgatgaacaatcatggcaattacatcgtacgcctcggacaccttgtgagctggatgggagaacaggcagaggctctgggagttgaagtgtaccctggatatgctgctgctgaggtcctttatcatgaagatggtagtgtgaaaggaatcgccactaacgatgtgggaatacagaaggatggcgcaccaaagacaacatttgagagaggcctggagttgcatgccaaagtcacaatctttgcagaaggctgccatggacacctagccaagcagctttataaaaagtttgatttgagggccagctgtgatgcccagacttacggaattggtttgaaggagttatgggttattgatgagaagaagtggaaacctgggagagtagatcacactgttggctggcccttggacagacatacttatggaggctctttcctctatcacttaaatgaaggtgaacctctagtagctgttggttttgtggttggcctggactatcagaatccatacctgagtccattcagagagttccagaggtggaagcatcaccccagcatccgaccaaccctggaaggtgggaaaaggatagcctatggagcccgagctctcaatgaaggtggcttgcagtccataccaaaactcacttttcctggtggcttactaattggttgcagtcctggattcatgaatgttcccaagatcaaaggtacccacacagcaatgaaaagtggaagcttggcagcagaagcaatttttaagcaactaactagtgaaaatctccaatcaaagacagcaggactccacgtaactgagtatgaggacaatttgaagcaatcctgggtgtggaaagagctacatgctgtcagaaatataaggccatcctgccacgggatcctgggggtatatggagggatgatttacactggaatattttactggatattgagaggaatggagccatggactctaaaacataaaggctcagactctgaacagctcaaaccagccaaggactgtacacccattgagtatccaaaacctgacggacagatcagttttgacctcttatcctctgtggctctgagtggtactaatcatgaacatgaccagccagcacatttaaccttgaaggatgacagcatacctgttaatagaaatctgtcaatatatgatgggcctgagcagcgattctgccctgcaggagtttatgaatttgttcctctggaacaaggtgatggatttcggttacagataaatgctcagaactgtgtgcattgtaaaacatgtgatatcaaagacccaagtcaaaatattaactgggtggtcccagaaggtggaggaggacctgcttacaatggcatgtaa

SEQ ID NO: 100522 - protein, 616 aa, Rattus norvegicus
MLVRLTKLSCPAYQWFHALKIKKCLPLCAPRCSSTSAVPQITTHYTIHPREKDKRWEGVNMERFAEEADVVIVGAGPAGLSAAIRLKQLAAEQEKDIRVCLVEKAAQIGAHTLSGACLDPAAFKELFPDWKEKGAPLNTPVTEDRFAILTEKHRIPVPILPGLPMNNHGNYIVRLGHLVSWMGEQAEALGVEVYPGYAAAEVLYHEDGSVKGIATNDVGIQKDGAPKTTFERGLELHAKVTIFAEGCHGHLAKQLYKKFDLRASCDAQTYGIGLKELWVIDEKKWKPGRVDHTVGWPLDRHTYGGSFLYHLNEGEPLVAVGFVVGLDYQNPYLSPFREFQRWKHHPSIRPTLEGGKRIAYGARALNEGGLQSIPKLTFPGGLLIGCSPGFMNVPKIKGTHTAMKSGSLAAEAIFKQLTSENLQSKTAGLHVTEYEDNLKQSWVWKELHAVRNIRPSCHGILGVYGGMIYTGIFYWILRGMEPWTLKHKGSDSEQLKPAKDCTPIEYPKPDGQISFDLLSSVALSGTNHEHDQPAHLTLKDDSIPVNRNLSIYDGPEQRFCPAGVYEFVPLEQGDGFRLQINAQNCVHCKTCDIKDPSQNINWVVPEGGGGPAYNGM

SEQ ID NO: 100523 - DNA, 1659 bp, Rhodopseudomonas palustris CGA009
  CDS (1)..(1659): transl_table=11
atgagtgatgaaacgctgccgccccgcgaatcgatggaattcgacgtcgtgatcgtgggtgcaggcccgtcgggactgtccgcagccattcgattgaagcagatcaaccccgagttgtcggtggtggtggtggagaagggctccgaagtcggggcccatatcctgtcgggcgcggtgatcgacgtttcggcgctcgaccgcctgatgccgagctggcgcgaggacgagagctgcccgctgaagacccacgtcgaagacgaccacttctacgtcatgacggcgtcgaaagcgctcaaggtgccaaacatcatggtgccgccgatgctcgacaaccataagaacttcatcggctcgctcggtgacctgtgccgttggctcgggccgaaggccgaggaactcggcgtcgagatctatcccggcttcgccgcgaccgaagtgctgtacggcgacaatggcgaggtgcgcggcgtcgccactggcgacatgggtatcggccgcgacggccagccgaaggattcctacacccgtggcatggaattgctcggcaagtacacgctgttcgccgaaggtgcacgcggcagcctgtcgaagcagctgatcgccaactacaagctcgacaaggattccaatccgccgaagttcggcattggtctcaaggaaatctggcaggtcgagccgtccaagcatcgcaagggccggatcgcccactcgttcggctggccgctcagcaacaatgtcggcggtggctcgttcctgtatcactacggcgacaacctggtggcagtcggcttcgtggtgcatctcaactacgacgatccgtatctgtcgccgttcgagcagttccagaagttcaagacccatccgtcggtggcgccgatcttcgaaggcggcaagcgcatctcctacggcgcccgcgccatcaccgaaggcggctatcagtcggtgccgcgtctgactttcccgggtggcgcgctgatcggctgcgcggccggcttcgtcaacgtaccgcgcatcaagggcgtccataacgcgatcggctccggcatgctggccgccgaacacgtcgcggcggcgctcgctgcgggccgctccaatgacgagccggtggactacgaaaacgcctggcgcgactccggtgtcggcaaggacctgttccgcgttcgcaacgtcaagccgctgtggtcgaagttcggcaccgccgtcggcgtcgtgctggccggcttcgaaatgtggtgttcgacgttcggcttctcggtgttcggcacgttgtcgcatggcaagcccgaccgctcgacgctcgatccggcgaagtcgcacgagccgcacaagaatccgaagccggacggcaagctgaccttcgaccgtttgtcgtcggtgttcctgtcgaataccaatcacgaggaagaccagccggtgcacctcaaggtcgccgatatgcagctgcagaagacgtcggagcacgacgtctatgccggcccgtcgggccgctactgcccggccgcggtgtatgagtgggtggaagagccgaccggtccgcgcttcgtgatcaacgcgcagaactgcgtccactgcaaaacctgcgacatcaaggacccgaacggcaacatcacctgggttccgccggaaggcggcggcggcccgaattatcagggcatgtga

SEQ ID NO: 100524 - protein, 552 aa, Rhodopseudomonas palustris CGA009
MSDETLPPRESMEFDVVIVGAGPSGLSAAIRLKQINPELSVVVVEKGSEVGAHILSGAVIDVSALDRLMPSWREDESCPLKTHVEDDHFYVMTASKALKVPNIMVPPMLDNHKNFIGSLGDLCRWLGPKAEELGVEIYPGFAATEVLYGDNGEVRGVATGDMGIGRDGQPKDSYTRGMELLGKYTLFAEGARGSLSKQLIANYKLDKDSNPPKFGIGLKEIWQVEPSKHRKGRIAHSFGWPLSNNVGGGSFLYHYGDNLVAVGFVVHLNYDDPYLSPFEQFQKFKTHPSVAPIFEGGKRISYGARAITEGGYQSVPRLTFPGGALIGCAAGFVNVPRIKGVHNAIGSGMLAAEHVAAALAAGRSNDEPVDYENAWRDSGVGKDLFRVRNVKPLWSKFGTAVGVVLAGFEMWCSTFGFSVFGTLSHGKPDRSTLDPAKSHEPHKNPKPDGKLTFDRLSSVFLSNTNHEEDQPVHLKVADMQLQKTSEHDVYAGPSGRYCPAAVYEWVEEPTGPRFVINAQNCVHCKTCDIKDPNGNITWVPPEGGGGPNYQGM

SEQ ID NO: 100525 - DNA, 1308 bp, Rhodopseudomonas palustris CGA009
  CDS (1)..(1308): transl_table=11
atgatcgaagaacgtttcgacgccatcgtcgtcggggccggcatggccggcaacgccgctgcgctgaccatggccaagcgcggcctgaaggtgctgcagatcgagcgaggcgaatacccgggctcgaagaacgtgcagggagcgattctctacgccgacatgctggagaagctggtgcccgacttccgcgaggatgcgccgctcgagcggcacctcgtcgaacagcggttctggatgatggacggcaagtcgcacaccggcctgcatcaccgttcggaagacttcaacgaagagaagccgaatcgctacaccatcatccgcgcccagttcgacaaatggctgtccagcaaggcgcaggaagccggcgcgatcgtgctgtgcgaaaccaccgtcaaggaactggtgcaggacgcttacggcaaggtgatcggcgtgatcaccgatcgtgaaggcggccaggttcatgccgacgtcgtggtactggccgaaggcgtcaacggcctgctcggcaccaaggccgagctgcgtgagcgcccgacgccggagaacgtcgcgctggctgtgaaggaaatgcacttcctgccgcgcgagaccatcgaagcccgcttcaacctgaagggcgacgagggcgtggtgatcgaggcggcgggcaccatctcggccggcatgaccggcatgggcttcatctacaccaacaaggagtcgatctcgatcggcatcggctgtctggtgtcggacttccagaagaccggcgagaccccctacggcctgctcgagcgcttcaagaagcatccgtcggtggcgccgctgatcgaaggctccgaggtgaaggaatacgccggccatctgatcccggaaggcggctacaacgcaatcccgcagctctatggtgacggctgggtcgtggtcggcgatgccgcgcagctcaataacgcgatgcaccgcgagggctccaacttggcgatgacctcgggccggatcgccgccgaggcgatcttccaggtcaagtcgcgcaaggatccgatgaccaaggagaatctggcgctctacaagaagatgctggacgatagcttcgtcatcaaggacctgaagaagtacaaggatatgccggacctgctgcatatccgctcgcagaacttcttcctgacctatccgcagctcgtcaacaaggcgctgcagaacttcgtgcgggtcgacggcacgccgaagatcgagaaggaaaagaccacgatcaagtcgttcgtgtcggcacggtcgtggggcggattgttcggcgacgcgttccgcttcgcgcgggcgtggcgataa

SEQ ID NO: 100526 - protein, 435 aa, Rhodopseudomonas palustris CGA009
MIEERFDAIVVGAGMAGNAAALTMAKRGLKVLQIERGEYPGSKNVQGAILYADMLEKLVPDFREDAPLERHLVEQRFWMMDGKSHTGLHHRSEDFNEEKPNRYTIIRAQFDKWLSSKAQEAGAIVLCETTVKELVQDAYGKVIGVITDREGGQVHADVVVLAEGVNGLLGTKAELRERPTPENVALAVKEMHFLPRETIEARFNLKGDEGVVIEAAGTISAGMTGMGFIYTNKESISIGIGCLVSDFQKTGETPYGLLERFKKHPSVAPLIEGSEVKEYAGHLIPEGGYNAIPQLYGDGWVVVGDAAQLNNAMHREGSNLAMTSGRIAAEAIFQVKSRKDPMTKENLALYKKMLDDSFVIKDLKKYKDMPDLLHIRSQNFFLTYPQLVNKALQNFVRVDGTPKIEKEKTTIKSFVSARSWGGLFGDAFRFARAWR

SEQ ID NO: 100527 - DNA, 1737 bp, Bdellovibrio bacteriovorus HD100
  CDS (1)..(1737): transl_table=11
atgtctgtatacgatcaactgccagaaggtgtaacacgcgaaacgatggacgtggatgtcctgatcgtcggtggtggttccgcgggcttgtcctgcgctttgcatctgcaaaatcaaattcaaaaacacaacgaagacgttgctgccggtaaaaaacagggcgagcaaattccggaacagatgatcgttgttctggaaaaagcttctgaagtgggcgcgcacagtttctcgggtgcggttttgaacccgaaagcattgactgagcttattcctaatttcaaagaagaaggctgcccgattgactctgaagtcaaaaaggatgcggtttactatctgggttctgacttctctttcaaactgccaatcactcctccgccgttccacaatgaaggcaattacattgtctctttgagcaagttcaaccgctggttgggcaccaagtgtgaagaaaaaggcatcaacatcttcccgggctttgctgcggtggaagcgttgtatgaaggcgataaaatcgtcggcgttcgcaccggtgacaaaggccgcgacaaacacggcaatccaaaggcgaacttcgagccgggtctgattctgaaatccaaagtcgtgatctttgccgaagggactcgtggttccctgttccgtcaggttgaaaagaaattggacctgcgcgccggcaaaaacaaagaagtcttcgaagaaggcgtgaaggaaatcatccagatgcctccgggcacggtggaagctggccaggttatccataccatgggcttcccgctgtccaaatccatcggtgggactttcatttacaccatcccaggggacaagatcatcgtgggtctggtggcttacttagacacccaggatccattgctggatccacaccgtgaactgcaaaaactgaaaactcatccgttcctgcaaagcatgcttaaaggcggtaaagtcatcgcttacggcggtaagaccctgcctgcgggtggctggtattccatgccgaagctgtacggtaacggctttatggtctgcggtgactctgccagcatggtggacgtgcagaagctaaagggtatccacttggcgatgaaatccggcatgcaggcggcggaagccgttgttgacggtttgatcaaaggtggtgatttctctgaggaagtgaccaaggggtattccgaccgtattgaagcgggttatgtaaaaaccgagctttatcgtgttcgtaacttccaccaggcgctcagcaaagggatggtggaaagcatgcctctgttggcccttcaggagctgaccggcggccgtggtctgcaggatccaatgccgattgaccatatcgacgctgaaaccactgaaaaagtcctggatatctggggtccttatggcctggatcacgaggacaacaagctccctaaagccgacggggagctgttctttgataagctttccagcgtttacctgaccgggaccatgcacgacgaggattccccaaaccaccttattttgaaggatggggatatctgccgtaccgtatgtgagcctcagtacaaatcaccatgtaatcatttctgcccggcggcggtttatgagatggtgccgtctacaaaagaggcaggcaagaaggacttacaaatcaattatacgaactgtattcactgcaaaacttgtgatattaagtgcccattcgaaaatatcgagtggaccgttcctgaagggggcggtggaccacaataccgcgaaacatag

SEQ ID NO: 100528 - protein, 578 aa, Bdellovibrio bacteriovorus HD100
MSVYDQLPEGVTRETMDVDVLIVGGGSAGLSCALHLQNQIQKHNEDVAAGKKQGEQIPEQMIVVLEKASEVGAHSFSGAVLNPKALTELIPNFKEEGCPIDSEVKKDAVYYLGSDFSFKLPITPPPFHNEGNYIVSLSKFNRWLGTKCEEKGINIFPGFAAVEALYEGDKIVGVRTGDKGRDKHGNPKANFEPGLILKSKVVIFAEGTRGSLFRQVEKKLDLRAGKNKEVFEEGVKEIIQMPPGTVEAGQVIHTMGFPLSKSIGGTFIYTIPGDKIIVGLVAYLDTQDPLLDPHRELQKLKTHPFLQSMLKGGKVIAYGGKTLPAGGWYSMPKLYGNGFMVCGDSASMVDVQKLKGIHLAMKSGMQAAEAVVDGLIKGGDFSEEVTKGYSDRIEAGYVKTELYRVRNFHQALSKGMVESMPLLALQELTGGRGLQDPMPIDHIDAETTEKVLDIWGPYGLDHEDNKLPKADGELFFDKLSSVYLTGTMHDEDSPNHLILKDGDICRTVCEPQYKSPCNHFCPAAVYEMVPSTKEAGKKDLQINYTNCIHCKTCDIKCPFENIEWTVPEGGGGPQYRET

SEQ ID NO: 100529 - DNA, 1860 bp, Eremothecium gossypii
  CDS (1)..(1860)
atgaagtcattaataaatcacacctcaaacgggacagctactctgcaaggaagtcgttggtttgccagcagtgcgacacttcggaagactgctgagcttcccttcagtgagctttcagaagaagagcagcttctagtcggctcagagcgcgaagttgataaggttgatgtgtgcattgttggcggtgggcccgcaggactcgcaactgcaatcaaactcaaacaacttgataacaaagatggtagcggggagctaagggttgttgtacttgataagggctcagagtgtggatcacatatagtttctggggtaatcttagaacctcgagcatggagggaactttttcccgacgattgtgacgaaggtattccaatcccatctgagttagtaaccaaagtcgagcgcgaagagttccgtttcttgatgggtaaccttgctctcccaattcctgagccgcctgtgatggtgaacaagggaaacaactacatcgcctcattatctcaagtgactagatggctagctgaaaaggcagaggaggttggcgtagaggtttaccccggaattgcggtttcagacgttgtatattcttccgatggcagctctgttgttggcgtcgcaactaaggacatggggctttcgaaatcgggtaggccgaaggggaattttgaaagaggaatggaattccatgccagacaaactgtttttgcagagggctgccatggatctcttacgaagcaattggtgaagaagtttgctctaagagagaacagggataatcagacctatggattgggcataaaagaagtatgggaagtgatgcctgaaaaattcaataagggatttgtttcacatactatgggttacccactaagtaacgatctctatgggggcggcttccagtatcactttggcgagggacttgtgactgttggcctggtcgtaggcttagactacaaaaacccttgggtttcaccttatcaagagttccagagaatgaagcaccatccatattatgccaatgttttggagggtggtaaatgcgtggcatatggcgcccgtgcgttaaatgagggtggtctgcagtctgttccgaaactacatttcccaggcggttgcctcgttggtgccacagcagggttcatgaatgttccaaagattaagggtacgcatactgcaatgaagacaggcatgctggctgctgaggagatatttaaagcactggcacctcttccttcgttatctgaattggaggagatggatggcgcatcgctggtagagactccgatcaacttggaatcatatgaagctgcttttagaaagtcgtgggtatatgacgaactgtggcaggttcgcaacatacgtccttcttttggttccaaacttggtggttatggcggaatggcttactctgctgtggactcttacatcctcaaagggcggggaccttggacttttcatcaccataaatccgatgcagctgttacaggaccagcatctgagtaccgcaagattgaatatccaagcccagatggcaaaatatcgtttgacattttaacctcagtatcaagaacagggacataccacgatgaggatgagttatgtcacttgagggttcctgaccaggatcctaaactacatacagccaaagcttacccaaaatggaaggggattgaatcaagattttgccccgctggcgtatatgaatacgtggaagattcttccagtccggagggcgtcaaatttcagatcaactcgcaaaactgcatacattgcaagacatgcgatattaaggttccgacgcaagatatcgattgggtggtgccagaaggtagcgacggtcccaaatacacattgacatag

SEQ ID NO: 100530 - protein, 619 aa, Eremothecium gossypii
MKSLINHTSNGTATLQGSRWFASSATLRKTAELPFSELSEEEQLLVGSEREVDKVDVCIVGGGPAGLATAIKLKQLDNKDGSGELRVVVLDKGSECGSHIVSGVILEPRAWRELFPDDCDEGIPIPSELVTKVEREEFRFLMGNLALPIPEPPVMVNKGNNYIASLSQVTRWLAEKAEEVGVEVYPGIAVSDVVYSSDGSSVVGVATKDMGLSKSGRPKGNFERGMEFHARQTVFAEGCHGSLTKQLVKKFALRENRDNQTYGLGIKEVWEVMPEKFNKGFVSHTMGYPLSNDLYGGGFQYHFGEGLVTVGLVVGLDYKNPWVSPYQEFQRMKHHPYYANVLEGGKCVAYGARALNEGGLQSVPKLHFPGGCLVGATAGFMNVPKIKGTHTAMKTGMLAAEEIFKALAPLPSLSELEEMDGASLVETPINLESYEAAFRKSWVYDELWQVRNIRPSFGSKLGGYGGMAYSAVDSYILKGRGPWTFHHHKSDAAVTGPASEYRKIEYPSPDGKISFDILTSVSRTGTYHDEDELCHLRVPDQDPKLHTAKAYPKWKGIESRFCPAGVYEYVEDSSSPEGVKFQINSQNCIHCKTCDIKVPTQDIDWVVPEGSDGPKYTLT

SEQ ID NO: 100531 - DNA, 1818 bp, Anopheles gambiae str. PEST
  CDS (1)..(1818)
atgtcgttgcttactttctccgcagatactcgaacactgctccagcggccacaacttcgccactattccgaagcctccgcacagttcccgaaaatcaccacccactacacgattcacccgcgggataaggatccacgatggggagaggtcgacatggagcgtttcgtcgacgaagcggatctgctcatcgtgggcggtggtccggccggtctctccgcagcgatccgggcaaagcagctagcggcggagaagggccaggagctgcgcgtctgtctcgtggagaaggcggctgaggtcggtggccacatcctgtccggcgcctgtctcgatccggtcgccctgaacgagctgatcccggactggaaggaaaaggaagccccactcaacacgcccgtcacgcacgacaagttctcctacctcaccgagtcggccaagctgcccattccgatctttcccggctggccgatggacaaccggggcaactacgtcgtgcggttgggtcacgtcgtggcctggctcggccagcaggcggaagagctcggcgtggagatctaccccggtacggccgcctcggagatactgtaccacgaagacggctcggtgaagggcatcgccaccggcgacgtcggcatcgggaaggacggtgcgccgaaggatacgttcgcgcgcggcatggaactgcacgcgaagacgaccatctttgcggagggttgtcggggccacctgtccaagcaggtgatggcccgctttgggctgaacgcggagaacgacccgcaaacgtacggcatcgggctgaaggaggtgtgggagatcaaggcggaaaaccataagccggggctggtggagcacacgatcgggtggccgctggaccggcacacgtacggcggctcgttcctgtaccatctgaacgaaccgacgccgctggtggcggtcgggttcgtggtggggctggactacgtcaacccgtacctgagcccgttccaggagttccagcggttcaagacgcacccgaaggtgcgcggcacgttcgagggcggcagccgcattgcgtacggtgcgcgggcactgaacgagggcggcttccagagcattccgaagctgacgttcccgggcggctgtttggtggggtgcggcgccggcttcatgaacgtgccgcgcgtcaagggcagccactatgcgatgaagagtggcatgctggcggcggagagtgcttgcgaggcaatcttctccggggcgacgcaggaaaaggcgggcctagaaccgaaggactatcccgatcgcatcaaggaatcgtacgtgtggaaggatctgtacaaggtgcgaaactcccggcccagcttccacaccgggctcggcctgttcggcggtgtggcatacagtggtttcagcattctggtcggcgggcgggaaccgtggacgctgcaccacggttcacccgaccacacccgcctgaagccggcaaaggactgcaaaccgatcgagtatccgaaaccggacggcaagctgacgttcgatctgctctcctcggtggcgctgaccggcaccaaccacgagggcgaccagccggcccatctgacgctcaaggacgacacggtgccggtgaagaacaatctaacgatttacgacggcccggaggcacgcttctgcccggccggcgtgtacgagtacgtggcgaacgacgagggcggcaacatgaagctgcagatcaacgcgcagaactgcatccactgcaagacatgcgacattaaggacgtcacgcagaacatcaactgggtcgtgccggagggtggcggcggcccggcctacaacggcatgtga

SEQ ID NO: 100532 - protein, 605 aa, Anopheles gambiae str. PEST
MSLLTFSADTRTLLQRPQLRHYSEASAQFPKITTHYTIHPRDKDPRWGEVDMERFVDEADLLIVGGGPAGLSAAIRAKQLAAEKGQELRVCLVEKAAEVGGHILSGACLDPVALNELIPDWKEKEAPLNTPVTHDKFSYLTESAKLPIPIFPGWPMDNRGNYVVRLGHVVAWLGQQAEELGVEIYPGTAASEILYHEDGSVKGIATGDVGIGKDGAPKDTFARGMELHAKTTIFAEGCRGHLSKQVMARFGLNAENDPQTYGIGLKEVWEIKAENHKPGLVEHTIGWPLDRHTYGGSFLYHLNEPTPLVAVGFVVGLDYVNPYLSPFQEFQRFKTHPKVRGTFEGGSRIAYGARALNEGGFQSIPKLTFPGGCLVGCGAGFMNVPRVKGSHYAMKSGMLAAESACEAIFSGATQEKAGLEPKDYPDRIKESYVWKDLYKVRNSRPSFHTGLGLFGGVAYSGFSILVGGREPWTLHHGSPDHTRLKPAKDCKPIEYPKPDGKLTFDLLSSVALTGTNHEGDQPAHLTLKDDTVPVKNNLTIYDGPEARFCPAGVYEYVANDEGGNMKLQINAQNCIHCKTCDIKDVTQNINWVVPEGGGGPAYNGM

SEQ ID NO: 100533 - DNA, 1938 bp, Neurospora crassa
  CDS (1)..(1938)
atgtcgacctccgcacgcatcacgtcgtgcctctaccggcgggctggttccgccggcaccaccacctcggtacaggccacccgcggcctgaggaccctctcgacacccaccatcaacaacatctcccccgcttcgcgatccacaaggagacccaatgtcgcccgccagtcttacaaccctctcctaagaacacgacaagccgccgccctctcgacgacaacccaacgccgtttcgctgatgtcgctgacgacgccttcgaccccaacagcatcgagcgcgagagcgatgaggtcgacgtgtgcattgttggtggtggtcccgccggtctcgccgctgctattcgcctgaagcagctcgccaacgaggccggcaacgatgagttccgcgttctgcttctcgaaaaggccggcgagatcggcgcccacaccctctccggtgccgttatcgagccctccggcatcaaggagctgattcccgactggctcgacgaggagaacccgaaccgcttcaccggcgccacccccgctggcggcgacaccatgcgcttcctgaccgagaagcgtgccttctgggttcccaccccgccgcagatgcacaacaagggcaattacatcgtttccctttccgagtttacaaagtggttgggtgagcgcgctgaggaggtcggcgtcgaggtgtatcccggcttcgctgcctcggaagttctctacaagtccgacggctccgtcaagggcgttgccaccaacgatcttggtctcggccgcaatggcaagcccacggaccggttcgagcgcggtatggagttccacgcccgcgtcaccctctttggcgagggctgccacggctccctctccaagcaggtcatcaacaagtatgacctgcgccgcgacagccagccgcagacctacggtctcggcgtgaaggaggtttgggagatccaacccgagaagttcaagaagggtgaaatcttccactccatgggctacccgctgcccgccaacacctacggcggcgcctggatgtaccactttggcgacaacctcgtctccatcggtctcgtcaccgccctcgactaccccaacccctggctctccccttacggcgagttccagaagatgaagcagcaccccttctaccgccactacctcgaaggcggcaagtgcatctcctacggcgcccgcgccctgatcgagggtggtttccagtccatccccaaggtcgccttccccggcggcgcccttatcggcgactcggccggcttcgtcaacgtgcccaaggtcaagggcacccataacgctatgaagtccggtatgctcgcggccaacgccgcctgggatgcgctgcaggacaccaacgactccgggtctgtcttcctctactcgtacgaggactcgctgcgcaactcgtccatctggaaggaacttaaggaagtccgcaacatgcgcccctccttccactcgcccctgggtctctacggcggcatcatgtactcgggcatcgacgccttcctcctcaagggccgcgtgccctggacgttcaaacacaaggtacgcgaccacgaggccaccaagccggccgacgagtgcgaaaagatcgagtaccccaagcccgacggcaagatcactttcgacatcttgactagcgtgtccaggaccggcaccaaccacgaggaggaccagcccgtgcatctccaggttgaggactgggatcagcacaccaaggagacgtatcccaagtacaagggcgtcgagaatcggttctgccctgccggtgtgtatgagtatgtggaggacgcgacgaagaaggagggcgtgaggtttcagattaatgcgcagaactgcatccactgcaagacctgcgacatcaaggctcccaaccaggatatcaactggcaggtaccccagggtggtgagggtcccaagtactacatgacataa

SEQ ID NO: 100534 - protein, 645 aa, Neurospora crassa
MSTSARITSCLYRRAGSAGTTTSVQATRGLRTLSTPTINNISPASRSTRRPNVARQSYNPLLRTRQAAALSTTTQRRFADVADDAFDPNSIERESDEVDVCIVGGGPAGLAAAIRLKQLANEAGNDEFRVLLLEKAGEIGAHTLSGAVIEPSGIKELIPDWLDEENPNRFTGATPAGGDTMRFLTEKRAFWVPTPPQMHNKGNYIVSLSEFTKWLGERAEEVGVEVYPGFAASEVLYKSDGSVKGVATNDLGLGRNGKPTDRFERGMEFHARVTLFGEGCHGSLSKQVINKYDLRRDSQPQTYGLGVKEVWEIQPEKFKKGEIFHSMGYPLPANTYGGAWMYHFGDNLVSIGLVTALDYPNPWLSPYGEFQKMKQHPFYRHYLEGGKCISYGARALIEGGFQSIPKVAFPGGALIGDSAGFVNVPKVKGTHNAMKSGMLAANAAWDALQDTNDSGSVFLYSYEDSLRNSSIWKELKEVRNMRPSFHSPLGLYGGIMYSGIDAFLLKGRVPWTFKHKVRDHEATKPADECEKIEYPKPDGKITFDILTSVSRTGTNHEEDQPVHLQVEDWDQHTKETYPKYKGVENRFCPAGVYEYVEDATKKEGVRFQINAQNCIHCKTCDIKAPNQDINWQVPQGGEGPKYYMT

SEQ ID NO: 100535 - DNA, 1809 bp, Magnaporthe grisea 70-15
  CDS (1)..(1809)
atgtctgtgtcggtcaaaggagcaggcagggtctgcgcacgcatcccgagctgtcgctactcggccccgaggttacggacagccgccctctcatccacctccacagcacactatacgactcggccacagaggaggttaccaaggacgactgcagcttcctggacgcaaacacgcctcttctcagtaagcaggccacgtcgaaacgctagcgaacacgaatcctttgatccccggacggtcgagagggagagcgatgaggtggatgtttgcattgtgggtggaggcccggccggtctcagcgccgcgatccgcttgaaacagctcgcaaacgaagccggcaatgaagactttcgcgtcctgctcctcgaaaaggccggcgagcttggcgctcacatcgtgtcgggcgccgtgatccagcccaccgccatcgatgagctgatacctgactggctgtccgaggacaacccggaccgcttcgagcacgcaacacccgccggcaccgaccgcatgcgattcctgaccaagacgaaagcaatccccctgcccgccccgccgcagatgaacaaccacggaaactacatcgttagtttgggccagttcaccgcctggttgggcacacgcgccgaggagctgggtgtcgaggtgtatcccggcttcgccgcctccgaggtaatttacaagtcggacggctcggtactgggagtcgccacgaatgacctgggcatcgggcgcgacggtaagcccaaggattcgttcgagcgcggcatggagttccacgctcgctgcacgctctttgccgagggttgccacggtagcttgaccaagcaggtcaccaagaaattcgacctgcgccgcgacagccagccgcagacgtacgggctcgggctcaaggaggtctgggaggtcgacccggccaagttccgcaagggcgagatcacgcactcgctcggctacccgctgcccaaggatgtctacggtggcgcgtggatgtaccactttggcgacaatctcgtgtccctcggcctcgtcgtcgctctcgactacccgaacccatggatgtcgccataccaggagttccaaaagatgaagaagcacccgctctacagggaggtgctcgagggcggcaagtgcatctcgtatggcgcccgcgccctgatcgagggtggtttccagtccatccccaaggtcgccttccccggcggtgccctgatcggcgactcggccggcttcgtcaacgtgccaaaggtcaagggcacccacaacgccatgaagtcgggcatgctggcggccgaggctgcatggaaggctctggacacgagcgagaacgaagggtccgtcttcctctacgactacgagagttcgctgcgccagtctagcatatggaaggagctcaaggaggtgcgcaacatgcgcccgtccttccacaacccgctcggcctgtacggcggcatcatgtactcgggactagaggcttacgtcctcaagggccgcgtgccctggacgctcaagcacaagacgacggatcacggcgccaccaagccagcggaccagtgcgaaaagatcgagtacgagaagcccgacggcaagatcacctttgacatacttacaagcgtatcccgcaccggcaccaaccacgaggaggatcagccggtgcacctgcaggtcaaggactgggaccgccacgcgctcgaaacttggcccaaattcaagggcctggagaacaggttctgcccggccggtgtgtacgaatacgtcgaggatcaatccaaggagcttggcgtcaggttccaaatcaacgctcaaaagtaa

SEQ ID NO: 100536 - protein, 602 aa, Magnaporthe grisea 70-15
MSVSVKGAGRVCARIPSCRYSAPRLRTAALSSTSTAHYTTRPQRRLPRTTAASWTQTRLFSVSRPRRNASEHESFDPRTVERESDEVDVCIVGGGPAGLSAAIRLKQLANEAGNEDFRVLLLEKAGELGAHIVSGAVIQPTAIDELIPDWLSEDNPDRFEHATPAGTDRMRFLTKTKAIPLPAPPQMNNHGNYIVSLGQFTAWLGTRAEELGVEVYPGFAASEVIYKSDGSVLGVATNDLGIGRDGKPKDSFERGMEFHARCTLFAEGCHGSLTKQVTKKFDLRRDSQPQTYGLGLKEVWEVDPAKFRKGEITHSLGYPLPKDVYGGAWMYHFGDNLVSLGLVVALDYPNPWMSPYQEFQKMKKHPLYREVLEGGKCISYGARALIEGGFQSIPKVAFPGGALIGDSAGFVNVPKVKGTHNAMKSGMLAAEAAWKALDTSENEGSVFLYDYESSLRQSSIWKELKEVRNMRPSFHNPLGLYGGIMYSGLEAYVLKGRVPWTLKHKTTDHGATKPADQCEKIEYEKPDGKITFDILTSVSRTGTNHEEDQPVHLQVKDWDRHALETWPKFKGLENRFCPAGVYEYVEDQSKELGVRFQINAQK

SEQ ID NO: 100537 - DNA, 1809 bp, Gibberella zeae PH-1
  CDS (1)..(1809)
atgcccgccccacgaccagtttcgcgatgcgtccagcgcagctcgcaagtgctttctcgaactcagctgcgtcccgccagatcaaccttttcccccgccacaatcgctgccagatcatctctcacaaggagaacgagtacggcattatggtccgctgcaaaagtgccaatggccgctcgcgcctttagcaccacttcaagacttcgagacgacgacacagatttcgaccccgccaccgtcgaacgcgagtctgacgaggttgatgtctgcattgtaggaggcggtcctgctggtctcagcgctgctattcgtcttaagcagctcgccaatgatgctggaaacgaggacttccgcgtgcttgtcttggaaaaggctggcgatcttggcgctcatatcctctctggagctgtcatccagcctaccgctatcaatgaattgttccccgactggctcgacgagaacaaccccaaccgattcgaacatgccactcccgccggcaccgatcgtatgcgattccttaccaagaactctgctattcctatccccgcgcctcctcaaatgaccaaccacggaaactacatcgtcagcttgaaccaattcgtcaagtggctcggcgagcgtgctgaagagatcggtgttgaggtctaccctggctttgctgcttccgaggttgtctaccatgcagatggctctgtcaagggtgttgccaccaacgatcttggtgttggccgtgacggcaagcccaaggaaacattcgagcgaggcatggagttccatgcccgagtcaccatgttcggcgaaggctgccacggaagtttgagcaagcaggttatcaacaagttcgacttgcgaagggacagccagcaccagacttacggccttggtgtcaaggaggtttgggagattgaccccgccaagtttgaaaagggcctggttgtgcactcgatgggttacccattgcccaaggacgtgtacggtggctctttcatgtaccactttggtgaaaatcttgttcagatcggtctcgttacctcacttgactacacaaacccatggatgtcgccataccaagagttccagaagctcaagcgacaccctcttttccgcgatgttctcgagggtggaaagtgcatctcatatggcgcccgtgctctgattgagggtggtttccagtccatccccaaggttgctttccctggtggtgcgctcattggtgactcagctggtttcgtcaacgttcctaaagtcaagggtacacacaatgccatgaagtcaggcatgctggcagccgaggcagcatggactgcccttagcgagaagaccgacgaaggcacagtcttcctgtacgactacgagaacaagcttcgggactcttctatctggaaggagctccacgaggtccgtaacatgcggccatctttccacacgcctctcggtctttacggcggtatcatgtactccggtctcgaagcctatgtcttcaagggccgagtcccttggacgctcaagcacaagacccccgaccacgcgtccactcttcacgccgacaaggttcccaagatcgaatacgagaagcccgacggcaagctcacctttgatatattgacaagtgtctcccgtactggaaccaaccacgaggaagaccagcccgttcaccttcaggtcaaggactgggacgcccacaccgagtcaacataccctccctacaagggcatggagaaccgattctgcccagctggcgtttacgagtatgttgaggatgagtcaaagccccatggcgttcgattccaaatcaacgcacaaaagtaa

SEQ ID NO: 100538 - protein, 602 aa, Gibberella zeae PH-1
MPAPRPVSRCVQRSSQVLSRTQLRPARSTFSPATIAARSSLTRRTSTALWSAAKVPMAARAFSTTSRLRDDDTDFDPATVERESDEVDVCIVGGGPAGLSAAIRLKQLANDAGNEDFRVLVLEKAGDLGAHILSGAVIQPTAINELFPDWLDENNPNRFEHATPAGTDRMRFLTKNSAIPIPAPPQMTNHGNYIVSLNQFVKWLGERAEEIGVEVYPGFAASEVVYHADGSVKGVATNDLGVGRDGKPKETFERGMEFHARVTMFGEGCHGSLSKQVINKFDLRRDSQHQTYGLGVKEVWEIDPAKFEKGLVVHSMGYPLPKDVYGGSFMYHFGENLVQIGLVTSLDYTNPWMSPYQEFQKLKRHPLFRDVLEGGKCISYGARALIEGGFQSIPKVAFPGGALIGDSAGFVNVPKVKGTHNAMKSGMLAAEAAWTALSEKTDEGTVFLYDYENKLRDSSIWKELHEVRNMRPSFHTPLGLYGGIMYSGLEAYVFKGRVPWTLKHKTPDHASTLHADKVPKIEYEKPDGKLTFDILTSVSRTGTNHEEDQPVHLQVKDWDAHTESTYPPYKGMENRFCPAGVYEYVEDESKPHGVRFQINAQK

SEQ ID NO: 100539 - DNA, 1986 bp, Ustilago maydis 521
  CDS (1)..(1986)
atgttcgctgctcgcaccacacacgcctcgccagcccgtctggcgagcgtcctccgcagcagcaccgcccacaaggctggtggttcgcttcgcgccacctcgtctgcttccgtggcatcagcagcttcgctctccacattggcttctcgcagctgtcttgcaaatgcccgagcaagctgcttcgcaagctcctccgtcattgggcgcgccttttcgacaacgtcagtcgctcaaagagccacgcccatcgaagagggtgatggcgagcctttcgacctcaccaccgtcgagcgagtttctgacgaggtcgacgtgatcatcgttggaggtggtccagcgggtctcagtgccgccatcaagatcaagcagctagccgaagagcgtggcgaggagatccgtgtcgtcgtgcttgaaaagggccctgaagttggcaaccacatcctctcgggtgctgtcatccagaccaatgccctcgatgagctcttgccagactggaaggaactcggtgctcctctcaatcagcctgcgctcgaagatcacatgcgcttccttacacctaccggatcgtttcccatgccgcatccaccgcaaatgtccaacaagggcaactacattgtctcgctctcgcgcgtcgtctcatggttgggtgagcaggccgaagctgcgggtgtcgaaatctatcccggtttcgctgccgcacagccactgtggcagatggatgaaaacggtaagcccatcggcatcaagggtgtcatcaccaacgagattggactcgacaagtcacgcaagcccaaggactcgttcgaaccaggcatggagttccacgcgccgatcacgcttttcgccgaaggtgcgcacggttccatgacacaaaagatgatcaagcaactcggacttcgtgacgccgttggcgctgatccacagacttatggcctcggtgtcaaggaagtctggcgagtcaagcccgagaagcaccaggccggtctggtgacccacaccatgggctggccgctggacacgagcacgtatggaggtagctggacgtaccacatggaggacaatatggtctcgattggtctcgtcgtcggtctggattacaagaacccttacctcagccccttccgtgaattccaaaagatgaagcaccatcccttcttcaaagatctccttgagggtggcgagtgccttgcttatggcgccaggacgctcaacgagggtggctaccagtcaattcccaagcttcacttccctggtggtgccttggtgggttgtgctgccggattcctcaacgtacccaagatcaagggcacgcacaacgccatgaagtctggcatggtcgctgctgaggctgtcgtcgaagcgcttgccaaacgagctgagtcaggctccgaagacacgattgaccttgccggctacaagacgaggctcgacgatacgtacgtcatgaaggagctgtacgaggtgcgcaatctgcggccttcgttccacggtccactcggcttctggggtggtctggcctactctggtcttgactcgatgatcctcaagggtcgtgtaccttggaccttccaccaccctggtgaggaccacgcccagaccaagcctgcctccgaatgcgagccgatcgaataccccaagccggacggcaagctttccttcgatattttgacctcggtctcgaggaccggtacgaatcacgctgaggaccagcctgtccacctcgtggtaaaagagggagactacaagggtcatgttgagcgcaatgtcggcactttcgaagggcccttgggccgttgctgccccgctggcgtgtatgagtacgtggaagctgacactcccgatcaggaggatgcattgggtaagaagctcgtgattaacagtcagaactgcatccactgctacacgtgctcgatcaagacgcctgaccagagcattcgttgggacgtgcctgagggtggtggaggacccaagtactctttgacctag

SEQ ID NO: 100540 - protein, 661 aa, Ustilago maydis 521
MFAARTTHASPARLASVLRSSTAHKAGGSLRATSSASVASAASLSTLASRSCLANARASCFASSSVIGRAFSTTSVAQRATPIEEGDGEPFDLTTVERVSDEVDVIIVGGGPAGLSAAIKIKQLAEERGEEIRVVVLEKGPEVGNHILSGAVIQTNALDELLPDWKELGAPLNQPALEDHMRFLTPTGSFPMPHPPQMSNKGNYIVSLSRVVSWLGEQAEAAGVEIYPGFAAAQPLWQMDENGKPIGIKGVITNEIGLDKSRKPKDSFEPGMEFHAPITLFAEGAHGSMTQKMIKQLGLRDAVGADPQTYGLGVKEVWRVKPEKHQAGLVTHTMGWPLDTSTYGGSWTYHMEDNMVSIGLVVGLDYKNPYLSPFREFQKMKHHPFFKDLLEGGECLAYGARTLNEGGYQSIPKLHFPGGALVGCAAGFLNVPKIKGTHNAMKSGMVAAEAVVEALAKRAESGSEDTIDLAGYKTRLDDTYVMKELYEVRNLRPSFHGPLGFWGGLAYSGLDSMILKGRVPWTFHHPGEDHAQTKPASECEPIEYPKPDGKLSFDILTSVSRTGTNHAEDQPVHLVVKEGDYKGHVERNVGTFEGPLGRCCPAGVYEYVEADTPDQEDALGKKLVINSQNCIHCYTCSIKTPDQSIRWDVPEGGGGPKYSLT

SEQ ID NO: 100541 - DNA, 1995 bp, Debaryomyces hansenii CBS767
  CDS (1)..(1995)
atgagtatacaacagatatttcggaagaccttgtttgaaatgttgaagactaagaattgtttagctttacgtcatttcgtaaagaaaaataatatagtgaaacacttatccactagatctttgttagttccattaaaaccaacgacgcatagactacagacgattcgtaaattcgccagcaccaccagaataaggaatgaaaccgaagagcaattaaaccataataacgaaataccattcgaacggttatcggaagaagaacaagcaacattgaaagatgaaagagcagcagattctgtcgatgtttgtattgttggaggaggaccagctggcttagttactgccatcaaattaaaattgcttgataatgaacagggcacaggtgagttaagagtggtagttttggaaaaagctggtgatttcggtgcacatattgttagtggtgcagttatagagccaaaggcattaaaagaattatttcccgatagcgaatttttgaatgaagatggatcaggaattccattgcccgatgatttagttaccatggtagaaagtgatacaatgaaatacttgaccaacgaatatgcgtatccaatgcctgaaccacctcagttggtcaaccatggcaagaactatattgtttcattgaataatgtagtcaaatttttagctgaaaaagctgaagagttgggtgttgaattataccctggaatttccgtaagcgaggtaatctataatgaaaaaggtgatgcgatcaagggtgtagctacaaaagatatgggaatttcaaaaactggagctcctaaggattcatttgagagaggtatggaatttcacgctcgaatgactgtactcggtgaaggttgtcatggttccttaacaaaagaagtaatctccagatataacttaagagaaaacagtgaacctcaaacctatggcttaggaatcaaagaagtctgggaagtcaagccagagaattttgaaaaaggtgcagtagcgcatactatgggttatccattatcatcagatgtttatggcggtggttttatgtatcattttggtgatggattagttaccgtaggtttggttgttggattggattatgctaatccttatatttcaccgtatcaagaatttcagaagatgaaattacatccattttactcgaacgtattagagggtgggaaatgtctatcgtatgcagctagagcccttaatgaaggtggatttcaatctgttccacagttatatttcccaggtggaattttagttggttgctcagctggttttgttaacgtaccaaagatcaaaggtacacatactgccatgaaatcgggtattctagcagcagaaactattttcaatgaagtaaaatctttggatccagttgaagaaggaacattagatgacgctgaaccaatagtattgaaatcatacgaagaagcatacgaaaaatcgtggatctacgatgaattaaatgaagtccgtaatgttcgtccttcatttaacggtcctttaggattcttaggtggtttaattcattcgggtctttcaactatgtttacaaggggacatgaaccatggactttaagtcatcattctactgatgctgcggccacaaaggatgcatctaactatgaacctattgaataccctaagcctgatggtaaaataacttttgatctcttaacttcagtatcaagaacaggtacttaccatgatgatgatgaacaatgtcacttgaggattccagatcaagattaccgtaaacatgcaagcatttcttatccaaaatttaagggcgtggagcaaagattttgtcctgcaggggtctatgagtatacagaagatgaaaatgaaccgttaggtgtaaaattccaaatcaacagtcaaaattgtattcattgcaaaacttgcgatattaaggttccaacgcaagatataaactggactgttcctgaaggtggtggaggtccaaaatattatatgacataa

SEQ ID NO: 100542 - protein, 664 aa, Debaryomyces hansenii CBS767
MSIQQIFRKTLFEMLKTKNCLALRHFVKKNNIVKHLSTRSLLVPLKPTTHRLQTIRKFASTTRIRNETEEQLNHNNEIPFERLSEEEQATLKDERAADSVDVCIVGGGPAGLVTAIKLKLLDNEQGTGELRVVVLEKAGDFGAHIVSGAVIEPKALKELFPDSEFLNEDGSGIPLPDDLVTMVESDTMKYLTNEYAYPMPEPPQLVNHGKNYIVSLNNVVKFLAEKAEELGVELYPGISVSEVIYNEKGDAIKGVATKDMGISKTGAPKDSFERGMEFHARMTVLGEGCHGSLTKEVISRYNLRENSEPQTYGLGIKEVWEVKPENFEKGAVAHTMGYPLSSDVYGGGFMYHFGDGLVTVGLVVGLDYANPYISPYQEFQKMKLHPFYSNVLEGGKCLSYAARALNEGGFQSVPQLYFPGGILVGCSAGFVNVPKIKGTHTAMKSGILAAETIFNEVKSLDPVEEGTLDDAEPIVLKSYEEAYEKSWIYDELNEVRNVRPSFNGPLGFLGGLIHSGLSTMFTRGHEPWTLSHHSTDAAATKDASNYEPIEYPKPDGKITFDLLTSVSRTGTYHDDDEQCHLRIPDQDYRKHASISYPKFKGVEQRFCPAGVYEYTEDENEPLGVKFQINSQNCIHCKTCDIKVPTQDINWTVPEGGGGPKYYMT

SEQ ID NO: 100543 - DNA, 1941 bp, Yarrowia lipolytica CLIB99
  CDS (1)..(1941)
atgattcgatccagccggcttttgcgagtgaagccccagcgggccgttcggggtgtgcagcgagtttcgcgagcgatcccctcgggagtgacccacattccgcgagccaccgtgactgctcatgtgtctaacttctccacctttcgagtggttcgacagcagcagttttccgaggacgagctcgacgtgctgaattccgagcgagaaaaggactttgttgacgtggccattgtgggaggaggccctgctggtctgtctgcggccatcaagatcaagcagcttgataatgagcacggcaatggcgatctgcgagtcattgtgcttgaaaaggcccccgatatgggctcgcacattctgtctggagctgttctcgagccccgagctctggatgagctgatccccgagtggagagacgatcctcctgagcccatgactcttgttaccgaagagaccatgcgtttcttcaccaaaaagtgggccattcccatccccgagcctccccagatgcacaacaagggaaagaactacattgtatcacttaaccaggtgaccaaatggctggccgagaaggccgaggaggttggagtcgaggtctaccccggattttctgtttccgagctggtttaccgagacggaaacgtggttggtgtggctactaacgacatgggccgagccaaggacggaaagccccttgatagctttgagcgaggcatggagttctacgcccgaaccacgctgctggccgagggctgccacggatcgctgagtaagcaggcaatctccaagtacgatctgcgaaaggattccgagccccagacctacggtattggaatcaaggaggtgtgggaggtccctgacgaggtgttcaagtccggatacgtggcccacggtctgggatggcctcttgatacagaaacttatggaggaggcttcatgtaccactttggagacaacctggtggccgtcggtcttgtcactggcctcgactacaagaacccttacatttcgccattcaaggagtttcagcgaatgaagcatcaccccttcttcgccaaggttctgtcggagggaacctgtattcagtacggtgcccgagctcttaacgagggaggtctgcagtccatccccaagctttctttccccggaggcgcacttatcggctgttctgctggcttcctcaacgtgcctaaaattaagggtactcatactgccatgaagtctggtatgcttgctgctgagaccatttgggagcagttccaggccgagaacgaggctggaacccctctggtggtgtctgaggctgaggaccttgagcccgagctgttcaagactatcgatctcgccaactacgagcagaagttcaaggattcgtggatctacgacgagcttcacgaggtccgaaacgtgcgaccctctttccacaaccctctcaagaactggggaggtctgctgtactccggtattgacaccttcctgctgcggggacgagttccctggactctcaagcatgccaccaccgactctgctgccaccgagcctgcttccaagcacaaggagattgattaccccaagcccgacggaaagctgtcttttgatctgcttacttccgtgtcacgaaccggaactaaccacgacgaagatgaacctgtccatctgaagctcacttctgaccctgctgacgctcccttcaagatcaacactgaggctgatctggccaagcataccgccgacaactgggagaagtacaagggtgtcgaggcccggttctgccccgccggtgtctacgagtacattgaggatgacgctggtgacggcgttcgattccagatcaactcgcagaactgtatccattgcaagacctgcgatatcaaggtgcctggccagaacatcaactggactgttcctcagggtggagatggtcccaagtactccatgacttaa

SEQ ID NO: 100544 - protein, 646 aa, Yarrowia lipolytica CLIB99
MIRSSRLLRVKPQRAVRGVQRVSRAIPSGVTHIPRATVTAHVSNFSTFRVVRQQQFSEDELDVLNSEREKDFVDVAIVGGGPAGLSAAIKIKQLDNEHGNGDLRVIVLEKAPDMGSHILSGAVLEPRALDELIPEWRDDPPEPMTLVTEETMRFFTKKWAIPIPEPPQMHNKGKNYIVSLNQVTKWLAEKAEEVGVEVYPGFSVSELVYRDGNVVGVATNDMGRAKDGKPLDSFERGMEFYARTTLLAEGCHGSLSKQAISKYDLRKDSEPQTYGIGIKEVWEVPDEVFKSGYVAHGLGWPLDTETYGGGFMYHFGDNLVAVGLVTGLDYKNPYISPFKEFQRMKHHPFFAKVLSEGTCIQYGARALNEGGLQSIPKLSFPGGALIGCSAGFLNVPKIKGTHTAMKSGMLAAETIWEQFQAENEAGTPLVVSEAEDLEPELFKTIDLANYEQKFKDSWIYDELHEVRNVRPSFHNPLKNWGGLLYSGIDTFLLRGRVPWTLKHATTDSAATEPASKHKEIDYPKPDGKLSFDLLTSVSRTGTNHDEDEPVHLKLTSDPADAPFKINTEADLAKHTADNWEKYKGVEARFCPAGVYEYIEDDAGDGVRFQINSQNCIHCKTCDIKVPGQNINWTVPQGGDGPKYSMT

SEQ ID NO: 100545 - DNA, 2529 bp, Pan troglodytes
  CDS (1)..(2529)
atgctagaatatatgccccctctagtggttacctctggggactctggggagggaggaacgggacaggatcaaacagatgctgcagaggcgtctgagagaaggggagaagagggagcggcgggggcggcgaagaaacctgcacgtcctcaggatcggccatggggaagggttgggaccgcggaatccgacccgagaagccgaaccaacaccaactgtcttttaaccactcgcgcccaaagccgagaggccccgcctcctaacgccagaaatcccgcccagtctcctcgaagccgtgtgcgtcgccccgccttctactgcctttcactgcgcgtgcgtcgtgctgtgggattcgcggacccttctggccgcgctctgtttcaccgctcccgggctgggacttggagtcccttatctttccccggtttggtacatgacccggaagcctcggctggccgccgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctgtctactgaggaaaactaattttaaggaagataataattttcgtaatttttgtgcagcatatcagtgctttcatgccttaaaaattaagaaaaattatctacctctatgtgctacaagatggtcttcaacttctgctgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgcggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatatagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtttatggagggatgatttacactggaatcttttactggatattgagaggaatggagccatggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcaatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaa

SEQ ID NO: 100546 - protein, 842 aa, Pan troglodytes [sequence omitted]

SEQ ID NO: 100547 - DNA, 1848 bp, Cryptococcus neoformans var. neoformans JEC21
  CDS (1)..(1848)
atggccataataacccccatatcacgtttagcaacgtcccgcaccctcacagctgcctctcgcagctcctcaggagctctacttcgccggcctacagctcttcgaatacggaccttcgcgtctgaagccaaattcgacccggagagcgttgaacgggcacaggatgaagtggatgtctgcatcgttggcggtggccctgctggccttagtgctgctattagactgaagcagcttgagcaagaacgaggtggcgatgagctcagagtcgtcgttcttgagaaaggtggtgaagttggggcccatatcctttctggtgcagtgattgaacctagagccctcaatgaacttatacccgattggaaagaattgggagcgcccctcaaccaacctgccctttccgactctatgcgattcttgacctccaactcatccttccctctgccccatcctcctcaaatgaacaacaaaggcaattacattgtgtcactttctcgattcactgcttggttgggggagcaagctgaggcacttggtgttgaggtatatcctggatttgctggtgccaaggtcttgtacacagaggacggcaagggcatcaagggtgtcattaccggtgatgtcggattagataaggatggaaaccccaaggataattacgagcctggtatggagttccatgccaaggtaactctcattgccgaaggtgcccacggttcgttgtccaaggaattgcagaaaaaattcaatcttcgagaaggtaaagacccacaaacctacggcctgggcatcaaggaagtgtggaaggtcaaggacgaagtttatgagcctggaaaaatcgttcatactcttggatggcctttagattacaagacttatggtggtagttggatgtaccacatggaggataacatggtcagcataggtctggttgttggccttgactaccaaaatccctacctttctccttataaggagttccaacgaatgaagcaccaccctttctttgccaacatcctcaaagatggtcaatgtatcgcctacggtgcccgagctctgaatgaaggaggcttccagtccataccgaaattgcacttccctggtggtgctttgatcggatgttctgctggtttcctcaatgtccccaagatcaaaggtactcataacgccatgaagtcgggtatgctcgccgccgaatcagcttttgctgctatcacctctaccgagtctagcgaagaagtttcccttgacactaatcccgcggacttgtctaattacgccaccgccatcgagaactcttggatctggtccgaactcaaggaggtcaggaatctcaggccgtctttccacaaccccctcggcctttggggtggtatggcctactctggcttggatagtttgatcttgaagggacgcgtgccttggacatttaggaactctgtagaggactatgaagcgaccaagaaggccagtgaagagaagcctatcgattatcctcagcctgatggcaagctctcttttgacatccttacctctgtttctttgacgggtaccaaccacgctgagaatcaacccgtgcatctgaggttacctaaggttgagggtgctagggcttcgcacaccaagatcaatgttgaggattacgctggtcttttgggcagggtctgccccgcggcagtttacgagtatgcggatgcagaaggtagcgaagtagacgcggatggcaagaagttcgtgatcaactcacaaaactgtatacactgtaagacatgttctattaagactcctacacaagacatcagctgggatgttcccgaaggcggtggcggtcccaagtactctatcacataa

SEQ ID NO: 100548 - protein, 615 aa, Cryptococcus neoformans var. neoformans JEC21
MAIITPISRLATSRTLTAASRSSSGALLRRPTALRIRTFASEAKFDPESVERAQDEVDVCIVGGGPAGLSAAIRLKQLEQERGGDELRVVVLEKGGEVGAHILSGAVIEPRALNELIPDWKELGAPLNQPALSDSMRFLTSNSSFPLPHPPQMNNKGNYIVSLSRFTAWLGEQAEALGVEVYPGFAGAKVLYTEDGKGIKGVITGDVGLDKDGNPKDNYEPGMEFHAKVTLIAEGAHGSLSKELQKKFNLREGKDPQTYGLGIKEVWKVKDEVYEPGKIVHTLGWPLDYKTYGGSWMYHMEDNMVSIGLVVGLDYQNPYLSPYKEFQRMKHHPFFANILKDGQCIAYGARALNEGGFQSIPKLHFPGGALIGCSAGFLNVPKIKGTHNAMKSGMLAAESAFAAITSTESSEEVSLDTNPADLSNYATAIENSWIWSELKEVRNLRPSFHNPLGLWGGMAYSGLDSLILKGRVPWTFRNSVEDYEATKKASEEKPIDYPQPDGKLSFDILTSVSLTGTNHAENQPVHLRLPKVEGARASHTKINVEDYAGLLGRVCPAAVYEYADAEGSEVDADGKKFVINSQNCIHCKTCSIKTPTQDISWDVPEGGGGPKYSIT

SEQ ID NO: 100549 - DNA, 1821 bp, Apis mellifera
  CDS (1)..(1821)
atgtctcgagtgaaaattaatatattaaataatttacagaagtttcaatggatatttcaaagagtttattcacaagaaaaatttccaaaaattacaactcattatactattgtgccaagagaattagatcaaagatggaaagatgtaaatatggaaagatatatagatgaaactgatattttaattgtgggaggtggtccagcaggattatctgctgcaattcaagcacgtaaattagcagaaaaatatggaaaagatctaaaagttacagttgttgaaaaagcttctactattggtggtcatatccttagtggagcttgtttagatccaatagctttaaatgaattatttcctaattggaaagaattaggtgctccattaaatactcctgtcacagaagataaatttgcatttcttactgaaaaaaatagactatcaatacctattttaaaaggaatgccaatgtataatcatgggaattatatagttagattaggtcatgttgtaacttggcttggggaacaagctgaagctatgggtgtagaaatatatcctggatatgctgcagcagaagtactttatcacgaagatggatctgttaaaggaatagctacaaatgatgttggtattgctaaagatggatcaccaaaagatacttttgaacgtggaatggaattacatgcaaaatgtaccatttttgcagaaggatgtcatggccatcttacaaaacaaatttcaaagaaattaaatctcagaaaagattgtgaaccacaaacttatgctataggattaaaagaaatatgggaaattgatctaaaaaaacataaacctggcactgttgaacatactattggttggccacttaaaaaagatacttatggtggttcatttttatattaccttaatgaagatacacctcttattgctattggttttgttattggtttggattattctaatccttatctacatccatttaaagaatttcaaagatttaaacaacatccaagtattaggccagtacttgaaggaggaaaaagaattgcatatggtgcaagagctttggtagaaggaggttttcaatctcttcctaaacttcaatttcctggtggttgtctaattggttgtacagcaggatttcttaatgtacctaaaatcaaaggaacacataatgctatgaagagtggaatgcttgctgcagaaagtataattgaagctctaattgatgcagaaaataatccttcaccaacaaaaggtttagaaccaaaaacttatactgaaaaaatacagaatagttggatttataaagaattaaaagctgtaagaaatataaggccaagttttcatacaaaatttggtctctatggaggtttattatattctggattttcaatgttagttggaggaaaagagccatggactttatcacatggaggtccagactatacaaaattaaaatcagcaactttatgtactccaatagaatatccaaaaccggataatgaaatatcttttgatttattatcatctgtagcacttactggcacaaatcatgaagctgatcaacctccacatcttactttagcagatgatactgtacctgtaaaaaaaaatttagctatatttgctggaccagaaggtcgattttgtcctgctggtgtatatgaatttgtaccattagaatctggagaaggagaaagattacaaattaatgctcagaattgtattcattgcaaaacttgtgatattaaggatccaagccaaaatatcaattgggttgtaccagaaggtgggggtggtccagcttacaacggaatgtaa

SEQ ID NO: 100550 - protein, 606 aa, Apis mellifera
MSRVKINILNNLQKFQWIFQRVYSQEKFPKITTHYTIVPRELDQRWKDVNMERYIDETDILIVGGGPAGLSAAIQARKLAEKYGKDLKVTVVEKASTIGGHILSGACLDPIALNELFPNWKELGAPLNTPVTEDKFAFLTEKNRLSIPILKGMPMYNHGNYIVRLGHVVTWLGEQAEAMGVEIYPGYAAAEVLYHEDGSVKGIATNDVGIAKDGSPKDTFERGMELHAKCTIFAEGCHGHLTKQISKKLNLRKDCEPQTYAIGLKEIWEIDLKKHKPGTVEHTIGWPLKKDTYGGSFLYYLNEDTPLIAIGFVIGLDYSNPYLHPFKEFQRFKQHPSIRPVLEGGKRIAYGARALVEGGFQSLPKLQFPGGCLIGCTAGFLNVPKIKGTHNAMKSGMLAAESIIEALIDAENNPSPTKGLEPKTYTEKIQNSWIYKELKAVRNIRPSFHTKFGLYGGLLYSGFSMLVGGKEPWTLSHGGPDYTKLKSATLCTPIEYPKPDNEISFDLLSSVALTGTNHEADQPPHLTLADDTVPVKKNLAIFAGPEGRFCPAGVYEFVPLESGEGERLQINAQNCIHCKTCDIKDPSQNINWVVPEGGGGPAYNGM

SEQ ID NO: 100551 - DNA, 1821 bp, Dictyostelium discoideum
  CDS (1)..(1821)
atgttaaaatcattttcattaattggtaaaaatattaccaaaaatgtttcattatcatcatcaaataaatttttatttggaaaaaatcatcaaaatatgaaatcaatttattcatcaattagatttttttcaagtgaacaagaattaccaccaagagattcagatcaatttgatgttgttattgttggtgcaggaccatcaggtttatcaacagcaattagattaaaacaattatcagagaaagcaggtaaagatttaagagtatgtgttgttgagaaaggttcagaagttggttcacatatattatcaggtgcagtaatggatccaaaagcattgaatgaattaataccagattggaaagagaaaggtgcaccattgataaccgaagtgaaacaagataaattctactttctaacagagaatagatcattaagattaccaacaccaagattaatgcataacgagggtaactatatcattagtttaggtaatgttgtcagatggttaggtgaacaagcagagtcaatgggtgttgaggtttatccaagttttgcagcatcagaggtgttataccacgataatggtgctgtcagaggcattgcaaccaacgatatgggtattgctaaagatggttcattgacctccaatttcactagaggtatggagttgaatgcaagattaacaatattcgccgaggggtgtagaggtagtttaactaaaggtttatttgaaaaattcaatttacgtgatgaatgtgaaccacaaacctttggtttgggtattaaagaaacatgggaaattaaaccagagaaacatcaacaaggtttggtaattcatacattgggctatccattgagtgatgagttattaggtggtagttttatttatcatgcagagaataatactgttaatttaggtttagtcgttggtttagattattcaaatccatacttaaatccatatcaagaatttcaaaaacttaaattacatccaatggtaaaggatatgttagagggtggtacatgtattcaatatggtgctagaaccatcaatgaaggtggtttccaatcaattccaaaacttgttttcccaggtggtgctttagttggttgtactgcaggtttcgttcatgtaccaaaagttaaaggttcacattatgcaatgaaaactggtatcttggctgctgaagctgcttttccacaattaatttctcaacaagaaaaagaacaagaacaagagcaagataaaccatcagttgaaccattattaattaatgaatatcctgaagaattaaagaaatcttgggtttggaaagaattaagagaagttagaaactatcgtccaagtcttcattggggtactataccaggattaatttatggtgctttggaaatgtatattttccgtggtcatactccatggactcttagtaatggtaaacctgataatgaacgtttaaaacctgctgccgaatgtaaaaagattgaatacaagaaaccagatggccaaatcacttttgatcttatgacctccgtcatgagatctggtacaaatcatgaagaaaatcaaccaattcacttaaaggttagagatatggaagtagctaaaaaagtaaatcgtgatatttacgatggtccagaaggtagattctgtcccgctggtgtctatgaatgggttgaaggtgaaaaaggtgaaaaagaattagttagaaatagtgtattctgtttacattgtaaaacttgtgatattaaagatccaactcaaaatatagatttcactgtaccagaaggtggtggtggtccaaaatatggtgctatgtaa

SEQ ID NO: 100552 - protein, 606 aa, Dictyostelium discoideum
MLKSFSLIGKNITKNVSLSSSNKFLFGKNHQNMKSIYSSIRFFSSEQELPPRDSDQFDVVIVGAGPSGLSTAIRLKQLSEKAGKDLRVCVVEKGSEVGSHILSGAVMDPKALNELIPDWKEKGAPLITEVKQDKFYFLTENRSLRLPTPRLMHNEGNYIISLGNVVRWLGEQAESMGVEVYPSFAASEVLYHDNGAVRGIATNDMGIAKDGSLTSNFTRGMELNARLTIFAEGCRGSLTKGLFEKFNLRDECEPQTFGLGIKETWEIKPEKHQQGLVIHTLGYPLSDELLGGSFIYHAENNTVNLGLVVGLDYSNPYLNPYQEFQKLKLHPMVKDMLEGGTCIQYGARTINEGGFQSIPKLVFPGGALVGCTAGFVHVPKVKGSHYAMKTGILAAEAAFPQLISQQEKEQEQEQDKPSVEPLLINEYPEELKKSWVWKELREVRNYRPSLHWGTIPGLIYGALEMYIFRGHTPWTLSNGKPDNERLKPAAECKKIEYKKPDGQITFDLMTSVMRSGTNHEENQPIHLKVRDMEVAKKVNRDIYDGPEGRFCPAGVYEWVEGEKGEKELVRNSVFCLHCKTCDIKDPTQNIDFTVPEGGGGPKYGAM

SEQ ID NO: 100553 - DNA, 1902 bp, Aspergillus nidulans FGSC A4
  CDS (1)..(1902)
atggcttcaagaggagtcgtgctgcgcctattgaggcgtgagactcggcctagcccctctaggctttcaagaccatcgtcatcgttatgcatcagttctcgcggctcaatcgcaacatcaggtagacgggcgagtgtccgctgctcagcacactccaggccgatccaggttcgcgcattttcgcagtcgatctcaaggaatctcaccgatgagaacggtcactttgatccccggcaggttgagcgggagtcggacgaggtagacgtctgcattgtcggcggtggtcctgctggtcttagcgctgcaattcgattaaaacaacttgccaatgaagccggaaacgaagaatttcgcgttatcgtcctagagaaggctggtgagattggcgctcatgttttatccggcaatgtgctcgaaccttcagctctggaagagttatttccggactggctgtcggaggataacccttcccgttttgaaggcgccaccccggccaaggaggataagatgcggttcttgacgaaaaattcgtcgatcccgattcctgcgccaccacaaatgaacaatcatgggaattatatcatcagtctgaacgagttgacaaagtggctcggcgagcgggctgaggagctgggagtggaagtatacgccggatttgctgccagtgaaatcgtttacaactcggacggttcagtaaagggtgtggcaaccaacgatctcggtgttgctcgggatggtcaagccaaagatacgtttgaacggggaatggagttccatgctcgtgtcacgcttcttggagaaggctgtcacggtagcttgaccaagcaagttaccaagaggtacgatctcagacgggacagccagccgcaaacatatggaatcggtattaaggaggtgtgggaaattcagccggagaagttcaagtcgggcgagattacacattccatgggatacccgctgccaaaggatacctacggcggtgcttggatgtatcactttggtgaaaacatggtcagcattggtttagtagtcggtcttgattatccgaacccgtggttgtcgccctatggagagttccagaagctcaagcatcatcctctgtatcgcgaggtcttggagggtggaaagtgcatttcctacggtgctcgagcattgaacgaaggtggttaccagtcaatccctaagtgtgcgttccccggaggtgccttgattggtgatagcgcaggtttcctcaatgtccccaagatcaagggcacgcatacggcgatgaggtcggcgatcttggcagcagagtctacgttcgccgccctgagaaatgacgcgggtggcactgtgttcctattcgactacgaggactcactccgtaagtcttcgatttggaaggagctgtacgaggtccgaaacatgcgaccgtctttcagcacacccctcggtatctacggaggtattttgtattccggccttgaggcttacattttccgcggccacaccccgtggacgctcaaacaccacggcacagatgcggcagccactaagctggcatctgaatgcgagaagatcgagtatcctaagcccgatggcaagatctcttttgatatcctgactagtgtgagccgaacgggtaccaaccacgaagaagaccagccggtgcacttgcaagtggaagactgggacaagcacacggacattgcctggcccaagtacaagggagttgagaatcgcttctgcccggctggggtgtacgaatatgtggaggattcaagtaaaccgcacggggttcggtttcagatcaacgctcagaactgcattcattgcaaaacatgtgatatcaaggtcccaacccaggacatcaactggcaaaccccccagggcggagaaggtcccaagtactttaagacataa

SEQ ID NO: 100554 - protein, 633 aa, Aspergillus nidulans FGSC A4
MASRGVVLRLLRRETRPSPSRLSRPSSSLCISSRGSIATSGRRASVRCSAHSRPIQVRAFSQSISRNLTDENGHFDPRQVERESDEVDVCIVGGGPAGLSAAIRLKQLANEAGNEEFRVIVLEKAGEIGAHVLSGNVLEPSALEELFPDWLSEDNPSRFEGATPAKEDKMRFLTKNSSIPIPAPPQMNNHGNYIISLNELTKWLGERAEELGVEVYAGFAASEIVYNSDGSVKGVATNDLGVARDGQAKDTFERGMEFHARVTLLGEGCHGSLTKQVTKRYDLRRDSQPQTYGIGIKEVWEIQPEKFKSGEITHSMGYPLPKDTYGGAWMYHFGENMVSIGLVVGLDYPNPWLSPYGEFQKLKHHPLYREVLEGGKCISYGARALNEGGYQSIPKCAFPGGALIGDSAGFLNVPKIKGTHTAMRSAILAAESTFAALRNDAGGTVFLFDYEDSLRKSSIWKELYEVRNMRPSFSTPLGIYGGILYSGLEAYIFRGHTPWTLKHHGTDAAATKLASECEKIEYPKPDGKISFDILTSVSRTGTNHEEDQPVHLQVEDWDKHTDIAWPKYKGVENRFCPAGVYEYVEDSSKPHGVRFQINAQNCIHCKTCDIKVPTQDINWQTPQGGEGPKYFKT

SEQ ID NO: 100555 - DNA, 1884 bp, Candida albicans SC5314
  CDS (1)..(1884): transl_table=12
atgttgattcaatcattgttaccaagagtaggaagtaggcgattgtttcctcgttcactaccaccattgagaaattctatcaattacactccatgtatcagaagattccatcaatcatgtacaagatacaatctaacgtcggaacaagaagaaattttacatcaagaacgtgccagagactatgtggatgtatgtatagtaggtgccggacctgctgggttatcgactgctataaagttgaaacaacttgataatgaacaaggtaatggggatttacgagtcattgttttggaaaaagcaggagattttggtagtcatatagttagtggtgcggttattgaaccacaagcttttaaagaattattccccgaaagtgaattgactgaagaaaacgggatcccattaccactggatattataacaaaagtaacatcggatcatatgaaatacttgactcctaatagtgcattcccattgccagaacctcctcagttaaccaataaggggaaaaactttattgttagtttaaatgaagttgtcaagtatctagctgaacaagctgaagagttgggagttgaattgtatccagggatttcagtgaatgaattggtttataacgaagataaatcagccataaaaggtatcataacccaagatatgggggttgatcgtaatggtgcaccaaaagatagttttgaaccgggtatggaattttttgcaagattgactgttttggccgaaggttgtcatggatcattgactaaaaatgccattagcaactttaacttgagagaaaattctgaacctcaaacatatggacttggaatcaaagaagtttgggaagtttcacccgaaaagtttgataaaggttatgtaggacattcattgggatatccattaacttcaaaggaatatggtggaggttttatttatcattttggtgacgggttagtcgccgttggtttggttattggattggattatgccaatccatacatctcaccttatcaagaattccaaaaaatgaaaactcatccattttatgccaatgtgttaaaaggtggtaaatgtatttcatacgctgcaagagctttgaatgaaggtgggtaccaatccattcccaaattgcatttccctggtggtattttggttggttgtgctgctgggtttgttaatgtgccaaaagttaaaggcactcacactgctgtgaagagtggtatagttgctgcagaaacaatcatctccactttcaaacaaatggaattggatccttgtgatgaagaaaactttgaagaattatccacgccaatagatttaagtcagtatgaagagaatttcaaagattcgtgggcatacaaggaattgtacgcagtgagaaatgtgcgtccttcattcaactctccacttggtatggttggaggtcttgttcactcaggtttgctgactatgattacacagggtaaagaaccatggactttatctcaccatggtaccgattcaggggcaactcaagatgcaaacaagttccaacctattgaatatccaaagcctgataatgaattgacttttgatattcttacctctgtgtcaagaactggtacctaccatgacgaagatgaaccatgtcatttaaaaataccagaccaagattgtcgaaaacatgctgaattaaactggaccaaatacagaggtgtcgaacaaagattctgtccagcaggagtctacgaatatattgaggatgaactggaaccattgggagtcaagttccaaataaatagtcaaaattgtattcattgtaagacgtgtgatattaaagtcccatctcaagacattacatggtctgtacctgaaggtggagatggtccaaagtattacatgtcctga

SEQ ID NO: 100556 - protein, 627 aa, Candida albicans SC5314
MLIQSLLPRVGSRRLFPRSLPPLRNSINYTPCIRRFHQSCTRYNLTSEQEEILHQERARDYVDVCIVGAGPAGLSTAIKLKQLDNEQGNGDLRVIVLEKAGDFGSHIVSGAVIEPQAFKELFPESELTEENGIPLPSDIITKVTSDHMKYLTPNSAFPLPEPPQLTNKGKNFIVSLNEVVKYLAEQAEELGVELYPGISVNELVYNEDKSAIKGIITQDMGVDRNGAPKDSFEPGMEFFARLTVLAEGCHGSLTKNAISNFNLRENSEPQTYGLGIKEVWEVSPEKFDKGYVGHSLGYPLTSKEYGGGFIYHFGDGLVAVGLVIGLDYANPYISPYQEFQKMKTHPFYANVLKGGKCISYAARALNEGGYQSIPKLHFPGGILVGCAAGFVNVPKVKGTHTAVKSGIVAAETIISTFKQMELDPCDEENFEELSTPIDLSQYEENFKDSWAYKELYAVRNVRPSFNSPLGMVGGLVHSGLSTMITQGKEPWTLSHHGTDSGATQDANKFQPIEYPKPDNELTFDILTSVSRTGTYHDEDEPCHLKIPDQDCRKHAELNWTKYRGVEQRFCPAGVYEYIEDESEPLGVKFQINSQNCIHCKTCDIKVPSQDITWSVPEGGDGPKYYMS

SEQ ID NO: 100557 - DNA, 1884 bp, Candida albicans SC5314
  CDS (1)..(1884): transl_table=12
atgttgattcaatcattgttaccaagagtaggaagtaggcgattgtttcctcgttcactaccaccattgagaaattctatcaattacactccatgtatcagaagattccatcaatcatgtacaagatacaatctaacgtcggaacaagaagaaattttacatcaagaacgtgccagagactatgtggatgtatgtatagtaggtgccggacctgctgggttatcgactgctataaagttgaaacaacttgataatgaacaaggtaatggggatttacgagtcattgttttggaaaaagcaggagattttggtagtcatatagttagtggtgcggttattgaaccacaagcttttaaagaattattccccgaaagtgaattgactgaagaaaacgggatcccattaccactggatattataacaaaagtaacatcggatcatatgaaatacttgactcctaatagtgcattcccattgccagaacctcctcagttaaccaataaggggaaaaactttattgttagtttaaatgaagttgtcaagtatctagctgaacaagctgaagagttgggagttgaattgtatccagggatttcagtgaatgaattggtttataacgaagataaatcagccataaaaggtatcataacccaagatatgggggttgatcgtaatggtgcaccaaaagatagttttgaaccgggtatggaattttttgcaagattgactgttttggccgaaggttgtcatggatcattgactaaaaatgccattagcaactttaacttgagagaaaattctgaacctcaaacatatggacttggaatcaaagaagtttgggaagtttcacccgaaaagtttgataaaggttatgtaggacattcattgggatatccattaacttcaaaggaatatggtggaggttttatttatcattttggtgacgggttagtcgccgttggtttggttattggattggattatgccaatccatacatctcaccttatcaagaattccaaaaaatgaaaactcatccattttatgccaatgtgttaaaaggtggtaaatgtatttcatacgctgcaagagctttgaatgaaggtgggtaccaatccattcccaaattacatttccctggtggtattttggttggttgtgctgctgggtttgttaatgtgccaaaagttaaaggcactcacactgctgtgaagagtggtatagttgctgcagaaacaatcatctccactttcaaacaaatggaattggatccttgtgatgaagaaaactttgaagaattatccacaccaatagatttaagtcagtatgaagagaatttcaaagattcgtgggcatacaaggaattgtacgcagtgagaaatgtgcgtccttcattcaactctccacttggtatggttggaggtcttgttcactcaggtttgctgactatgatcacacagggtaaagaaccatggactttatctcaccatggtaccgattcagaggcaactcaagatgcaaacaagttccaacctattgaatatccaaagcctgataatgaattgacttttgatattcttacctctgtgtcaagaactggtacctaccacgacgaagatgaaccatgtcatttaaaaataccagaccaagattctcgaaaacatgctgaattaaactggaccaaatacagaggtgtcgaacaaagattctgtccagcaggagtctacgaatatattgaggatgaactggaaccattgggagtcaagttccaaataaatagtcaaaattgtattcattgtaagacatgtgatattaaagtcccatctcaagacattacatggtctgtacctgaaggtggagatggtccaaagtattacatgtcctga

SEQ ID NO: 100558 - protein, 627 aa, Candida albicans SC5314
MLIQSLLPRVGSRRLFPRSLPPLRNSINYTPCIRRFHQSCTRYNLTSEQEEILHQERARDYVDVCIVGAGPAGLSTAIKLKQLDNEQGNGDLRVIVLEKAGDFGSHIVSGAVIEPQAFKELFPESELTEENGIPLPSDIITKVTSDHMKYLTPNSAFPLPEPPQLTNKGKNFIVSLNEVVKYLAEQAEELGVELYPGISVNELVYNEDKSAIKGIITQDMGVDRNGAPKDSFEPGMEFFARLTVLAEGCHGSLTKNAISNFNLRENSEPQTYGLGIKEVWEVSPEKFDKGYVGHSLGYPLTSKEYGGGFIYHFGDGLVAVGLVIGLDYANPYISPYQEFQKMKTHPFYANVLKGGKCISYAARALNEGGYQSIPKLHFPGGILVGCAAGFVNVPKVKGTHTAVKSGIVAAETIISTFKQMELDPCDEENFEELSTPIDLSQYEENFKDSWAYKELYAVRNVRPSFNSPLGMVGGLVHSGLSTMITQGKEPWTLSHHGTDSEATQDANKFQPIEYPKPDNELTFDILTSVSRTGTYHDEDEPCHLKIPDQDSRKHAELNWTKYRGVEQRFCPAGVYEYIEDESEPLGVKFQINSQNCIHCKTCDIKVPSQDITWSVPEGGDGPKYYMS

SEQ ID NO: 100559 - DNA, 2202 bp, Aspergillus fumigatus Af293
  CDS (1)..(2202)
atggcatcaaaaggagcggtcttgcctctcttgaggcgcgagctgcaaaccaatcgcacacaactgaatagagccgcttcatccttttcgactgttgccacgactgttcggagcaggagagcagtgtccgctaggcattcggctcgccacaccgcgctattctctcagagacaattactcggtcaaactcgggcattttcacagtcgctatcgacaaggcttgcagacgagcatgatcagttcgatccccgtcaagtagaaagggagtcggatgaggtggatgtgtgcattgttggtggcggtcctgccggtctcgcagcagctatccgactaaaacagctagcaaacgaggctggaaacgaggagtttcgtgtgattttgctggaaaaagcgggagagctgggcgcgcatatactttcaggcaatgttcttcaaccaactgcaatgaatgagcttctgcccgattggttgtctgaggagaatccgtcgcgatttgagggtgcaacaccagcgcgggaggacaagatgcgctttttgaccaagaacttgtcgttcccgatccccgccccaccccaaatgaacaaccatggcaactacattgtcagtctgaacgagctgacgaagtggttgggtgagcgagctgaggagttgggtgtcgagatttaccctggatttgctgctagcgagttagtctacaattcggatggctccgtcctcggcgttgcgacgaacgaccttggtgttggacgggacggcaaggccaaggacaattttgagcgaggtatggagttccacgctcgtgtaactctcctagccgagggctgccatggtagtttaacgaagcaggtaatcaagaagtacgacctcagacgtgatagtcaaccccagacttatggtatcgggttgaaggaggtgtgggagattcaaccggaaaagttcaagtcgggagagatcgtgcattctatgggatacccacttccttcggacacctacggtggtgcctggatgtaccattttggagagaatctggtcagcattgggctggtcgtcggcttggactatcccaacccgtggctttcaccttacggagagttccagaagctcaaacaccatcccctgttcagggaggtcttggagggcggtaaatgtatctcctatggtgctagggccctcaacgagggtggcttccagtcgattcctaaatgtgcttttccaggaggcgctctcatcggtgacactgctggcttcctgaatgttcccaaaatcaagggcactcattcggctatgaaatcgggcatgttggctgcggaggctactttcaatgctttgcagaatgacaacaatggtactgtcttccttttcgactacgaggatgctcttcgaaagtcctcgatctggaaggagctgtacgaagtgcgcaatatgcggccctcgttcaaatccccgctcggactttacggcggtatcctctactctggcttagaagccttcctgttccgcggcaaaacaccctggacactcaagcaccacggtacagatgcagcatccaccaaaccggcatctgaatgtgaaaagatcgaataccccaaacctgacggcgtgatcagcttcgatatcctgaccagcgtgagccgaacgggaacgaaccacgaggaggaccagcctgtccatttgcaggtcgctgattgggacaagcatacggacgtcgcttggcccaagtaccggggcattgaaaacagattttgtcctgctggagtctatgagtacgtcgaggatccaagcaagcagcacggcgttcgcttccaaattaatgcccaaaagatatcaattggcaaacaccccagggcggagaaggccctaaatacttcaagacataagctcatacccactgtacttttttttttctttcattttcatcatcttcaactgtttctatgtcgtttgaaaaggatagtttcgaatttatcctccgcagacttccgtcgatcaactctacgggttaaaacatcctttcctctgggtgacatcttgtttctactgacaggttctccctcttgggtgatgtttctcgatatgcaaagtaccaatagtctcggattactccgtagtccactggcatacgaagtagaaatttgcgtacctctctttgcaaattctcacttagcagcatgccatgagaacttccgagacccagactggtag

SEQ ID NO: 100560 - protein, 733 aa, Aspergillus fumigatus Af293
MASKGAVLPLLRRELQTNRTQLNRAASSFSTVATTVRSRRAVSARHSARHTALFSQRQLLGQTRAFSQSLSTRLADEHDQFDPRQVERESDEVDVCIVGGGPAGLAAAIRLKQLANEAGNEEFRVILLEKAGELGAHILSGNVLQPTAMNELLPDWLSEENPSRFEGATPAREDKMRFLTKNLSFPIPAPPQMNNHGNYIVSLNELTKWLGERAEELGVEIYPGFAASELVYNSDGSVLGVATNDLGVGRDGKAKDNFERGMEFHARVTLLAEGCHGSLTKQVIKKYDLRRDSQPQTYGIGLKEVWEIQPEKFKSGEIVHSMGYPLPSDTYGGAWMYHFGENLVSIGLVVGLDYPNPWLSPYGEFQKLKHHPLFREVLEGGKCISYGARALNEGGFQSIPKCAFPGGALIGDTAGFLNVPKIKGTHSAMKSGMLAAEATFNALQNDNNGTVFLFDYEDALRKSSIWKELYEVRNMRPSFKSPLGLYGGILYSGLEAFLFRGKTPWTLKHHGTDAASTKPASECEKIEYPKPDGVISFDILTSVSRTGTNHEEDQPVHLQVADWDKHTDVAWPKYRGIENRFCPAGVYEYVEDPSKQHGVRFQINAQKISIGKHPRAEKALNTSRHKLIPTVLFFFFHFHHLQLFLCRLKRIVSNLSSADFRRSTLRVKTSFPLGDILFLLTGSPSWVMFLDMQSTNSLGLLRSPLAYEVEICVPLFANSHLAACHENFRDPDW

SEQ ID NO: 100561 - DNA, 1695 bp, Trypanosoma cruzi
  CDS (1)..(1695)
atgtttcgtcgttcctgccgcattttttgcgcgcctgtggaacggatggtggaggaatttgacgttgtcattgtggggggtggccccgcgggattatctgcggccatccgcctgaaacagcttgccggcgatgcgaaggacgactttcgggttggactcgtcgagaagggaagtgagattggggcgcacacgctctctggcgcctgtattgagacacactcgctagatgagttgttaccggactggcgcaaagccacagatctgccgacaatgacagctgtcaagaatgatgcattatatcttcttcgggataaggagcgaagcatgaagtcgccgttgcttccgcccacactacacaatcgccattcctacattgtgtctcttggttccgtgtgtaaatggctaggcgagcgggcgacggagttgggtgtggagatatacccaggctttgccgcagcgcagccagtgtatgacggcagtggcgaggcgctagaaggggtgcagctgaatgacgttggtatcaacaagaggggtgaaaaaacaccccaatacgaacctggcatgatcttcaaggcaaagcaaactatatttgccgaaggatgccgcggatcctgtacaaagcagctagagaaaaagtttggtctccgtggtgagggaaatttccagacatatgggctcggcatcaaggaagtttgggaggtgccagcggaggcgcatcgtcctgggacggtgatgcacaccattggatggcccctcacggacaagggacatcacaacacatacggtggctccttcatgtatcactacggcgatggattgatttcacttggcttcgttattggtctggactatagcaacccgcatatccgaccgtacatggaaatgcagaagtggaagacgcacaagttgatttcgtcgcaactgaaggatggaaaacccctgctgtacggcgcacgaacccttgttgagggcggttacgtctctctgcccaaattacacttccccggtggcctgctcgttggtgactgcgccggatttttgaacctgccgaagattaaagggacccacacggcaatgaagtctggtatacttgcagcagaggcggtatacgatgacgcctttgcttccggaaaggaaaagcgggatggggtggagtgcaggagctacgacgatcggttccgcaacagttggctgcacaaggaactttacgcggtgcgcaatgtgcgccaggtgtttgcacgcaacttcttccagggtgttttgtacacagggatcacaacaacgatcacgcgcggctgggagccatggacgctttcacatcacaagccggaccacgaggccctcaaagtcgccgcggattgtgagccaatcgagtacccgaagcctgacgggaaactcacctttgatcttctcaccaaccatagccgtagcggcactgcgcacaacgccgaccaaccggcgcacctcaagctgaaggactcttcagtgccggaaaaagtcaatcttgctgtgtatgagggtcctgaggggaagtattgtcctgcaaaggtgtacgaattcgtggatgggaaattagtcatcaacgcacagaactgtctgcactgtaaggcttgtgatatcaaggatcccacgcagaacatcaattggagtgtgccggagggaggtggcggtccgaattacagtgcacagatgtga

SEQ ID NO: 100562 - protein, 564 aa, Trypanosoma cruzi
MFRRSCRIFCAPVERMVEEFDVVIVGGGPAGLSAAIRLKQLAGDAKDDFRVGLVEKGSEIGAHTLSGACIETHSLDELLPDWRKATDLPTMTAVKNDALYLLRDKERSMKSPLLPPTLHNRHSYIVSLGSVCKWLGERATELGVEIYPGFAAAQPVYDGSGEALEGVQLNDVGINKRGEKTPQYEPGMIFKAKQTIFAEGCRGSCTKQLEKKFGLRGEGNFQTYGLGIKEVWEVPAEAHRPGTVMHTIGWPLTDKGHHNTYGGSFMYHYGDGLISLGFVIGLDYSNPHIRPYMEMQKWKTHKLISSQLKDGKPLLYGARTLVEGGYVSLPKLHFPGGLLVGDCAGFLNLPKIKGTHTAMKSGILAAEAVYDDAFASGKEKRDGVECRSYDDRFRNSWLHKELYAVRNVRQVFARNFFQGVLYTGITTTITRGWEPWTLSHHKPDHEALKVAADCEPIEYPKPDGKLTFDLLTNHSRSGTAHNADQPAHLKLKDSSVPEKVNLAVYEGPEGKYCPAKVYEFVDGKLVINAQNCLHCKACDIKDPTQNINWSVPEGGGGPNYSAQM

SEQ ID NO: 100563 - DNA, 1695 bp, Trypanosoma cruzi
  CDS (1)..(1695)
atgtttcgtcgttcctgccgcattttttgcgctcctgtggaacggatggtggaggaatttgacgttgttattgtggggggtggccccgcgggattatctgcggccatccgcctgaaacagcttgccggcgatgcgaaggacgactttcgggttggactcgtcgagaagggaagtgagattggggcgcacacgctctctggcgcctgtattgagacacactcgctagatgagttgttaccggactggcacaaagccacagatctgccgacaatgacagctgtcaagaatgatgcattatatcttcttcgggataaggagcgaagcatgaagtcgccgttgcttcctcccacactacacaatcgccattcctacattgtgtctcttggttccgtttgtaaatggctaggcgagcgggcgacggagttgggtgtggagatatacccaggctttgccgcagcgcagccagtgtatgacggcagtggcgaggtgctagaaggggtgcagctgaatgatgttggtatcaacaagaggggtgaaaaaacaccccaatacgaacctggcatgatcttcaaggcaaagcaaactatatttgccgaaggatgccgtggatcctgtacaaagcagctagagaaaaggtttggtctccgcggtgagggaaatttccagacttatgggctcggcatcaaggaagtgtgggaagtgccagcggagacgcatcgtcctgggacggtgatgcacaccattggatggcccctcacggacaagggacatcacaacacatacggtggctccttcatgtatcactacggcgatggattgatttcacttggcttcgttattggtctggactatagcaacccgcatatccgaccgtacatggaaatgcagaaatggaagacgcacaagttgatttcgtcgcaactgaaggatggaaaacccctgctgtacggcgcacgaacccttgttgagggcggttacgtctctctgcccaaattacacttccccggtggcctgctcgttggtgactgcgccggatttctgaacctgccaaagattaaagggacccacacggcaatgaagtctggcatacttgcagcagaggcggtgtacgatgacgcctttgcttccggaaaggaaaagcgagatggggtggagtgcaggagctacgacgatcggttccgcaacagttggctgcacaaggagctttacgcggtgcgcaatgtgcgtcaggtgtttgcacgcaacttcttccagggtgtcttgtacacagggatcacaacaacaatcacgcgcggctgggagccatggacgctctcacatcacaagccggaccacgaggccctcaaagtcgccgcggattgtgagccaatcgagtacccgaagcctgacgggaaactcacctttgatcttctcaccaaccatagccgtagcggcactgcgcacaacgccgaccaaccggcgcacctcaagctgaaggactcttcagtgccggaaaaagtcaatcttgctgtgtatgagggtcctgaggggaagtattgtcctgcaaaggtgtacgaattcgtggatgggaaattggtcatcaacgcacagaactgtctgcattgtaaagcttgtgatatcaaggatcccacgcagaacatcaactggagtgtgccggagggaggtggcggtccgaattacagtgcgcagatgtga

SEQ ID NO: 100564 - protein, 564 aa, Trypanosoma cruzi
MFRRSCRIFCAPVERMVEEFDVVIVGGGPAGLSAAIRLKQLAGDAKDDFRVGLVEKGSEIGAHTLSGACIETHSLDELLPDWHKATDLPTMTAVKNDALYLLRDKERSMKSPLLPPTLHNRHSYIVSLGSVCKWLGERATELGVEIYPGFAAAQPVYDGSGEVLEGVQLNDVGINKRGEKTPQYEPGMIFKAKQTIFAEGCRGSCTKQLEKRFGLRGEGNFQTYGLGIKEVWEVPAETHRPGTVMHTIGWPLTDKGHHNTYGGSFMYHYGDGLISLGFVIGLDYSNPHIRPYMEMQKWKTHKLISSQLKDGKPLLYGARTLVEGGYVSLPKLHFPGGLLVGDCAGFLNLPKIKGTHTAMKSGILAAEAVYDDAFASGKEKRDGVECRSYDDRFRNSWLHKELYAVRNVRQVFARNFFQGVLYTGITTTITRGWEPWTLSHHKPDHEALKVAADCEPIEYPKPDGKLTFDLLTNHSRSGTAHNADQPAHLKLKDSSVPEKVNLAVYEGPEGKYCPAKVYEFVDGKLVINAQNCLHCKACDIKDPTQNINWSVPEGGGGPNYSAQM

SEQ ID NO: 100565 - DNA, 1803 bp, Canis familiaris
  CDS (1)..(1803)
atgtcggtgccgctggccaagctgtcctgcgcggcatatcagtgctttcatgccttaaaaattaagaaaagttatctacctctgtgtcatgcaagatggtcttcaacctctgttgtacctcgaattactacccactatactatttatccccgggataaggacaagcgatgggaaggagtgaacatggagaggtttgcagaagaagcagatgtagttatagttggtgcaggccctgcaggactttctgcagctgttcgtctaaagcaattggctactaaacatgaaaaggacatccgtgtgtgtctagtagagaaagctgctcaaataggagctcatactctctcaggggcttgccttgatccacgtgcttttgaagaattattcccagactggaaggagaagggagctccactgaatactccagtaacagaagacagatttggaattttaacagagaaatacagaattcctgtgccaattctcccagtaagctggatgggagaacaagcagaagcccttggtgttgaaatataccctggttatgctgctgctgaggtcctttttcatgaagatagtagtgtaaaaggaattgccactaatgacgtagggatacaaaaggatggtgcaccaaagacaacatttgagaggggactagaactacatgcaaaagttacagtttttgcagagggttgccatggacatctagccaaacaactgtataagaagtttgatttgagagccaattgtgatcctcaaacctatggaattggactgaaggagttatggattattgatgaaaagaagtggaagccagggagagtggatcacactgttggctggcccttggacagacacacttatggaggctccttcctctaccacttaaatgaaggcgaacccctggtagcccttggttttgtggttggtctagactaccagaatccatatttgagtccattcagagagttccagaggtggaaacaccatcctagcattcagccaacactggaaggtggaaaaaggattgcatatggagccagagccctgaacgaaggtggctttcagtctataccaaaactcacttttcctggtggtttactaattggttgtagtcctggttttatgaatgtacccaagatcaaaggtacccacacagcaatgaaaagtggaattttggcagcagaatctatttttaagcaactaactagtgaaaatctccaatcaaagacaattggactccatgtaactgagtatgaagacaatttaaagaaatcatgggtgtggaaagagctatatactgttagaaatataaggccgtcctgccatggaatactgggcgtatatggcgggatgatttacactggaatcttttactggatatttagaggaatggagccatggactctaaagcacaaaggttctgactctgatcagctcaagccagccaaggactgcacacctattgagtatccaaaaccagatggacagatcagttttgaccttctgtcgtctgtggcactgagtggtactaaccacgagcatgaccagccagcacacttaaccttaagggacgacagtatccccgtaaatcgaaatctgtccctattcgatggaccggagcagcgcttctgccctgcaggagtttatgaatttgtacctttggaacaaggtgatggatttcggttacagataaatgctcagaattgcgtacactgtaaaacatgtgatattaaagatccaagtcagaatattaactgggtggtacctgaaggtggtggaggacctgcttacaatggaatgtaa

SEQ ID NO: 100566 - protein, 600 aa, Canis familiaris
MSVPLAKLSCAAYQCFHALKIKKSYLPLCHARWSSTSVVPRITTHYTIYPRDKDKRWEGVNMERFAEEADVVIVGAGPAGLSAAVRLKQLATKHEKDIRVCLVEKAAQIGAHTLSGACLDPRAFEELFPDWKEKGAPLNTPVTEDRFGILTEKYRIPVPILPVSWMGEQAEALGVEIYPGYAAAEVLFHEDSSVKGIATNDVGIQKDGAPKTTFERGLELHAKVTVFAEGCHGHLAKQLYKKFDLRANCDPQTYGIGLKELWIIDEKKWKPGRVDHTVGWPLDRHTYGGSFLYHLNEGEPLVALGFVVGLDYQNPYLSPFREFQRWKHHPSIQPTLEGGKRIAYGARALNEGGFQSIPKLTFPGGLLIGCSPGFMNVPKIKGTHTAMKSGILAAESIFKQLTSENLQSKTIGLHVTEYEDNLKKSWVWKELYTVRNIRPSCHGILGVYGGMIYTGIFYWIFRGMEPWTLKHKGSDSDQLKPAKDCTPIEYPKPDGQISFDLLSSVALSGTNHEHDQPAHLTLRDDSIPVNRNLSLFDGPEQRFCPAGVYEFVPLEQGDGFRLQINAQNCVHCKTCDIKDPSQNINWVVPEGGGGPAYNGM

SEQ ID NO: 100567 - DNA, 1209 bp, Picrophilus torridus DSM 9790
  CDS (1)..(1209): transl_table=11
atggattacgatgtcgatcttgcaattgttggtggcggccttgccggtctttcagctgccattaccgcatccaggcttgggatatcttgcatagttcttgaacgcggtgagtactcaggatcaaagaacgtaagcggtggcagaatgtacattcattcactgaggcggctccttggcgatagatttgatgaggcccctctggaactgcccgttgagtcagagcgctattttataaaatgcggtgaaaaatcaattagtttctcattttctgaggagaataaaaaaaatagctacactgtgctccgtgcaaagtttgaccgctggctatcgcagtttgcagaggaagccggtgtgccagtttcatacagtaccctggtaaaaaatgcatcaagggacaatggaataatgcttgagacaaaccgtggtgatataagggcgccacttgttatagaggctgatggcgttggctcctcattatcaaggtttcttgataaaaaggagttaaaaccagagttttacatgcttggaataaaggagatcattgaaagcggtgaaaacaaaacaggtgaggccaatacatttataggctacagcgggggcgtcaagggcggtggctttatgtacacgaataaaaactcaatatctcttgggctgacattgaagatcgaatcattgcagaataataacgaaatatcacacgaactgatagagaaattccgtgaatcactgaacatggatggcaaaatacttgaatactcggcgcatatgataccattctacggatataaaaacataaaaaatatatcatcagagaacctgcttgtaacaggtgatgcagccggacttttaataaacgatggttttgcaatacgcggcatggaccttgcaatagaatcaggaatgatagcggcgcaggcggcagaaaagatcttaaaatcaaagaattacagtgatacatcaatatacaataaaatgatgtatggcagccaggtcatgaacgatctaaaaacggcatccagcatctttgatttatttaacagcgatgagttctttaatgtctatccaaaggttttatgcgatgccttttcaaaggtctttaccgttgatgatgattacagaaagccctttataaagtatgcaatggagagcgcgcacgataataatataagcctgttatcgatgcttagaaatatcatgagggtgatgtga

SEQ ID NO: 100568 - protein, 402 aa, Picrophilus torridus DSM 9790
MDYDVDLAIVGGGLAGLSAAITASRLGISCIVLERGEYSGSKNVSGGRMYIHSLRRLLGDRFDEAPLELPVESERYFIKCGEKSISFSFSEENKKNSYTVLRAKFDRWLSQFAEEAGVPVSYSTLVKNASRDNGIMLETNRGDIRAPLVIEADGVGSSLSRFLDKKELKPEFYMLGIKEIIESGENKTGEANTFIGYSGGVKGGGFMYTNKNSISLGLTLKIESLQNNNEISHELIEKFRESLNMDGKILEYSAHMIPFYGYKNIKNISSENLLVTGDAAGLLINDGFAIRGMDLAIESGMIAAQAAEKILKSKNYSDTSIYNKMMYGSQVMNDLKTASSIFDLFNSDEFFNVYPKVLCDAFSKVFTVDDDYRKPFIKYAMESAHDNNISLLSMLRNIMRVM

SEQ ID NO: 100569 - DNA, 1191 bp, Picrophilus torridus DSM 9790
  CDS (1)..(1191): transl_table=11
atgcttgattatgatgctgttgtggttggtgccggtccagccggatcggctgctgcactgaagcttgcaagccttggtaaaaaaacgctggttcttgaacgcggtccggaaccaggatcaaagaatgtctcaggcgcaatgataagaaaggactttgtaacatctgtcttcggtgatggattacctgtggaaagaaacgttgagagaatgaaggtatcattatacagcagcgagaggcctgttagtctggaattttatccagaaaatcttgcgacaactggcagattaaaatttgataaatggctctcatcagtttcggagaaggccggcgccattgtaataccaaaaacaacggtgacagacataaaatggaaggatggaagggcaacaggtgttgtaacagatcgcggagaggtttcaacgagatcaatagttcttgcagagggtgtaaactcattattggcaatatcatccggaataaaaagggagcttaaaccagatcaggctgttcagacagttaaatacgtttactcgataaaaaaagagcagataaattcaatgtttaatctatcatctgacgatgccggtctctcatggaggataatacgtgccgatcctgtgctcaccgcaggatttttatacacatacagggacagcgtttccgtaggcgttggcgccccaataagcggtttaatagagaagaagataaagccagaggagctcatggatatgtttatgaagtacacaggttttgaagacctttttaagggcttttcactgcgcgagtactctgcaaagatcataccagaggcgggttttcctgacatgcttgcatcaaaatcaaatgtttacctctgcggagatgcacttggacttgttgacccgctgacctttgatggaataagtcctgcaatagaatcaggtctactggcaggagaggctgcattttctaatatgccagaatttgaatacaggtattcattaataaaagataaggagatttcaaagattgcaaaggaacgtggccttgaatcaagattcttccatgaggatgcgccatcaaagtatcttacaatgatgtcaaaggttttaaatgactgggcatccggaaacctccttggaataaggggcgaccttatatcaggaacctcaatgaaggatgttcttgattttatgataagaatgaggtga

SEQ ID NO: 100570 - protein, 396 aa, Picrophilus torridus DSM 9790
MLDYDAVVVGAGPAGSAAALKLASLGKKTLVLERGPEPGSKNVSGAMIRKDFVTSVFGDGLPVERNVERMKVSLYSSERPVSLEFYPENLATTGRLKFDKWLSSVSEKAGAIVIPKTTVTDIKWKDGRATGVVTDRGEVSTRSIVLAEGVNSLLAISSGIKRELKPDQAVQTVKYVYSIKKEQINSMFNLSSDDAGLSWRIIRADPVLTAGFLYTYRDSVSVGVGAPISGLIEKKIKPEELMDMFMKYTGFEDLFKGFSLREYSAKIIPEAGFPDMLASKSNVYLCGDALGLVDPLTFDGISPAIESGLLAGEAAFSNMPEFEYRYSLIKDKEISKIAKERGLESRFFHEDAPSKYLTMMSKVLNDWASGNLLGIRGDLISGTSMKDVLDFMIRMR

SEQ ID NO: 100571 - DNA, 1659 bp, Bartonella quintana str. Toulouse
  CDS (1)..(1659): transl_table=11
atgaatgaaactctgtatcaacgcgaaagcatagagtttgacatagtgattgtgggagcaggacctgcaggactttctgccgcaattcgtctaaaacagattaatcccgaactatctgttacaatcgttgaaaaaggtagcgaagtcggtgctcatattctgtccggtgcagttgttgatcccatcggcattgatacacttttaccagaatggaggaacgaacccgatcatcccttcaaaacgcccgtcaccagtgaccaatttttttcgctaacgccgaagcaggctaaaatatttcccaatgtttttcgcccaaaaattttatcaaatgacggttgctatatcgtttcgcttggcgatgtctgccgctggctaagtaaaaaagccgaagcactcggtgttgaaatctatcctggatttgctgcatcggataccatccaaaacgataacggagctattattggtattctcacaggtgatatgggtcttgaaaaagatggaattcctggaaaaaattatatgcctggtatggccttactggcgaaatacacactcatcgcggaaggagcacggggctcaattgcaaaacaactgatacaaaaatttaatcttagccaaaaccgtgaaccacaaaaatttggtctaggtctcaaagagctttgggaagtcgatccccaaaaacacagccttggtttagttcaacattttaccggctggccattagacgataatactggcggtggaggttttctttatcatcaggaaaaaaatttaatttctgtcggtttcgttgtgcacttagattataaaaatccttatctctctcccttcgaagaatttcaacgttttaaaacacatcccaaactttatgagatcttcaaaggtgcaaaacgcctttcctatggtgcgcgcgctatcagcgaaggtggttggcaatctgtaccaaaactcacctttcccggtggtgcacttatcggctgttctgccggatttgtcaatgtccctcggatcaaaggatcacacaatgccatcttatccggcatattggcagctgataaaatcgctacagctcttgctcaaggtcgcgcccatgatgaaatcaatgaaatcgaagaacattggcgaaaaggtccgattggcaaagatctgtataaggcacgcaatgccaaaccactctgggcaaaatatggtacaaaatgcgggattaagcttgctggctttgatatgtggtggcaacaattattcggattttccttatttaaaacgctctctcatggaaaagtagattatgcatgtcttgaaccagcagaaaaatttcaacccattgcttacccaaaaccagatggtgttgtaacctttgaccgactttccagtgttgcgctttccaatacgcatcatgaagaaaatcaaccttgccatttaaaaatagcctcacttgaaaaacaaaaagattctgaatatgcaatttacgcaggaccttccgtacgctattgccctgctgctgtctacgaatggctagaccataatgatcatgaaacttatgttatcaacgcttcaaactgcatccattgtaaaacgtgcgatatcaaagatcctaatcaaaatatcaattggacctgtccgcaaggcaatgagggaccactttatccaaatatgtaa

SEQ ID NO: 100572 - protein, 552 aa, Bartonella quintana str. Toulouse
MNETLYQRESIEFDIVIVGAGPAGLSAAIRLKQINPELSVTIVEKGSEVGAHILSGAVVDPIGIDTLLPEWRNEPDHPFKTPVTSDQFFSLTPKQAKIFPNVFRPKILSNDGCYIVSLGDVCRWLSKKAEALGVEIYPGFAASDTIQNDNGAIIGILTGDMGLEKDGIPGKNYMPGMALLAKYTLIAEGARGSIAKQLIQKFNLSQNREPQKFGLGLKELWEVDPQKHSLGLVQHFTGWPLDDNTGGGGFLYHQEKNLISVGFVVHLDYKNPYLSPFEEFQRFKTHPKLYEIFKGAKRLSYGARAISEGGWQSVPKLTFPGGALIGCSAGFVNVPRIKGSHNAILSGILAADKIATALAQGRAHDEINEIEEHWRKGPIGKDLYKARNAKPLWAKYGTKCGIKLAGFDMWWQQLFGFSLFKTLSHGKVDYACLEPAEKFQPIAYPKPDGVVTFDRLSSVALSNTHHEENQPCHLKIASLEKQKDSEYAIYAGPSVRYCPAAVYEWLDHNDHETYVINASNCIHCKTCDIKDPNQNINWTCPQGNEGPLYPNM

SEQ ID NO: 100573 - DNA, 1659 bp, Bartonella henselae str. Houston-1
  CDS (1)..(1659): transl_table=11
atgaatgcacctatgcatcaacgcgaaagcatggaatttgacatagtaattgtgggagccggccctgcaggactttccgctgcaattcgtctgaaacaaattaatccagaactttctgtcacaatcgttgaaaaaggcactgaagttggtgcacatattctctctggtgcagttgttgatcctatcggtattgatacactcttgccagaatggagaaaggaacagaatcatcctttcaagacaccggtcaccagtgatcagtttttttttctaaagcccaaacatgctacattatttcccaatgtttttaatccaaaaatcttatcaaataacggatgctatatcgtttcgctcgggagtgtctgtcgctggctaagcaaaaaagccgaagcgctcggtgttgaaatctatcctggtttttccatatcggaaaccatagaaaacgataacggagccatcattggagtcctcacaggtgatgtaggcttaaacaaagatggaactcctggaaaaaattatacgcctggtatggcgttattagcaaaatatacgctgattgcggaaggagcgtgtggctccatcgcaaaacaactgatacaaaaatttgatcttagcaaaaaccgtgaaccacaaaagtttggtctcggtctcaaagagctttgggaagttgatcccaaaaaacataagcttggtttagttcaacattttgccggttggcccttagataataatactagtggtggtggttttctttatcaccaagaaaacaatctgatctctgttggttttgttgtacatttagattataaaaatccttacctttctccctttgaagagtttcaacgttttaaaacacatcccaaactctatgaaatcttcaaaggagcaaaacgcctttcctatggtgcacgtgttatcagcgaaggtggttggcaatctgttccaaaactgacctttcctggcggagcacttattggctgttcggctggtttggtcaatgtccctcggatcaaaggatcacacaatgccatcttatctggcatattggcagccgataaaattgtagcagctcttgcgcaaggtcgcgcccatgatgaagtcaaagaaatcgaagaagactggcgcaaaggtcctattggcaaggatctttataaagcacgaaatgtcaaacctctctgggcaaagtacggcacaaaatacgggattaagctcgccggctttgatatgtggtggcaacaattatttggattttccttatttaagacactctcacatggaaaagcagattacgcatgtcttgagccagcggaaaattttcaacccattgcttacccaaaaccagatggtatggtaacttttgaccgcctttccagtgttgcgctttctcatacacaccatgaagaaaaccaaccttgccatttaaaaatagcctcattagaaaaacaaaaaaattctgaatatgcaatctatggaggtccttccacccgctattgccctgctgctgtttacgaatggtcagagtataaggatcacaaaacttatatgatcaacgcttcaaactgcatacattgcaaaacctgtgacatcaaagatcccaatcaaaatattaattggacctgtccacaaggcaatgagggaccactttatctcaatatgtaa

SEQ ID NO: 100574 - protein, 552 aa, Bartonella henselae str. Houston-1
MNAPMHQRESMEFDIVIVGAGPAGLSAAIRLKQINPELSVTIVEKGTEVGAHILSGAVVDPIGIDTLLPEWRKEQNHPFKTPVTSDQFFFLKPKHATLFPNVFNPKILSNNGCYIVSLGSVCRWLSKKAEALGVEIYPGFSISETIENDNGAIIGVLTGDVGLNKDGTPGKNYTPGMALLAKYTLIAEGACGSIAKQLIQKFDLSKNREPQKFGLGLKELWEVDPKKHKLGLVQHFAGWPLDNNTSGGGFLYHQENNLISVGFVVHLDYKNPYLSPFEEFQRFKTHPKLYEIFKGAKRLSYGARVISEGGWQSVPKLTFPGGALIGCSAGLVNVPRIKGSHNAILSGILAADKIVAALAQGRAHDEVKEIEEDWRKGPIGKDLYKARNVKPLWAKYGTKYGIKLAGFDMWWQQLFGFSLFKTLSHGKADYACLEPAENFQPIAYPKPDGMVTFDRLSSVALSHTHHEENQPCHLKIASLEKQKNSEYAIYGGPSTRYCPAAVYEWSEYKDHKTYMINASNCIHCKTCDIKDPNQNINWTCPQGNEGPLYLNM

SEQ ID NO: 100575 - DNA, 1713 bp, Acinetobacter sp. ADP1
  CDS (1)..(1713): transl_table=11
atggaacacatcgaacgcgaagcgatggagtttgacgtagtgatcgttggtgctggacctgccggtctatctgctgcgattaaaattcgccaactcgcgattgaaaataatttacctgatctgtccgtctgcgtcgtcgaaaaaggttccgaagtaggtgctcacatcctctctggtgcagtacttgaacctcgcgccatcaatgaacttttccccaactggaaagaagaaggtgcgccgctcaatgtcccggtgactgaggataaaacctatttcctgatgtcggatgagaaatctcaggaagcaccgcactggatggtgcctaaaaccatgcacaatgatggcaattatgtcatctcgctgggcaatgtggtgcgctggttaggccagaaggcggaagagcttgaagtctcgatttttccaggctttgctgctgccgagattctgtatcatgctgatggtacggttaaaggcattcagaccggtgatatgggtattggcaaggatggcgaaccaacgcataactttgcgccaggttatgaactgcatgccaaatatacgctgtttgccgaaggttgccgtggtcatttaggcaagcgcctgatcaataagtttaatctggatcaggaggctgacccgcagcattacggtatcgggattaaagagctttgggaaatcgatcctgccaagcataaaccaggtctggtgatgcatggttctggctggccattgtctgaaacgggttcttctggtggctggtggttatatcatgccgagaataatcaggtgactttgggcatgatcgtggatttatcatatgaaaatccgcatatgttcccgtttatggaaatgcagcgctggaaaacccacccactgatcaaacagtatctggaaggtggtaagcgtatttcttacggtgcacgtgctgtggtcaaaggtggcttaaactcactgcccaagttgactttcccaggtggttgtctgattggtgatgatgcaggctttttgaactttgcgaaaatcaaaggctcacatacggccatgaaatctggcatgctttgcggtgaagccgtatttgaagcgattgcacgtggtgtcgaaaaaggcggtgatctagccattgcccgtgtcgttgaaggtgaagatttgtttgataaggagctcaccgcctacacgcagaaatttgataagagctggcttaaagaagagttacaccgcagtcgtaattttggtccagccatgcacaagtttggtttatggattggtggtgcatttaactttgtggatcagaacatttttaaagttccattcactctgcacgatcttcagcctgactacagcgcactgaaaactcaggatcaagccacctttaaaccgaattatccaaagccagatggcaagctgacgtttgaccgtttgtcttcggtatttgtatccaatacggtacatgaagaaaatcagccatcacacttgaaactgaccgatgccagtattcctgtggcggtgaatctaccgagatgggatgagccagctcagcgctactgccctgcgggtgtgtacgaaattgtggatgaaggtgaaggcaacaagcgttttcagatcaatgcagccaactgtgtgcactgcaaaacctgtgatatcaaggatccatctcagaatatcacatgggtgacgcctgaaggtggcggtgggccgaattacccaaatatgtga

SEQ ID NO: 100576 - protein, 570 aa, Acinetobacter sp. ADP1
MEHIEREAMEFDVVIVGAGPAGLSAAIKIRQLAIENNLPDLSVCVVEKGSEVGAHILSGAVLEPRAINELFPNWKEEGAPLNVPVTEDKTYFLMSDEKSQEAPHWMVPKTMHNDGNYVISLGNVVRWLGQKAEELEVSIFPGFAAAEILYHADGTVKGIQTGDMGIGKDGEPTHNFAPGYELHAKYTLFAEGCRGHLGKRLINKFNLDQEADPQHYGIGIKELWEIDPAKHKPGLVMHGSGWPLSETGSSGGWWLYHAENNQVTLGMIVDLSYENPHMFPFMEMQRWKTHPLIKQYLEGGKRISYGARAVVKGGLNSLPKLTFPGGCLIGDDAGFLNFAKIKGSHTAMKSGMLCGEAVFEAIARGVEKGGDLAIARVVEGEDLFDKELTAYTQKFDKSWLKEELHRSRNFGPAMHKFGLWIGGAFNFVDQNIFKVPFTLHDLQPDYSALKTQDQATFKPNYPKPDGKLTFDRLSSVFVSNTVHEENQPSHLKLTDASIPVAVNLPRWDEPAQRYCPAGVYEIVDEGEGNKRFQINAANCVHCKTCDIKDPSQNITWVTPEGGGGPNYPNM

SEQ ID NO: 100577 - DNA, 1350 bp, Propionibacterium acnes KPA171202
  CDS (1)..(1350): transl_table=11
ttgcggggtgtgggctcccagccttcggagacaccgccgccgttgtgggatgtcccgggcgttgagcctgatttcgatgtcattgtcgtcgggggtggtgtggctggtgccgtcgcggcgtacgagctagctggtgaggggcacgaagtactccttgtcgagcgtggccgagaacctggaagcaaaaatctctcaggaggtgttctttactgtcgggtccttgaggagatatttccgaacttccttcgagatgctccggtcgagcgcaagatcactcgcaaccaactgatgtttctgaatagggattcgtctgttgcagttgattatcgagatgcgcgactcgtggaccccgttaacgctgttaccgtcctccgggcgaaacttgatccgtggctgtcggaaaaatgcgaggaagctggcgtcactgtgatgtcaggtgttcgcgttgactcgttgatcgagcgtgatgggcagttcgtcggggttcgagctggtgacgatgagttgtattcgcgtgtggtcattgctgccgacggtgtgaattcatttctgagtcgtgacgctgggctccgtggaccggagcctaagaacaatcttgccgtcggcgtgaagtcggtaattggccttgacccgaaagtcatcgaagaacggttccaagttaagaacggcgagggggcagcgtacgcggttgtcggtgactgcacgaaaggtgttgggggaggtgggttcctttacacgaatattgacagcgtgtcagccgggatcgtcctacggttggatgatttagaaaggagtggggagtcaagctcgcagctgcacgaccacttcttgacgcacccggttgttgcgccactccttgctggtggcgagctgctggaatacggctgtcatcttgtagctgaaggtggtgccagtatgcagcacgacctggttgcgccagggctcttgatcgtcggcgacgctgccggctttacgctgaacactgggtttacggtacgggggatggacctcgctgcaggttccgccctcgccgctgcgaaatcggttgatctagccttgcgtaaccatgatgtcggtcatgggactctggatggttatatctccacttgcaatgaaagtttcgtgggtcgcgacatgaatacttatcggaacgccccggcattcctggaatctccagaaatgtacgacgatgtcggtcagctcgcggcggacgtgatgtataagatttatggtctcgatatgacccctcgaaaacacttacttccgacggtagcctctgcggtgaggtcatcgaacctgagtttttcccagatcgcctcaatcgggttcagagcaatgagggcattgtga

SEQ ID NO: 100578 - protein, 449 aa, Propionibacterium acnes KPA171202
MRGVGSQPSETPPPLWDVPGVEPDFDVIVVGGGVAGAVAAYELAGEGHEVLLVERGREPGSKNLSGGVLYCRVLEEIFPNFLRDAPVERKITRNQLMFLNRDSSVAVDYRDARLVDPVNAVTVLRAKLDPWLSEKCEEAGVTVMSGVRVDSLIERDGQFVGVRAGDDELYSRVVIAADGVNSFLSRDAGLRGPEPKNNLAVGVKSVIGLDPKVIEERFQVKNGEGAAYAVVGDCTKGVGGGGFLYTNIDSVSAGIVLRLDDLERSGESSSQLHDHFLTHPVVAPLLAGGELLEYGCHLVAEGGASMQHDLVAPGLLIVGDAAGFTLNTGFTVRGMDLAAGSALAAAKSVDLALRNHDVGHGTLDGYISTCNESFVGRDMNTYRNAPAFLESPEMYDDVGQLAADVMYKIYGLDMTPRKHLLPTVASAVRSSNLSFSQIASIGFRAMRAL

SEQ ID NO: 100579 - DNA, 1674 bp, Burkholderia mallei ATCC 23344
  CDS (1)..(1674): transl_table=11
atgacccccgcaagcctcatcgagcaatacggcccgcgcgaatcgatggaatacgacgtcgtgatcgtcggcggcggccccgcaggcctgtcggcggccatccggctcaagcagctcgccgccgagaaaggtgcggaaatcggcgtgtgcgtgctcgaaaagggctcggagatcggcgcgcacatcctgtcgggcgccgtgatggacccgcgcgcgatcaccgaactgttccccgactggaaggaaaagggggcgccgctcaacgtcgacgtcaccgaggaccgcttcctgttcctgaccgagaaaagctcgttccaggtacccaactgggcactgccggacaatttcaagaaccacggcaattacgtgatcagcctcggcaacgtcacgcgctggctcggccagcaggcggaagccctgggcgtcgagatcttcccgggcttcccggccgccgagatcctctataacgacgacggctcggtcaagggcgtcgcgacgggcaacatgggcgtcggcaaggacggcgagccgaccgagaacttccagctcggcatggagctgcacgcgaagtacacgctcttttgcgaaggcgcgcgcggccacctcggccgccagttgatggacaagttcaagctgaacgcgaacagcgacccgcaggcgtacgggatcggcatcaaggagctgtgggagatcgatccggtcaagcacaagccgggcctcgtgatccacacggccggctggccgctgtcgtcggacacgtacggcggctcgttcctgtatcacatggacaacaatcaggtcgtcgtcggcttcgtcgtcggcctcgcgtactcgaacccgtacctgtcgccgttcgaggagttccagcgctacaagacgcatccggcgatccggccgttcctcgaaggcggcaagcgcgtgtcgtacggcgcgcgcgcgatcaccgcgggcggcctgctgtcgctgccgaagacggtgttcccgggcggcgcgctcgtcggcgacgacgcgggcttcctgaacgcgtcgcggatcaagggcagccatgcggcgatcaagaccggcatgctcgccgccgaagccgcgttcgacgcggtgcaggcgggccgccaggccgacgaactgaccgcttacccggacgcgttcaagacgtcctggctgcacaccgagctctatcgcgcgcgcaacttcaagcagtggatgggcaaggggctgtatctcggcacgctgatggtcggcgtcgagcagaagctgatgaacggcaacgtgccgtggacgctgcatcaccagcacggcgaccacgagatgctgaagcccgcgtcgcagtgccagccgatcgactatccgaagccggacggcaagctgacgttcgaccggctgtcgtcggtattcatctcgaacacgaaccatgaggagaaccagcccgcgcacctgacgctgaaggacgcgagcgtgccggtcaacgtcaatctgcgcacgtatgcggggccggaagcgcgcttctgcccggccgccgtctatgaattcgtgaagaacgacgacggcagcgaccgcctcgtgatcaacgcgcagaactgcgtgcactgcaagacctgcgacatcaaggatccgacgcagaacatcgtgtgggtcacgccggaaggcggcggcgggccgaactacccgaacatgtga

SEQ ID NO: 100580 - protein, 557 aa, Burkholderia mallei ATCC 23344
MTPASLIEQYGPRESMEYDVVIVGGGPAGLSAAIRLKQLAAEKGAEIGVCVLEKGSEIGAHILSGAVMDPRAITELFPDWKEKGAPLNVDVTEDRFLFLTEKSSFQVPNWALPDNFKNHGNYVISLGNVTRWLGQQAEALGVEIFPGFPAAEILYNDDGSVKGVATGNMGVGKDGEPTENFQLGMELHAKYTLFCEGARGHLGRQLMDKFKLNANSDPQAYGIGIKELWEIDPVKHKPGLVIHTAGWPLSSDTYGGSFLYHMDNNQVVVGFVVGLAYSNPYLSPFEEFQRYKTHPAIRPFLEGGKRVSYGARAITAGGLLSLPKTVFPGGALVGDDAGFLNASRIKGSHAAIKTGMLAAEAAFDAVQAGRQADELTAYPDAFKTSWLHTELYRARNFKQWMGKGLYLGTLMVGVEQKLMNGNVPWTLHHQHGDHEMLKPASQCQPIDYPKPDGKLTFDRLSSVFISNTNHEENQPAHLTLKDASVPVNVNLRTYAGPEARFCPAAVYEFVKNDDGSDRLVINAQNCVHCKTCDIKDPTQNIVWVTPEGGGGPNYPNM

SEQ ID NO: 100581 - DNA, 1632 bp, Legionella pneumophila str. Paris
  CDS (1)..(1632): transl_table=11
gtggaacacgaaacgatggaatttgatgttatcatagtcggtgcagggccttctggattatccgctgcaatcaaattaaagcaactggctttagcttcacaaaaagaaattactatttgtatactggaaaaaggagctcaggtcggcgctcatattctttctggtgcagttttagaacccagaagcttaaaagaattactgccagagaattggcaacaggccccgctagatactcctgtcaacaaagatctgttttattttttgactcaaaataaatcatttaagctccctactccaaaacctatgcataatgaaggaaattttattatcagtttgggagagctatgtaagtttcttgcagaacaagcagaagctctaggctgtgaaatataccctggatttgcggcagcagaaattctctataatgataaaaatcaagtcataggtgtagctactggcgacgtaggaattgatcgacaagggaaaaaaactgataattatcaacctggcatgcatttattagccaaacaaactttatttgctgagggatgtcgcgggcaattaagtcaaacattaatgaatcgctatcatttaagagatcattcgcaaccacaaacttacggtatagggattaaagaaatctggcaagttgatgcatcccggcatgaacctggaaaagtcatccatactgttggttggcctcttgatcatgcgacctatggaggctcctttttgtatcatctttcagagcagagagttgctataggttttgttgtgggacttgactacaagaacccatggttaaatccttttggagagtttcagagatttaaaactcacccccttattaaatctgttctaacaggcggtgagcgaattggttatggagccagagcacttaatgagggaggatggcaatctctccctaaacttacctttcctggtggcgccttgattggagatgctgccggtttcctaaatgtgcctaaaattaaaggaattcacaccgcaatgcaatctggaatgcttgctgcacaagcttgctttgatgcgctaagtgaggaaaagagtggtcaatttgagctaagcgcttactctgaaaaaatcaatcaatcctggctaaagaaagagctatatgcagtgcgaaatattcgaccgggattcaaatacggtttatttcccggcctaattaatgctgccttggaaacttatgtaactcgagggtattctccatggactttaaaaaatcatgcggaccataaatcgttaattccagcagaaaaagctaaaaaaattaactatcccaagcccgatggcgtgctcacatttgataaactctcatctgtatttttatcaaatacatttcatgaagaaaatcaaccctgccatctcaagttaaaacaacctaagctggccattgaagtgaacttaaaccaatacgcttccccagaaagccgctattgcccggcagctgtttatgaaataatcgaagatgttgaaaaagggcctcgattgcaaattaatgcccagaactgtattcattgtaaaacgtgcgatattaaagatccacgtcaaaatatagtttggcaagcgcctgaaggtgggggtggaccgaattactcaggaatgtaa

SEQ ID NO: 100582 - protein, 543 aa, Legionella pneumophila str. Paris
MEHETMEFDVIIVGAGPSGLSAAIKLKQLALASQKEITICILEKGAQVGAHILSGAVLEPRSLKELLPENWQQAPLDTPVNKDLFYFLTQNKSFKLPTPKPMHNEGNFIISLGELCKFLAEQAEALGCEIYPGFAAAEILYNDKNQVIGVATGDVGIDRQGKKTDNYQPGMHLLAKQTLFAEGCRGQLSQTLMNRYHLRDHSQPQTYGIGIKEIWQVDASRHEPGKVIHTVGWPLDHATYGGSFLYHLSEQRVAIGFVVGLDYKNPWLNPFGEFQRFKTHPLIKSVLTGGERIGYGARALNEGGWQSLPKLTFPGGALIGDAAGFLNVPKIKGIHTAMQSGMLAAQACFDALSEEKSGQFELSAYSEKINQSWLKKELYAVRNIRPGFKYGLFPGLINAALETYVTRGYSPWTLKNHADHKSLIPAEKAKKINYPKPDGVLTFDKLSSVFLSNTFHEENQPCHLKLKQPKLAIEVNLNQYASPESRYCPAAVYEIIEDVEKGPRLQINAQNCIHCKTCDIKDPRQNIVWQAPEGGGGPNYSGM

SEQ ID NO: 100583 - DNA, 1632 bp, Legionella pneumophila str. Lens
  CDS (1)..(1632): transl_table=11
gtggaacacgaaacgatggaatttgatgttatcatagtcggtgcagggccttctggattatccgctgcaatcaaattaaagcaactggctttagcttcacaaaaagaaattactatttgtatactggaaaaaggagctcaggtcggcgctcatattctttctggtgcagttttagaacccagaagcttaaaagaattactgccagagaattggcaacaggctccgctagatactcccgttaacaaagatctgttttattttttgactcaaaataaatcatttaagctccctactccaaaacctatgcataatgaaggaaattttattatcagtttgggagaactatgtaagtttcttgcagaacaagcagaagctctgggctgtgaaatataccctggatttgcggcagcagaaattctctataatgataaaaatcaagtcataggtgtagctactggggacgtaggaattgatcggcaaggaaaaaaaactgataattatcagcctggcatgcatttattagccaaacaaactttatttgctgagggatgtcgcgggcaattaagtcaaacattaatgagtcgctatcatttaagagatcattcgcaaccacaaacttacggtatagggattaaagaaatctggcaagttgatgcatcccagcatgaacctggaaaagtcatccatactgttggttggcctcttgatcatgcgacttatggaggctcctttttgtatcatctttcagagcagagagttgccataggttttgttgtaggactagactacaagaacccatggttaaatccttttggagagtttcagagatttaaaactcacccccttattaaatctgttctaacaggcggtgagcgaattggttatggagccagagcacttaatgagggaggatggcaatctctccctaaacttacctttcctggcggcgccttgattggagatgctgccggtttcctaaatgtgcctaaaatcaaaggaattcacaccgcaatgcaatctggaatgcttgctgcacaagcttgctttgatgcgctaagtgaggaaaagagtggtcaatttgagctaagctcttactctgaaaaaatcaatcaatcctggctaaagcaagagctatatgcagtgcgaaatattcgaccgggattcaaatacggtttattgcccggtctaattaatgctgccttggaaacttatgtaactcgagggtattctccatggactttaaaaaatcatgcggatcataaatcgttaattccagcagaaaaagctaaaaaaattaactatcccaagcccgatggcgtgctcacatttgataaactctcatctgtatttttatcaaatacatttcatgaagaaaatcaaccctgccatctcaagttaaaacaacctaagctggccattgaagtgaacttaaatcaatacgcctccccagaaagccgctattgcccggcagctgtttatgaaataatcgaggatgttgaaaaagggcctcgattacaaattaatgcccagaactgtattcattgtaaaacgtgcgatattaaagatccacgtcaaaatatagtttggcaagcgcctgaaggtggggggggaccgaattactcaggaatgtaa

SEQ ID NO: 100584 - protein, 543 aa, Legionella pneumophila str. Lens
MEHETMEFDVIIVGAGPSGLSAAIKLKQLALASQKEITICILEKGAQVGAHILSGAVLEPRSLKELLPENWQQAPLDTPVNKDLFYFLTQNKSFKLPTPKPMHNEGNFIISLGELCKFLAEQAEALGCEIYPGFAAAEILYNDKNQVIGVATGDVGIDRQGKKTDNYQPGMHLLAKQTLFAEGCRGQLSQTLMSRYHLRDHSQPQTYGIGIKEIWQVDASQHEPGKVIHTVGWPLDHATYGGSFLYHLSEQRVAIGFVVGLDYKNPWLNPFGEFQRFKTHPLIKSVLTGGERIGYGARALNEGGWQSLPKLTFPGGALIGDAAGFLNVPKIKGIHTAMQSGMLAAQACFDALSEEKSGQFELSSYSEKINQSWLKQELYAVRNIRPGFKYGLLPGLINAALETYVTRGYSPWTLKNHADHKSLIPAEKAKKINYPKPDGVLTFDKLSSVFLSNTFHEENQPCHLKLKQPKLAIEVNLNQYASPESRYCPAAVYEIIEDVEKGPRLQINAQNCIHCKTCDIKDPRQNIVWQAPEGGGGPNYSGM

SEQ ID NO: 100585 - DNA, 1677 bp, Photobacterium profundum SS9
  CDS (1)..(1677): transl_table=11
atggatagagaatatatggcgtttgatgttgtgattgttggcgctggtcctgctggcttggctgccgcttgtcagcttgcacagctcaaccagaaagcaaataaaaaaggacaagacattagcatttgtgttgtcgaaaaaggcgctgaagtcggtgcacatattatctctggtgcgctatttgaaacccgtgcattagatgaactcttccctgaatggtcaacaatgggcgccccactcactacaccagtgactgacgataaattcatttacctaactaaccaacataatcatctgactgttccacatttcctcacaccacagcctatgcataacacagataaaaaccatgtgataagtttagccaacttatgccgctggctcgcccagcaagctgaaacactcggtgtagaaattttccctggttttgctgctgccagtattaattacgacgcagctggtgctgtgactggtattaatacgtcagatatggggcgagataaaaatggcgcccccaaagcgaatttcgaagcgggtatcgaactgaaagccaaatacactattttcgctgaaggatcacgaggaaatttgggtaaacaactgctcgataagtatcagctagaggcaggtaaacaacctcaacactatgcattggggctaaaagaaatatgggaagtgcctacagataatactcaatctaatgcaggtagtgttattcacgcagcaggttggcctttaaatgaatcagatacgactggcggtggctttctttatcatttagacggcaaccaaatcgccgttgggttaatcgttgatttgaattacagtaacccttatctaagccctttcgatgaattccagcgactgaaaaaacatcccgctttcagtaagcacctcaaaagtggacagcgtatttcttacggtgcgcgggctatttctaaaggcggattatcatctttgcccaaacagcaatttcccggtggcttgttagtaggttgtgatgcaggcacattaaatgtagccaagataaaaggcagccacactgcgatgaaatcaggcatgctagcggcagatgctatttttgaacaattacgatgtggtaatgctcaaaacgagccggattatgacttgttatttcaagcgtcttggctgtatcaagagctacaagaatcacgtaattttggtgcagagctacacaaatttggtagtttgttagggggtgtactcgctacctttgaacataatgtatgggcatctatttttaagcgtaaaacgccttggacaattacagatcaacaggccgatcatgagtgcttaaaagatattgcacaatgccaccctatttcctatcccaagcctgatggcatattgagtttcgataagccgtcatcggtatatttatcaggaacacaacatgaagaaaatcaaccttgccacttagtactcgccgataacaacattcctattcatacccatttaccacgctatgatgaacccagtcagcgctattgccccgcaggcgtctatgaaatcatcacggtcgatgataaacctaaactgcacatcaacgctgctaactgcgtacattgtaaaacctgcgacattaaagatccgtcgcagaatatcacttggcatccacctgaaggtggcggcgggccaaattatcaaaatatgtaa

SEQ ID NO: 100586 - protein, 558 aa, Photobacterium profundum SS9
MDREYMAFDVVIVGAGPAGLAAACQLAQLNQKANKKGQDISICVVEKGAEVGAHIISGALFETRALDELFPEWSTMGAPLTTPVTDDKFIYLTNQHNHLTVPHFLTPQPMHNTDKNHVISLANLCRWLAQQAETLGVEIFPGFAAASINYDAAGAVTGINTSDMGRDKNGAPKANFEAGIELKAKYTIFAEGSRGNLGKQLLDKYQLEAGKQPQHYALGLKEIWEVPTDNTQSNAGSVIHAAGWPLNESDTTGGGFLYHLDGNQIAVGLIVDLNYSNPYLSPFDEFQRLKKHPAFSKHLKSGQRISYGARAISKGGLSSLPKQQFPGGLLVGCDAGTLNVAKIKGSHTAMKSGMLAADAIFEQLRCGNAQNEPDYDLLFQASWLYQELQESRNFGAELHKFGSLLGGVLATFEHNVWASIFKRKTPWTITDQQADHECLKDIAQCHPISYPKPDGILSFDKPSSVYLSGTQHEENQPCHLVLADNNIPIHTHLPRYDEPSQRYCPAGVYEIITVDDKPKLHINAANCVHCKTCDIKDPSQNITWHPPEGGGGPNYQNM

SEQ ID NO: 100587 - DNA, 1662 bp, Haloarcula marismortui ATCC 43049
  CDS (1)..(1662): transl_table=11
atgactgacaccgccgagaagtacgaggcagtcgtcgtcggctgtggcccgggcggggccgctgcggcggcgacgctcgcccgcaacggcgtcgaaacgctcgtcctcgaacgcggcgtcgacgccgggtcgaagaacgtctcgggcgggctcatctacgccgaggagtcggcaccctacaccatcgacggcctgttcccggacttccgcgaggaagcggcggagcggccggtgacggagaacctcatccacaatatcgccggcgacagggtgaaatccttcgacatcggcgacctgcatcaccacgacacggcgtgggccgacgcggtgttgcgccggaagatggactcctggctcgcccagcaggtccacgagcgcacccgggagaccggcggcggcctgctgaccgaggtccacgtcaccggcctgttgcgcgaacgaggcgaaattgtcggcgtgacgacagaggagttggaccccatcaaagccgacatcatcgtggcggccgacggcgtcaactccgaactcgcccgcgacgccgggctgatggactgggacgagcccgaagagtggtttcagggcgtcaaggcagtcgtcgacatggagccggaggtcatcaacgaccgcttcgacgtggcctccgacgacggcgcggcccacctgttctcgggcgacctgttcgacggcgtccgtggtggcggcttcctctacaccaatgagtcctcgctgtctatcggcaccgtgttccacctcgattccatcgccgaggagcgggccgagccccacgaactgctcgacagcctgctcacgcatccgctcatggcccagtggctcggcgacgaatacgacgagcgcgagtacagcgcgaaactcgtcccggactcgaagaaggcggcccatccctcgccgcacgaggaccgcctcgtgctggtcggcgacgccgccggccagatgcaggcacagggacccatcatcaaggggatgaaccacgcggtcactgccggggcgctggccgccgaggcgttcgccgacgcgagggcacgcggcgacccgtctcaggccggcaaactgtacgagaagaagctccacgacgagggcgtgatggacaagctccggccgaccgggtacagggtgttcggacagctcggcgaactcgggcctgtcgacaacctctcgaacgctatcgcggagtccgccgtcggccggttcggggtccgcgcggcagccggactgctcgaacgggcctactcgtcaccgcggttggtgtcgatgattcccgacaccaaactgccctacgtgacgctgccgacggtcattgccgaggaactgggtgagcccgtgaccgacgagaacaccgtctcgccacccgacctgggtgaccgtatcggcgacctgacctatgacgtgggtgacccgcacatcgaactggtcgacaagtccttcgaggcctcgggcaccgccgtcacggcctgcccggtcagcgccgaagacttcggcggcggctgttaccgcgacgaaatggtccagaccaacggcagcgaggaacacctcgtgagcctcgacacccagccctgcgtcgagtgtggcacctgtgctatcgtcgccgacaccgagtgggaacaccccgctggcgggaaaggcgtggagttcaaccaggggtga

SEQ ID NO: 100588 - protein, 553 aa, Haloarcula marismortui ATCC 43049
MTDTAEKYEAVVVGCGPGGAAAAATLARNGVETLVLERGVDAGSKNVSGGLIYAEESAPYTIDGLFPDFREEAAERPVTENLIHNIAGDRVKSFDIGDLHHHDTAWADAVLRRKMDSWLAQQVHERTRETGGGLLTEVHVTGLLRERGEIVGVTTEELDPIKADIIVAADGVNSELARDAGLMDWDEPEEWFQGVKAVVDMEPEVINDRFDVASDDGAAHLFSGDLFDGVRGGGFLYTNESSLSIGTVFHLDSIAEERAEPHELLDSLLTHPLMAQWLGDEYDEREYSAKLVPDSKKAAHPSPHEDRLVLVGDAAGQMQAQGPIIKGMNHAVTAGALAAEAFADARARGDPSQAGKLYEKKLHDEGVMDKLRPTGYRVFGQLGELGPVDNLSNAIAESAVGRFGVRAAAGLLERAYSSPRLVSMIPDTKLPYVTLPTVIAEELGEPVTDENTVSPPDLGDRIGDLTYDVGDPHIELVDKSFEASGTAVTACPVSAEDFGGGCYRDEMVQTNGSEEHLVSLDTQPCVECGTCAIVADTEWEHPAGGKGVEFNQG

SEQ ID NO: 100589 - DNA, 1287 bp, Salmonella enterica subsp. enterica serovar Paratyphi A str. ATCC
  CDS (1)..(1287): transl_table=11
atgtccgaagatatctttgatgccatcatcgtgggtgcaggtctggccggttcggttacggcgctggtgcttgctcgcgaaggtgcacaggtgctggttatcgagcgcggcaattctgctggcgcgaagaatgtcaccggtgggcgtttgtatgcacatagcctggagcgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcaccggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctggggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatga

SEQ ID NO: 100590 - protein, 428 aa, Salmonella enterica subsp. enterica serovar Paratyphi A str. ATCC
MSEDIFDAIIVGAGLAGSVTALVLAREGAQVLVIERGNSAGAKNVTGGRLYAHSLERIIPGFADQAPIERMITHEKLAFMTDNGAMTIDYCNGEDASASQVSYSVLRSKFDAWLMEQAEEAGAQLITGIRVDNVVQRDGKVVGVEADGDILEAKVVILADGVNSLLAEKLGMAKRVEASHVAVGVKELIELPKSVIEDRFQLQGNEGAACLFAGAPTDGLMGGGFLYTNETTLSLGLVCGLHHLKDAKKSVPQMLEDFKQHPAVAPLIAGGKLVEYAAHVVPEAGMNMQPELVGDGVLIAGDAAGMCMNLGFTIRGMDLAISAGEAAAKTVLSAMKRDDFSKQSLGEYRQHLDEGPMRDMRMYQKLPAFLDNPRMFTAYPEMAVSIARDLFTVDGSAPVPMRKKILRHAKKVGFINLMKDGLKGVTVL

SEQ ID NO: 100591 - DNA, 1650 bp, Idiomarina loihiensis L2TR
  CDS (1)..(1650): transl_table=11
gtggaacgcgaaagcatggaatttgatgtcgtcatagttggtgcaggcccgtcagggttggcaaccgcctgtcgactcggccaactcgcacaggaaaatgagcaagaactcatgatatgcgtagttgagaaaggcgctgatattggcgctcatattttatccggcgcggtgttcgaaccacgagccctgaacgaacttttccctgactggaaagatcgcggcgccccgctcaataccgaagttaccggcgatgatgttttattgctaaaagacgaaaataatcacagtcgcctgcctgactttagtgtgcctaaaacctttcacaataaaggcaattacattgccagtatgggtaacctgtgtcgttggatggcagaacaagccgaacaactgggcatcgaaatatttcctggttttgcggcctctgaaattctgtataacgacgatggcagcgttgcgggtattcaaaccggtgacatgggtgtggctaaagacggtagcgaaaaagacggctatatgccgggaatggaactgcgtgctaaatacaccttattcgcagaaggttgtcgcggtcatttaggcaaagagctgattagcaggtttgaactggataaagacagcaccccgcaacattatggtctaggctttaaagaaatttgggatgtaccagaggacatgcacgagcccggcaaagtggttcacaccgcaggctggccgctaaccgacagtgatgctactggcggcggttatctatatcatgccgaagacggacaagtgtacttaggccttattgttgatcttaactacgctaacccttacctgaatccatttcaggagtttcagcggttcaaaactcacccggctattaagcaaatcattgaaaatggtaagcgggtgtcctacggcgcacgcgctattgctaaaggtggctattattcgttaccgaaaatgaccttccccggaggtttgctggttggctgtaacgcaggcaccttaaactttgccaagatcaaaggaaaccataccgcaatgaagtcgggtatggtggccgctgaatgtgtatttgaacagctaaaaaatggtaaagccaacgacgacattaccagctacaaagaggcgtttgaaaagtcctgggtatttgatgaattgtatcgctcacgcaatttcggcggtgctgtgcataaattgggcacaatacttggcggcgcttataatatggtcgatcaaaattggtttggtggtaaattaccctttaaatttaaagagtggacaccggattataaagcgacaggtaaagccgaaaactatacggcaatcgactatccaaaagcagataataaactgacatttgatcgtctgtcatcggtatttttgtccaataccaatcacgcagaagatcaaccctgccatttaaagctcagtgacgctaatattccattagaggtcaatttaccgaagtatgcagagcctgcgcaacgctattgccctgccggggtttatgaagtggttgaagaagacggcaaacaagtttttcaaattaatgcgcaaaactgcatacactgtaaaacttgtgatattaaagatcctagccagaatataacctgggttgtgcccgaaggtggcggcggacctacctaccctaatatgtaa

SEQ ID NO: 100592 - protein, 549 aa, Idiomarina loihiensis L2TR
MERESMEFDVVIVGAGPSGLATACRLGQLAQENEQELMICVVEKGADIGAHILSGAVFEPRALNELFPDWKDRGAPLNTEVTGDDVLLLKDENNHSRLPDFSVPKTFHNKGNYIASMGNLCRWMAEQAEQLGIEIFPGFAASEILYNDDGSVAGIQTGDMGVAKDGSEKDGYMPGMELRAKYTLFAEGCRGHLGKELISRFELDKDSTPQHYGLGFKEIWDVPEDMHEPGKVVHTAGWPLTDSDATGGGYLYHAEDGQVYLGLIVDLNYANPYLNPFQEFQRFKTHPAIKQIIENGKRVSYGARAIAKGGYYSLPKMTFPGGLLVGCNAGTLNFAKIKGNHTAMKSGMVAAECVFEQLKNGKANDDITSYKEAFEKSWVFDELYRSRNFGGAVHKLGTILGGAYNMVDQNWFGGKLPFKFKEWTPDYKATGKAENYTAIDYPKADNKLTFDRLSSVFLSNTNHAEDQPCHLKLSDANIPLEVNLPKYAEPAQRYCPAGVYEVVEEDGKQVFQINAQNCIHCKTCDIKDPSQNITWVVPEGGGGPTYPNM

SEQ ID NO: 100593 - DNA, 1653 bp, Azoarcus sp. EbN1
  CDS (1)..(1653): transl_table=11
atgagtcgtgaagcaatggaattcgacgtcgtgatcgtcggcggcggcccggccgggctgtccgcggcgatccgcctgaagcagctcgccgcggacgctggcagcgagctgtcgatctgcgtcatcgagaaaggctcggaagtcggcgcgcacatcctgtcgggcgcggtgatggacccgcgcgcgctcgccgagctttttcccgactggcaggcgctcggcgcgccgctaaaagccgcggtcaccgaagaccgcttcctgctgctcggtgacaccggcgggcggcagctgccgaacgcgctgctgccccaatgtttccacaaccacggcaattacgtcgtcagcctcggcaacgtgtgccgctggctcgcgacgcaggccgaagcgctcggcgtcgacgtctatgccggcttcgccggggccgagatcctgtacgacgccgaaggccgcgtgacgggtgttgcgaccggcgacatgggacggctgaaggacggctcggaaggcccaaacttccaaccgggcatggagctgcaggcgaaatacacgctgttcgccgaaggctgccgcggccacctcggcaagcagctcgaggcgaagttcgacctgcgccgcgactgcgatccgcagacctacggcatcggcatcaaggagctgtgggaactcaagcccgaacgccaccgccagggcctcgtgatccacaccggcggctggccgctcgagccggacacctacggcggtggcttcctgtaccacatggaagacaacctggtgtcggtcggcttcgtcgtcggcctcggctaccgcaacccgcacctgtcgccgttcgacgagatgcagcgactcaagactcacccgctgctgaaggatttcttcgccggggcgcgtcgcgtcgcgtacggggcgcgcgcgatcgcggccggcggcctgcagtcgatgccgaagctggtgttcccggggggagcgctgatcggcgacgacgcgggcttcctcaacgcgagccgcatcaagggttcgcactgcgcgatcaagtccggcgcgctcgccgcggaagcctgtttcgccgcgctcgcgacgggccgcacgcacgacgagctcaccgcctaccccgaagcgttccgtgcgagctggctgtacgacgaactgcacaaggcgcgcaacttcaagccgtggatgagcaaaggcctgaagacgggctcgttgatgttcggcattgaccagatcgtgctgcgcgggcgcgcgccgtggacgctgaagaacagcgccgaccacggcaagctgcgacctgcggccgaaactgcgccgatcgtctatccgaagccggacggcgtgctgacgttcgaccggctgtcgtcggtgttcatctcgaacacgaaccacgaggaagaccagccctgccacctgacgctgggcgatgccgcggtgccgatcgccgtgaacctcgcgcagttcgacgcgccggagcaacgctactgcccggccggcgtctacgagatcgtgcgcgacgcggacgcctcatctgccagcagcgcgcggctgcagatcaacgcgcagaactgcctgcactgcaagacctgcgacatcaaggatccgacgcagaacatcacgtgggtcgtgccgcagggcggcgaaggaccgaactacccgaacatgtga

SEQ ID NO: 100594 - protein, 550 aa, Azoarcus sp. EbN1
MSREAMEFDVVIVGGGPAGLSAAIRLKQLAADAGSELSICVIEKGSEVGAHILSGAVMDPRALAELFPDWQALGAPLKAAVTEDRFLLLGDTGGRQLPNALLPQCFHNHGNYVVSLGNVCRWLATQAEALGVDVYAGFAGAEILYDAEGRVTGVATGDMGRLKDGSEGPNFQPGMELQAKYTLFAEGCRGHLGKQLEAKFDLRRDCDPQTYGIGIKELWELKPERHRQGLVIHTGGWPLEPDTYGGGFLYHMEDNLVSVGFVVGLGYRNPHLSPFDEMQRLKTHPLLKDFFAGARRVAYGARAIAAGGLQSMPKLVFPGGALIGDDAGFLNASRIKGSHCAIKSGALAAEACFAALATGRTHDELTAYPEAFRASWLYDELHKARNFKPWMSKGLKTGSLMFGIDQIVLRGRAPWTLKNSADHGKLRPAAETAPIVYPKPDGVLTFDRLSSVFISNTNHEEDQPCHLTLGDAAVPIAVNLAQFDAPEQRYCPAGVYEIVRDADASSASSARLQINAQNCLHCKTCDIKDPTQNITWVVPQGGEGPNYPNM

SEQ ID NO: 100595 - DNA, 1644 bp, Azoarcus sp. EbN1
  CDS (1)..(1644): transl_table=11
atggaacgcgaatcaatggaattcgatgtcctgatcgtaggcggcggcccggcagggctggcggcggcgatccggctcaagcagctcgccagcgagaaaggcacggagctggcggtatgcctgatcgagaaggcttccgagatcggcgcccatatcctgtcgggcgcagtgatggacccgcgcgcgctcaccgaactgattcccgactggaaagcgcagggcgcgccggtcaatacccaggtatccgaagaccgcgtgatcttcctgagcgagaccggcgggcgcagggtgcccaatagcctgctgccggcctgtttcctgaaccagggcaattacatcgtgcggctgggcaacgtcgtcaagtggctcggtgaacaggccgaggcgatgggcgtcgaagtctatccgggctttgccggcgcggaaatcctttacgacgagcgcggcgcggtcaagggcgtggcgaccggcgacatgggcgtcacgcgcgatggcgagcccggcccggcctaccagcccggcatggagctgcacgccaaatacacgctgttcgccgaaggctgtcgcggccatctcggcaagcagctcgaggaaaagtaccgcctgcgcgacggcatcgacccgcagacctacggcatcggcctgaaagaactgtgggaagtgccggccgagcagcacgtgcccggcctggtcgtgcacaccgccggctggccgatggacagcgccacttacggcggcggcttcgcctatcacctcgaggacaacctcgtcgctgtcggctatgtcgtggggctcaactactcgaacccgcatctggcgccgttcgaggagttccagcgctacaagacgcaccccgagatccgcaagttcctcgaaggcggcaagcggctggcctacggtgcgcgcgcgctcacggccggtgggctgcagagccagccgaagctggtgttcccgggcggcgcgctcgtcggcgacgacgcgggtttcctcaacgccgcgcgcatcaagggcagccacgccgcgataaagtccggctcgctcgccgccgaagcggccttcggcgctctcgccgccaatcggagccgcgacgaactgaccgcgttccccgaagcgttccgcgcgagctggctgtttgatgagctgcaccagacgcgcaacttcaagccctacatgaaaaaaggcctgtggatggggtccttgctgttcggcatcgaccagcaggtgttccgtgggcgcgcgccgtggacgctgcacaacacagccgaccacactgcgctcaagcccgcgtccgagtgctacaagatcgcctatccgaagcccgacggcgtgctgactttcgacaagctgtcgtccgtgttcctgtcgaacacgaaccacgaggaagaccagccctgccatctgcagctgaaggacccgtcgatcccgatcgcggtgaacctcgcgaagtacgacgcgcccgaacagcgctactgcccggccggcgtgtacgagatcgtgcgcgaccccgacggcacccacccacgactgcagatcagcgcgcagaactgcgtgcactgcaagacctgcgacatcaaggacccgacgcagaacatcaactgggtcgtgccgcagggcggcgaagggccgatctatcaggggatgtga

SEQ ID NO: 100596 - protein, 547 aa, Azoarcus sp. EbN1
MERESMEFDVLIVGGGPAGLAAAIRLKQLASEKGTELAVCLIEKASEIGAHILSGAVMDPRALTELIPDWKAQGAPVNTQVSEDRVIFLSETGGRRVPNSLLPACFLNQGNYIVRLGNVVKWLGEQAEAMGVEVYPGFAGAEILYDERGAVKGVATGDMGVTRDGEPGPAYQPGMELHAKYTLFAEGCRGHLGKQLEEKYRLRDGIDPQTYGIGLKELWEVPAEQHVPGLVVHTAGWPMDSATYGGGFAYHLEDNLVAVGYVVGLNYSNPHLAPFEEFQRYKTHPEIRKFLEGGKRLAYGARALTAGGLQSQPKLVFPGGALVGDDAGFLNAARIKGSHAAIKSGSLAAEAAFGALAANRSRDELTAFPEAFRASWLFDELHQTRNFKPYMKKGLWMGSLLFGIDQQVFRGRAPWTLHNTADHTALKPASECYKIAYPKPDGVLTFDKLSSVFLSNTNHEEDQPCHLQLKDPSIPIAVNLAKYDAPEQRYCPAGVYEIVRDPDGTHPRLQISAQNCVHCKTCDIKDPTQNINWVVPQGGEGPIYQGM

SEQ ID NO: 100597 - DNA, 1656 bp, Zymomonas mobilis subsp. mobilis ZM4
  CDS (1)..(1656): transl_table=11
atgggggaaatgtcagaacgcgaatccatggaatatgatgttgtcatcgtaggggctggacctgcaggtctttctgcagcaatccggttaaagcagctggcggaaaaaaacgatcaggatattactgtttgcgttttagaaaagggggctgaagtcggtgcccatattctttctggggctataattgaccccatcgctctcaatgaacttatcccagattggcgtgaacgaggcgccccattgactgttaaggtaacagaatccccgcattgggttttaacgcctaaaaaacatttaaccctgccatcgatatttcttccatccttcatgcataataaagggttttatacgggatcgcttggttctttatgccgttggcttgccacagaagctgaatccttaggtgtcgatatttttcccggatttgtcgcagcagatattttgtatgacgaaaatgaccaagtaaaaggtgtcattactggagatatgggcgtcggcaaagatggaaaagcaagacctgatttccagcccggtatggagctacgtggccgttataccttctttgcagaaggtgcacgtggacatcttacaaaaagagtcattcgcaaattcgagctcgacgcagaaagtcagccgcaggtttatggcttagggattaaagaactttgggaagtcttgcctgaaaagcatgtcgctggacgcgttatccatacacaaggatggccattaaaaagtgaagtcggcggcggctttatttatcaccaagaaaataatcaagtgtcattgggcttcgttgtcggcctaggttatagcaatccttatctttctcctttccaagagttccaacgctggaaagaacacccgtccattcgacccttgctggagggggggcgcaggattgcttatggtgcacgcgtcattaacgagggtggttaccaagcaattccaaaacttatttttcctggtggtgctcttattgggtgttctgctggttttgttaatgttcctcgtatcaaaggtacacatggggcaatgaaatctgctatgttagcagctgaagcggctttcgcggctatacagaaagagactccatctgatctactgcaagactatcctgataattttgaaaaaagttggcttgctgctgagctcaaaaatgccaggaatgcagaacctgctattgctcattttggtcctttaataggttctgctattgcaggaacagatctttggatgagaagtctagggatcaaattaccgtttacattagggcatcgtcctgacaattctacacttgtctccaaagataaggctaaaaagctaaattatcctaaagctgatgggacaatcagttttgatcgtttgtcatctgtttatctctcaaatacgcagcatgatgaaaatgaaccttgtcatctaaagctgaaagacccttctgtcgcgataaaggtaaattgggaagaatatgattctcccgaaagtcgttattgtccagctggggtctatgaaatcatagaagaagacagtaagccacgacttcaaataaatgcgcaaaattgcctgcactgcaaaacttgcgatatcaaagatccgactgggaatatcgaatgggtagcgcctcaaggtggcgaaggcccaaactatcccaatatgtaa

SEQ ID NO: 100598 - protein, 551 aa, Zymomonas mobilis subsp. mobilis ZM4
MGEMSERESMEYDVVIVGAGPAGLSAAIRLKQLAEKNDQDITVCVLEKGAEVGAHILSGAIIDPIALNELIPDWRERGAPLTVKVTESPHWVLTPKKHLTLPSIFLPSFMHNKGFYTGSLGSLCRWLATEAESLGVDIFPGFVAADILYDENDQVKGVITGDMGVGKDGKARPDFQPGMELRGRYTFFAEGARGHLTKRVIRKFELDAESQPQVYGLGIKELWEVLPEKHVAGRVIHTQGWPLKSEVGGGFIYHQENNQVSLGFVVGLGYSNPYLSPFQEFQRWKEHPSIRPLLEGGRRIAYGARVINEGGYQAIPKLIFPGGALIGCSAGFVNVPRIKGTHGAMKSAMLAAEAAFAAIQKETPSDLLQDYPDNFEKSWLAAELKNARNAEPAIAHFGPLIGSAIAGTDLWMRSLGIKLPFTLGHRPDNSTLVSKDKAKKLNYPKADGTISFDRLSSVYLSNTQHDENEPCHLKLKDPSVAIKVNWEEYDSPESRYCPAGVYEIIEEDSKPRLQINAQNCLHCKTCDIKDPTGNIEWVAPQGGEGPNYPNM

SEQ ID NO: 100599 - DNA, 1647 bp, Silicibacter pomeroyi DSS-3
  CDS (1)..(1647): transl_table=11
atggccgagattgaacgcgaagcgatggaatatgacgtggtgatcgtcggggcgggtccggcgggcctgtcggcggccattcgtctcaagcagctcgatgccgacctgaatgtcgtcgtgctggaaaagggctcggaggtgggcgcgcatatcctgtcgggcgcggtgctggatccctgtggtctggatgcgctgatccccgactggaaggagaagggcgcgccgctgaacgtgccggtcaaggacgacaacttctatatgctgggcgaggccgggcagatccgcatccccaactttccgatgccgccgctgatgaacaaccacggcaactacatcgtttcgatggccaatgtctgccgctggatggccgaacaggccgaggaactgggtgtcgagattttccccggcatgtcctgctcggaactggtctatggcgacaatggcgaggtcaagggcgtggttgccggtgtcttcggcctcgaggcggacgggtcctatggccccaacaccgaaccggggatggagctgcacggcaaatatgtcttcctgtccgaaggcgtgcgcgggtcgctggccaaggaagtcatcgccaaatacgacctgcaaaaaggcaaggagccgcagaaattcggcgtcggcatgaaagagatctgggagatcgacccggccaagcatcgcgaaggctcggtcacccacacgatgggctggccgctgggcggcaatgcgggcggcgggtcgttcatctaccacctggacaacaaccaggtctatgtcggtttcgtggtgcacctgaactacaagaacccgcacctgttcccctatatggagttccagcggttcaagcatcacccgatggtggccgaactgctgaaaggcggcaagcgcgtcgcctatggcgcccgcgccatcaccgagggcggataccagtcgatgcccaagatggtagcgcccggcgtggcgctgctgggctgttcggtcggcatggtcaacgtgccgcgcatcaagggcaaccataacgcgatgctgtcgggcaaggccgcggccgaggccgcccatgccgccatcaaggcgggccgccagtcggacgagctgagcgattacgagaccgaagtgcgcagcggcccgatcggcaaggacctgaaaaaggtccgcaacgtcaagccgatgtggtcgaaatggggccttgccgccagcctggcgctgggcgggctggacatgtggaccaatacgctgggcttttcgctgttcggcaccctgggccatggcaagaccgacgccgccgcgaccgaggatgccagcaaacacaagcccatcgactatcccaagcccgatggcgtgctatccttcgaccggctcaccaacgtgtcttttgccgccaccaaccacgaggaaagccagccctgccacctgcggctgaccgaccccgacctgccggtcaaggtgaacctgcccaaatatgacgagccggcacagcgctattgcccggctggcgtctacgaggtggtcgaggatgagggcggcccgcgctttgtcgtcaacttccagaactgcgtgcactgcaagacctgcgatatcaaggatcccagccagaacatcacctgggtcaccccgcagggtggcgacggtccgaactatcccaacatgtga

SEQ ID NO: 100600 - protein, 548 aa, Silicibacter pomeroyi DSS-3
MAEIEREAMEYDVVIVGAGPAGLSAAIRLKQLDADLNVVVLEKGSEVGAHILSGAVLDPCGLDALIPDWKEKGAPLNVPVKDDNFYMLGEAGQIRIPNFPMPPLMNNHGNYIVSMANVCRWMAEQAEELGVEIFPGMSCSELVYGDNGEVKGVVAGVFGLEADGSYGPNTEPGMELHGKYVFLSEGVRGSLAKEVIAKYDLQKGKEPQKFGVGMKEIWEIDPAKHREGSVTHTMGWPLGGNAGGGSFIYHLDNNQVYVGFVVHLNYKNPHLFPYMEFQRFKHHPMVAELLKGGKRVAYGARAITEGGYQSMPKMVAPGVALLGCSVGMVNVPRIKGNHNAMLSGKAAAEAAHAAIKAGRQSDELSDYETEVRSGPIGKDLKKVRNVKPMWSKWGLAASLALGGLDMWTNTLGFSLFGTLGHGKTDAAATEDASKHKPIDYPKPDGVLSFDRLTNVSFAATNHEESQPCHLRLTDPDLPVKVNLPKYDEPAQRYCPAGVYEVVEDEGGPRFVVNFQNCVHCKTCDIKDPSQNITWVTPQGGDGPNYPNM

SEQ ID NO: 100601 - DNA, 1641 bp, Gluconobacter oxydans 621H
  CDS (1)..(1641): transl_table=11
atgacccagatcgaacgcgaagaaatggaattcgatgtcgtggtggtcggtggcggtcccgccggtctctccgccgcgatccgcctgaaacagctgatgccggatgcgggcatctgcctgatcgaaaaaggtagcgagatcggcgcccacatcgtctcgggcgccgtgatcgagccgcgcacgcttgatgagcttctgccgaactggcgcgatctggacgccccgctccgcacgcaggtgacggaagagcggatgctgttcttgacggaaatgcgctcgttcgaggtgccgtatctggatcgcgtgatgccgcagatggccaatcacgggaactacgttgtctcgctcggcgaagtctgccgctggcttggcgaacaggccgaagcccttggggtggaaatctatccggggttctcgggcgcggaactgttcattgaagacaaccgcgttgccggtgtcatcacgggcgacatgggtatcgagcgcaacggtgagcacgggccgaacttcacgcccggcatgatcctgcgcgccaaacagaccatcctgaccgagggcgcacgcggctccctgaccggccatgccatgaagcgttttgggctgcgcaaaggcgtcgacccgcagacctatggccttggcgtcaaggaagtctgggaaatcccggcggaaaagcatcgccctggcctcgtgcagcacagctttggctggccgctcgatgaccatacctatggtggcgcctggctctatcatttcggggaaaatctggtcagcttcggcttcgtgaccggcctcgattacgccaacacctatctctcgcccttcgaggaaatgcagcgcaccaagctgcacccggccttccgggagcatttcgagggtggcaagcgtctgatctacggcgcacgcgccctgtccgaaggtggcttccagtccattccgcgcctgaccttcccgggcggtgtgctggccggtgattcggcgggtttcctgaacgtgcccaagatcaagggcacgcatacggccatgaagtccggcatgatcgcggccgaagccgttgccgaggctctggaaaaggacaaaaaggaagccgccagcatgacagcgcgcgtccgccagtcctggctgtggtccgaactgcgcgacgtccgcaacatccgcccggccttcgcgaagtggggcatgaagctcggcgcgctctatgcgggcatcgacagcatgatcctgcgcggccgcgcgccctggacgctgcaccatccacatgccgataacgagacgctgcgcccggcctcgctgtgcacgaagatcgagtatcccaagccagacgggaagatcaccttcgatcgcgtcagttcagtcttcctgagcagcacgaatcacgaggacaaccagccggtccacctcaagctgcgcaacgaggcgatctggcgcaccgtcaatcatgacgtgttcgattcgccggaaagccgctactgcccggccggggtgtatgagcaggaacagacgggcgagaacgcctggcagctccggatcaacgcccagaactgcgtgcattgcaaaacctgcgacatcaaggatccgacgcagaacatcgaatggtgcacgcccgaaggcggtggcggtccgaactatccggtcgggatgtaa

SEQ ID NO: 100602 - protein, 546 aa, Gluconobacter oxydans 621H
MTQIEREEMEFDVVVVGGGPAGLSAAIRLKQLMPDAGICLIEKGSEIGAHIVSGAVIEPRTLDELLPNWRDLDAPLRTQVTEERMLFLTEMRSFEVPYLDRVMPQMANHGNYVVSLGEVCRWLGEQAEALGVEIYPGFSGAELFIEDNRVAGVITGDMGIERNGEHGPNFTPGMILRAKQTILTEGARGSLTGHAMKRFGLRKGVDPQTYGLGVKEVWEIPAEKHRPGLVQHSFGWPLDDHTYGGAWLYHFGENLVSFGFVTGLDYANTYLSPFEEMQRTKLHPAFREHFEGGKRLIYGARALSEGGFQSIPRLTFPGGVLAGDSAGFLNVPKIKGTHTAMKSGMIAAEAVAEALEKDKKEAASMTARVRQSWLWSELRDVRNIRPAFAKWGMKLGALYAGIDSMILRGRAPWTLHHPHADNETLRPASLCTKIEYPKPDGKITFDRVSSVFLSSTNHEDNQPVHLKLRNEAIWRTVNHDVFDSPESRYCPAGVYEQEQTGENAWQLRINAQNCVHCKTCDIKDPTQNIEWCTPEGGGGPNYPVGM

SEQ ID NO: 100603 - DNA, 1701 bp, Xanthomonas oryzae pv. oryzae KACC10331
  CDS (1)..(1701): transl_table=11
atgcaatcccggaaaatggacaccagccatcgagccaacgggagcggagcaatgtcggaagcgggagtgggcgcacacgcgtcagaggcggtcgagcgtgacgtcatggaatacgacatcgtcaccgtcggtgccggtccggccgggctgtcgttcgcgatccggctcaagcagctcgatccgaacatcagcgtctgcgtgatcgaaaaatccagcaccatcggcgcgcatatcctgtccggtgcggtgatcgagcccggcccgctggatgcgctgctgccaggctggcgcaacaacccgccgccgatttgcgtcgcggccaccgacgacgaattctggttcctcggcaaggacagcgcgcgcaagttccccgtggtgccgccgggcatgcgtaatcatggcaacttcatcgtcagcctgggcgcgatgtgcgcctggctggcgccgcaggccgaagcgctgggcgtggagatctaccccggcttcgccgccgccgaaacgctgcacgacgaaagcggccaggtggtgggcgtgcgtatcggcgatatgggcattgcaaaagacggtacgcacaagcccggctacaccgccggcatcgacattcgcgccaaggtcaccgtgcttgccgaaggcgcacgtggccacctcaccaagcggttgctgaagcgcttcgacctcaccgccgacagcgacccacaaggctattcaatcggcatcaaggagttgtggcaggtgcccgaaggccgcgtcacgcccggcaagatcgtgcacaccatcggctggcccgccgacaaccgcacctacggcggcagctttgtgtatcacctggacaacaaccagatcgcgctcggttacgtgagcgggctggattacagcgacgccaactaccagccgtgggaagccttccagcaatggaagaaccacccgatgatcaagccactgctggcaggcggcagcattctgtctgccggcgcacgcgcactggtcagcggtggctggcaatcgctaccgaaggtggacatgcccggcgccttgctcatcggcgacaccgccggcctgctcaacgtgcccaagatcaagggcacccaccaagccatccgcagcggcatgctggcggccgaacacctggtgcaatcgcagctggccccacggggattcgatgccgcattgcgcgcctctgacgtcatggccgagctgaagcaagtccgcaacatcaagcccggtttcaagaagggcctgtggttcggcctgctcaatgccgcctgggaaaccgcgctcaagggcgcctcgccgtggacgctgaagaacaaacccgactggtcggcgctgcacaaactcggcgagtacgagcaacccgagcgcgactacgtcacccgcgacctcgcaccgcgcgatcgcctgcaagcggtgtatttcgccgccaccgagcacgatgaagaccagccggtacatctgaaggtactggacaccgatgtgtgcgccacccgctgcgtgaccgaatacgacaacccgtgcacgcgcttctgcccggccaacgtctacgaaatggtcgcagacaccgccagcccctccggcaagcgcctgcagatcaacgcggccaattgcgtgcactgcaagacctgcgacatcaaggacccgtacgaaatcatcacctgggtcacaccggagggtggttcgggtccgaactaccagaatctgtga

SEQ ID NO: 100604 - protein, 566 aa, Xanthomonas oryzae pv. oryzae KACC10331
MQSRKMDTSHRANGSGAMSEAGVGAHASEAVERDVMEYDIVTVGAGPAGLSFAIRLKQLDPNISVCVIEKSSTIGAHILSGAVIEPGPLDALLPGWRNNPPPICVAATDDEFWFLGKDSARKFPVVPPGMRNHGNFIVSLGAMCAWLAPQAEALGVEIYPGFAAAETLHDESGQVVGVRIGDMGIAKDGTHKPGYTAGIDIRAKVTVLAEGARGHLTKRLLKRFDLTADSDPQGYSIGIKELWQVPEGRVTPGKIVHTIGWPADNRTYGGSFVYHLDNNQIALGYVSGLDYSDANYQPWEAFQQWKNHPMIKPLLAGGSILSAGARALVSGGWQSLPKVDMPGALLIGDTAGLLNVPKIKGTHQAIRSGMLAAEHLVQSQLAPRGFDAALRASDVMAELKQVRNIKPGFKKGLWFGLLNAAWETALKGASPWTLKNKPDWSALHKLGEYEQPERDYVTRDLAPRDRLQAVYFAATEHDEDQPVHLKVLDTDVCATRCVTEYDNPCTRFCPANVYEMVADTASPSGKRLQINAANCVHCKTCDIKDPYEIITWVTPEGGSGPNYQNL

SEQ ID NO: 100605 - DNA, 1809 bp, Neisseria gonorrhoeae FA 1090
  CDS (1)..(1809): transl_table=11
atggtggcgtgcttattgaaatttcgacaaaggtcgtctgaaaaccgaaaacatggtttcagacgacctttgttgtatttggtaactatatgttcccgttgtataattacggatttgcaattcaataataaatacacaggaaccgccatgacagaatccatcacccgcgacagtatgcaatacgatgtcgtgattgtcggcgcaggcccgtcggggttgtccgccgccatcaaactcaagcagcttgccgaacagaacgggcgcgaaatcagcgtttgcgtggtggagaagggttcggaggcgggggcgcattcgctggcgggcgcggttatcgatccgattgcgctgaatgagctgattcccgactggaaagaaaaaggcgcgccgctgacgcgcacggtaactcaggacaaggtgttgttcctgacggagaaaaaagcgttcaatctgcctattaccccgaatttcgacaatcacggcaactacatcgtcagcttaggcgaagtcgtgcgctggttggcggagcaggcggaaaatatgggcgtggaaatctatccgggctttgccgccgccgaagtgctgtatcacgaagacggctcggtcaaaggtattgcgaccggcaatatgggtgtaggcaaagacggcgggccgaccgacagtttccagcccggcatggagctttgggcgcggcaaaccctgtttgccgaaggttgccgaggttcgctttccaagcaaatcatcgaacgtttccaactcgaccaaaacagccagccgcaaacttacggcttgggcatcaaagaagtttgggaagtgccgtctgaacagcatcagcccggtttggtggtgcatagcgcaggctggccgctggacagcaaaacctacggcggtgcgtttatttaccatttcgacgacaacaaagtcgccgtcggcttcgtggtcggtttggactatcaaaacccgtatctgtcgccgtttgaagagttccaacgtttcaaaacccatcccgaaatccgcaaaacctttgaaggcggccgccgcattgcttacggcgcgcgttcgctgattgaaggcggtttgcaaagcctgccgaagctctcgttcaaggggggcgttttaatcggcgatgcggcggggttcctcaatatgccgcgcatcaaaggcattcatacctcgatgaaatccgccatgctcgccgccgaagccgtgttccccttgttggaaaactttgaagaagtggaaagcttcgacagcggcaaagaagcgggaaactatcaaaaactgtttgaacaaagctggctgtatcaagagctttatgccgcgcgcaatgtccgtccgtcattcaaatggggcgtttacctcggctcgctttataccggcatcgaccagatgattttcagaggcaaagccccgtggaccttgaaacatcacggcaaagacaacgagcagctcaaaaaagccgccgtgtgcaagccgattgattatccgaaacccgacggtgtgttgacctttgaccgcttgagcagcgtcttccttgccaatctcgcgcacgaagaaaaccagcccgaccatttggtgctgaacaatccgcaaacgatgatagacgtgaactataaagaatacgcctctcccgaaacgcgctattgtccggccggcgtatatgaaatcatcgaagaaaacggcagtccgcgcctgcaaatcaacgcggcaaactgcgtgcactgcaaaacctgcgacatcaaagacccgacgcaaaacatcacttggatttgccccgaaggcgcaagcggaccgaattacggcgggatgtaa

SEQ ID NO: 100606 - protein, 602 aa, Neisseria gonorrhoeae FA 1090
MVACLLKFRQRSSENRKHGFRRPLLYLVTICSRCIITDLQFNNKYTGTAMTESITRDSMQYDVVIVGAGPSGLSAAIKLKQLAEQNGREISVCVVEKGSEAGAHSLAGAVIDPIALNELIPDWKEKGAPLTRTVTQDKVLFLTEKKAFNLPITPNFDNHGNYIVSLGEVVRWLAEQAENMGVEIYPGFAAAEVLYHEDGSVKGIATGNMGVGKDGGPTDSFQPGMELWARQTLFAEGCRGSLSKQIIERFQLDQNSQPQTYGLGIKEVWEVPSEQHQPGLVVHSAGWPLDSKTYGGAFIYHFDDNKVAVGFVVGLDYQNPYLSPFEEFQRFKTHPEIRKTFEGGRRIAYGARSLIEGGLQSLPKLSFKGGVLIGDAAGFLNMPRIKGIHTSMKSAMLAAEAVFPLLENFEEVESFDSGKEAGNYQKLFEQSWLYQELYAARNVRPSFKWGVYLGSLYTGIDQMIFRGKAPWTLKHHGKDNEQLKKAAVCKPIDYPKPDGVLTFDRLSSVFLANLAHEENQPDHLVLNNPQTMIDVNYKEYASPETRYCPAGVYEIIEENGSPRLQINAANCVHCKTCDIKDPTQNITWICPEGASGPNYGGM

SEQ ID NO: 100607 - DNA, 1686 bp, Salmonella enterica subsp. enterica serovar Choleraesuis str
  CDS (1)..(1686): transl_table=11
atgaacgatacactttctaatacccagcaatcacgtgagacaatagaatgtgatgttcttattgtgggagcaggacccgccggattatctgcagctcttaaacttaaattacaggcaaatgacgcaggaaaagaactgtccattatcgtccttgataaaggagctgagcctggttctcatattctcagtggggcagtcatggatccccgagcgctgaatgaactaattcctgattggcaggaaagaggcgcacccattaaacagcctgttactcaggataaattactgttactgacgaatgaaaaatgtattaatttgccggatgcattgattcctgataattttcgcaaccatggaaactttatcgtaagcctcggtaatctcattaaatggctcgccggtcaggcagaaacgtcgggcgtggatatttatgcaggcttttcggcaactgagatactgtatgatcaggatactaacattatcggtgtagtaactggtgatatgggacgtcatcgggatggcagcaagaaagaggggttccagagtggaatagaaattctggcaaaatatacaatttttgccgaaggggcccgcggtagtctggctaaagaactgatcaaaaaatttcatcttgatacaggcaaagcaccccagagttttagcataggcataaaagagttgtgggaggttccatcagaccagtcccatccggggcttgtaattcacaccacaggttggcctctggataaagagtcgttcgggggtgggtttctctatcatcttaatgataataaaattgcactaggtttggttgtgggacttgattattcaaatccctggttaagcccttttcaggaaatgcagcgcctgaaaacacacccttctatacgcaaatacattgaccggggtaagcgtattggttatggcgcaagagcaatcaataacggcgggattgcgtctatgcctgatccctgtttacctggtggtctgctgattggttgtaatgccggtacgctcaatgcaagtagaatcaagggcatacatacagctatcaaaagtggcatgatagcggctgacgctatatttaatgctttgctggacaacaggaaaaacgacatactgacagaatatcaaacattactgcgacagagctggctttggcaggaactggaaaatggtagtaatttcaaaccctggtttaaaaaagggcgtgtgataggttttatcatgactggcattgagcattggctgcttccccgaatgggtataaaaaaaatcccctggcgtgtaaaaaataaccgaccggacaatatcactctgcaaccggccaacaaaagccagaaaaaactgtacgacaaacctgacggtaaactgacgtttgatattttgtcatccgtctatctcagtaacacctggcatgatgacgaccagccagtacatttgaaaatcagtgatcagaatatccctatatccattaatctggatatttatggtggccccgaagaacgatattgccctgccggagtatatgaatttttacaggatagtgaaacacaaaatatgcgtctgcaaataaattcacagaactgtattcactgtaaagtttgtgacattaaagatcctaaacaaaatataacctggactacgcctgaaggtggcaacggaccaaattatacagggatgtaa

SEQ ID NO: 100608 - protein, 561 aa, Salmonella enterica subsp. enterica serovar Choleraesuis str
MNDTLSNTQQSRETIECDVLIVGAGPAGLSAALKLKLQANDAGKELSIIVLDKGAEPGSHILSGAVMDPRALNELIPDWQERGAPIKQPVTQDKLLLLTNEKCINLPDALIPDNFRNHGNFIVSLGNLIKWLAGQAETSGVDIYAGFSATEILYDQDTNIIGVVTGDMGRHRDGSKKEGFQSGIEILAKYTIFAEGARGSLAKELIKKFHLDTGKAPQSFSIGIKELWEVPSDQSHPGLVIHTTGWPLDKESFGGGFLYHLNDNKIALGLVVGLDYSNPWLSPFQEMQRLKTHPSIRKYIDRGKRIGYGARAINNGGIASMPDPCLPGGLLIGCNAGTLNASRIKGIHTAIKSGMIAADAIFNALLDNRKNDILTEYQTLLRQSWLWQELENGSNFKPWFKKGRVIGFIMTGIEHWLLPRMGIKKIPWRVKNNRPDNITLQPANKSQKKLYDKPDGKLTFDILSSVYLSNTWHDDDQPVHLKISDQNIPISINLDIYGGPEERYCPAGVYEFLQDSETQNMRLQINSQNCIHCKVCDIKDPKQNITWTTPEGGNGPNYTGM

SEQ ID NO: 100609 - DNA, 1692 bp, Brucella abortus biovar 1 str. 9-941
  CDS (1)..(1692): transl_table=11
atgtctgaagcgaacgagcttcccgaacgcgagagcatggaattcgacgtcgtgattgtcggcgcaggccctgccggtcttgcagcggcgattcgtttcaaacagataaaccccgaactttccgtggtcgtgctggaaaagggtggggaagtcggcgcgcatatcctgtcgggtgcggtggtggacccggtcggtatcgaccagcttctgcccggctggcgcgaggaggaaggccatcctttcaaaacgcctgtgacggcggaccatttcctggtgctggggcctgccggttccgtgcgcctgcccaattttgccatgccgtcgctgatgaacaaccacggcaattacatcgtttcgctcggtaatgtctgccgctggctcggcacgaaggccgaggagctgggcgtggaaatctatccgggcttcgctgcgaccgaagtactctataatgacgagggcgcggtgatcggcgttgcgacgggcgacatgggcgtcgaacgcgacggcacacgtggccctaactatacgcgcggcatggcgctgctcggtaaatatgtgctgatcggcgagggcgcgcgtggttcactcgccaagcagctcattgcgaagttcaagcttgacgagggccgcgaaccggccaagtttggcatcggcctgaaggagctttggcaggttgatccgtcgaagcacaaaccgggcctcgtgcagcattcgttcggctggccgctggacatgaaaaccggcggcggctcgttcctctatcatcttgaggacaatatggttgcggtgggctttgtgctgcacctcaattacaagaacccctatctctcgccattcgaggaattccagcgtttcaagacgcatccggccatccgcgatacgttcgagggcggcaagcgcctttcctatggcgcgcgtgcaattaccgagggcggctggcaatccgtgccgaagctttccttccccggtggcgcgctcatcggctgctcggccggttttgtcaatgtgccgcgcatcaagggcagccacaatgcgatcctgtccggcattctggccgccgacaagattgcagaggctattgccgctggccgtgccaatgacgagccgatcgagatcgagaatagctggcgggcgagcgccattggcaaggacttgaagcgcgtgcgcaacgtcaagccgctctggtcgaagttcggcaccgctatcggcattgctctgggcggcctggatatgtggaccaaccagcttttcggcttctcgttcttcggcgcgatgaagcacggcaagaccgatgcgcaggcgcttgaaccggctgcaaactacaagaagatcgactatccgaagccggatggtgtgctgacttttgaccgtctgtcgtctgtgttcctgtcgaacacgaaccacgacgaaaacgagccggtgcatttgcaagtgcgtgacatggaattgcagaagacttcggaacacgatgttttcgcaggaccgtcgacgcgctattgcccggctggtgtttatgaatgggtggatgcggacggcaatgccgctgctgatccgggcgtcaaggatgtgcgtttcgtcatcaatgcgcagaactgcgtccactgcaagacctgcgacatcaaggatccaaaccagaatatcaactgggttccgccacaaggcggcgaaggaccggtctatatgaacatgtaa

SEQ ID NO: 100610 - protein, 563 aa, Brucella abortus biovar 1 str. 9-941
MSEANELPERESMEFDVVIVGAGPAGLAAAIRFKQINPELSVVVLEKGGEVGAHILSGAVVDPVGIDQLLPGWREEEGHPFKTPVTADHFLVLGPAGSVRLPNFAMPSLMNNHGNYIVSLGNVCRWLGTKAEELGVEIYPGFAATEVLYNDEGAVIGVATGDMGVERDGTRGPNYTRGMALLGKYVLIGEGARGSLAKQLIAKFKLDEGREPAKFGIGLKELWQVDPSKHKPGLVQHSFGWPLDMKTGGGSFLYHLEDNMVAVGFVLHLNYKNPYLSPFEEFQRFKTHPAIRDTFEGGKRLSYGARAITEGGWQSVPKLSFPGGALIGCSAGFVNVPRIKGSHNAILSGILAADKIAEAIAAGRANDEPIEIENSWRASAIGKDLKRVRNVKPLWSKFGTAIGIALGGLDMWTNQLFGFSFFGAMKHGKTDAQALEPAANYKKIDYPKPDGVLTFDRLSSVFLSNTNHDENEPVHLQVRDMELQKTSEHDVFAGPSTRYCPAGVYEWVDADGNAAADPGVKDVRFVINAQNCVHCKTCDIKDPNQNINWVPPQGGEGPVYMNM

SEQ ID NO: 100611 - DNA, 1656 bp, Pseudomonas syringae pv. syringae B728a
  CDS (1)..(1656)
atggaacgcgaatacatggaattcgacgtcgttatcgtcggagccggcccgtccgggctttctgccgcttgccgccttaaacagaaggccgctgaagctggccaggaaatcagcgtctgcgtggtggaaaaaggctccgaagtcggtgcgcacatcctctccggtgccgtgttcgagccccgcgcgctgaatgaactgttccccaactggcaggaactgggcgccccgctcaacacgccggtcaagcgcgacgacatctatatgctgcgcgatgccgaaaaagcccagaaaataccggactttttcgtccccaagaccatgcacaaccatggcaactacatcatctcgctgggcaacctgtgccgctggctggctcagcaggctgaaaacctcggtgtcgaaatctatccgggctttgccgcccaggaagcgctgttcgacgagaacggtgtggtacgcggcatcgtcaccggcgatctgggtgtcgaccgcgaaggcaatccgaaggaaggcctgtacacccccggcatggaactgcgcgccaagtacacgctgttcgccgaaggctgccgtggtcacatcggcaagcagctgctcaagcgcttcaacctcgacgacgaagccgacgtgcagcattacgctatcggcctcaaggaaatctgggaagtcgacccggcaaaacatgaacaggggctggtggttcacaccgcaggctggccgctgaacgatgacaatccgggcggctcgttcctctaccacctggaaaacaatcaggtagtggtcggtctgatcgtcgacctgtcctacagcaatccgtacctgtcgccgttcgacgaattccagcgctacaagcatcacccggtcatcaagcaatacctggaaggcggcaagcgcatcagctacggcgcccgcgcgatcaccaagggcggcctgaactccctgccaaaaatggtcttccccggtggcgcgctgatcggctgcgatctgggcacgctgaacttcgccaagatcaagggcagccacacggcgatgaagtccggcatgctggctgccgattcggtggccgacgcgctgctggccggcaaggaaggcggcgacgtgctgacttcctacgtggatgccttcaaggccagctggctgcacgaagagctgttcgccagccgcaactttggcgtggcgatccacaaatacggcgcgatcaagggcggcgcattcaacttcatcgatcagaacattttcggtggcaagctgccgttcacgctgcatgacaccaagccggactacgcctgcctcaagctggcagccgactcgaagaagatcgattacccgaaacccgacggcaagctcagtttcgacaagctcagttcggtattcctctccagcaccaaccatgaagaggaacaaccctgccacctgaagctgaccgatccgagcatcccgatcagcaagaacttgccgctgtatgacgagccggctcagcgttactgcccggccggcgtgtatgaagtcatcaccaaggaagacggcgagaaacgcttccagatcaacgcgcagaactgcgtgcactgcaagacctgcgacatcaaggacccgtcgcagaacatcacctgggtggcaccggaaggtgctggcggcccgacctacccgaatatgtga

SEQ ID NO: 100612 - protein, 551 aa, Pseudomonas syringae pv. syringae B728a
MEREYMEFDVVIVGAGPSGLSAACRLKQKAAEAGQEISVCVVEKGSEVGAHILSGAVFEPRALNELFPNWQELGAPLNTPVKRDDIYMLRDAEKAQKIPDFFVPKTMHNHGNYIISLGNLCRWLAQQAENLGVEIYPGFAAQEALFDENGVVRGIVTGDLGVDREGNPKEGLYTPGMELRAKYTLFAEGCRGHIGKQLLKRFNLDDEADVQHYAIGLKEIWEVDPAKHEQGLVVHTAGWPLNDDNPGGSFLYHLENNQVVVGLIVDLSYSNPYLSPFDEFQRYKHHPVIKQYLEGGKRISYGARAITKGGLNSLPKMVFPGGALIGCDLGTLNFAKIKGSHTAMKSGMLAADSVADALLAGKEGGDVLTSYVDAFKASWLHEELFASRNFGVAIHKYGAIKGGAFNFIDQNIFGGKLPFTLHDTKPDYACLKLAADSKKIDYPKPDGKLSFDKLSSVFLSSTNHEEEQPCHLKLTDPSIPISKNLPLYDEPAQRYCPAGVYEVITKEDGEKRFQINAQNCVHCKTCDIKDPSQNITWVAPEGAGGPTYPNM

SEQ ID NO: 100613 - DNA, 1650 bp, Xanthomonas campestris pv. campestris str. 8004
  CDS (1)..(1650): transl_table=11
atgtcggaagcgggaatcggcgcgcaagcgtcagagacggtcgagcgcgacgtgatggagtacgacgtcgtcaccgtcggtgccggtccggccgggctgtcgttcgcgatccggctcaaacagctcaaccccgcgttgagcgtgtgcgtgatcgaaaaatccagcaccatcggtgcgcacatcctctccggcgcggtgatcgaacccggcccgctggatgccttgctgccgggctggcgcgatcgcccgccgccgatctgcgtggccgccaccgaagacgaattctggtttcttggcaaggacagtgcgcgcaaattcccggtggtgccgccaggcatgcgcaaccacggcaacttcatcgtcagcctgggcgccatgtgcgcctggctcgctccgcaggccgaagccctgggcgtggagatctaccccggctttgccgccgccgaaaccctgcacgacgacagcggccaggtggtgggcgtgcgcatcggcgacatgggcgtggccaaggatgggtcgcacaagaccggctacaccgccggtatcgacatccgcgccaaggtcaccgtgctggccgaaggcgcacgtggccatctcaccaagcgcctgctcaagcgcttcgacctgactgccgatgtcgacccgcagggctattcgatcggcatcaaggaactgtggcaggtgcccgagggccgcgtcagccccggcaagatcgtgcacacgctcggctggccggccgacaaccgcacctatggcggcagcttcctatatcacctggacaacaaccagatcgcgctgggctacgtcagcgggctggactacagcgaccccaattaccagccgtgggaggccttccagcaatggaagaaccacgcgctgatcaagcccctgctggaaggcggcagcatcctgtcggccggcgcgcgcgccatcgtcaccggcggctggcaatcgctgcccaaggtggaaatgccgggtgcgctgttgatcggcgacaccgccggcctgctcaacgtgcccaagatcaagggcacccatcaggcgatccgcagcggcatgctggccgccgagcacctggtgcaatcgcagctagccccacagggcttcgacgccaagctgcgcgcctccgatgccatggccgaactcaagcaggtgcgcaacatcaagcccggcttcaagaagggactgtggctgggcatgctcaatgccgcctgggaaaccgcgctcaaaggcgcctcgccgtggacactgaaaaacaagccggactggtcggccatgcacaaactcggcgagtacgaacagcccaaacgcgactacttccagcgcgagctcgccccacgcgatcggctgcaggcggtctacttcgccgccaccgaacacgacgaagaccaaccggtgcatctgcaggtgcttgacaccagcatctgcgccacccgctgcgtggaggaatacaacaacccctgcacccgcttctgcccggccaacgtctacgaaatggtcgcagacaccaccagcccctccggcaagcgcctgcagatcaacgccgccaactgcgtgcattgcaagacctgcgacatcaaggacccctacgagatcatcacctgggtcaccccggagggtggttcggggccgaactaccagaatctgtga

SEQ ID NO: 100614 - protein, 549 aa, Xanthomonas campestris pv. campestris str. 8004
MSEAGIGAQASETVERDVMEYDVVTVGAGPAGLSFAIRLKQLNPALSVCVIEKSSTIGAHILSGAVIEPGPLDALLPGWRDRPPPICVAATEDEFWFLGKDSARKFPVVPPGMRNHGNFIVSLGAMCAWLAPQAEALGVEIYPGFAAAETLHDDSGQVVGVRIGDMGVAKDGSHKTGYTAGIDIRAKVTVLAEGARGHLTKRLLKRFDLTADVDPQGYSIGIKELWQVPEGRVSPGKIVHTLGWPADNRTYGGSFLYHLDNNQIALGYVSGLDYSDPNYQPWEAFQQWKNHALIKPLLEGGSILSAGARAIVTGGWQSLPKVEMPGALLIGDTAGLLNVPKIKGTHQAIRSGMLAAEHLVQSQLAPQGFDAKLRASDAMAELKQVRNIKPGFKKGLWLGMLNAAWETALKGASPWTLKNKPDWSAMHKLGEYEQPKRDYFQRELAPRDRLQAVYFAATEHDEDQPVHLQVLDTSICATRCVEEYNNPCTRFCPANVYEMVADTTSPSGKRLQINAANCVHCKTCDIKDPYEIITWVTPEGGSGPNYQNL

SEQ ID NO: 100615 - DNA, 1224 bp, Sulfolobus acidocaldarius DSM 639
  CDS (1)..(1224): transl_table=11
atgagttttgatgctgatgtaattgtagttggtggaggcttaggcggactatctgctgcaataacagcagccaaagaagggttgagtgtcattgtattagagaggggagactatagtggtgcaaaaaatgtatcaggaggaagaatgtacatacatgccctacagaaacttataccagatgcgttagagagagcccccctagagagacctataactaaggaaacatttgaattttattgcagtaatgacaggaaactgtctttttcttttgaggaaaaaggaaagaagaatagttactctatattaagagcaaaatttgatagatggcttgcaagtgaggcagaaaatctgggcgtattgatttcatattcaacgttagtcacaaatgctcaaagagaaactggagggattaatctagagaccaacagaggaaacctgagagcaccgttggtgattgacgcatcaggtgttacgtctgtcgtgttcaggtatctaggtttaagaaagtttacccctgataagtggatgttaggagcaaaagagataataaagactgacgtaaatctacctgaagatgaaggtgaagttagaacaatagttgctgccgtgaagggcgtcaaagggggaggttttgtttacactaacaaagatactttgtcagtgggtatggctgtaacttttgattccctacctaaatctgaagtacctgcaaaagatttagttgaagcatttagggagaagttgggtatagagggagaaattcttgagtattctgcacatgcgattccatatttcggatacagaaatcttcctccactctatgataacaacctaatagctgtaggggattcagctggttttctaataaatgatggatttaccataagaggtatggatctagctataggctcaggtatgatagctggactagctgcaaagaaactaaaagagattaatgactacacaaagactgacgtctattaccagatgcttaaggagagcttcgtattaaggcacctagagttagcatacaacaggttttcagtaataaatgaccctaggactttagtgtcatatccagaggttctatgcaatgtattaacggacatgtttacagtaacagaggagaggaaaccattaatggaggtagcccttcaaaggcttaaggagaaggatatttcgttaaccaaagcattaatggacttaatgagggctagtaagtaa

SEQ ID NO: 100616 - protein, 407 aa, Sulfolobus acidocaldarius DSM 639
MSFDADVIVVGGGLGGLSAAITAAKEGLSVIVLERGDYSGAKNVSGGRMYIHALQKLIPDALERAPLERPITKETFEFYCSNDRKLSFSFEEKGKKNSYSILRAKFDRWLASEAENLGVLISYSTLVTNAQRETGGINLETNRGNLRAPLVIDASGVTSVVFRYLGLRKFTPDKWMLGAKEIIKTDVNLPEDEGEVRTIVAAVKGVKGGGFVYTNKDTLSVGMAVTFDSLPKSEVPAKDLVEAFREKLGIEGEILEYSAHAIPYFGYRNLPPLYDNNLIAVGDSAGFLINDGFTIRGMDLAIGSGMIAGLAAKKLKEINDYTKTDVYYQMLKESFVLRHLELAYNRFSVINDPRTLVSYPEVLCNVLTDMFTVTEERKPLMEVALQRLKEKDISLTKALMDLMRASK

SEQ ID NO: 100617 - DNA, 1185 bp, Sulfolobus acidocaldarius DSM 639
  CDS (1)..(1185): transl_table=11
gtggagtttgatgttatagttataggagcaggaccagcaggatcagctgctgctcttactgcagcaaaaggaggagctaaagtacttctcctggaaaagggacctgaaccaggatcaaaaaatgtctccggagcgatgataaggacagaggaaatcgcaaaagtatttgatacatcatcaatgccatttgagagaaaagtgaaaaatgttgatttaatattcatggactctacagggaaagtgagaatcagtgtagatatatcatcaggtctaataaacgtaggtagacttaagctcgataaatggatggctcaacaagctgagaaagctggtgcagttttagtgactaagaccactgctttgggtgtagaaaaagatggtgaaaagtacaaagtagttactgacaggggaagtattagtggaagcaaggttgttttagctgaaggagttaatgcgttaatttccatgggaatgaaaattagacctgatctagagcctgaacattcagttcaagctgtaaaggaagtatacaatttgaataaggacgaaataaataagaggttaggatttaagagcgatgaagagggttccagctggagaatatttggcactaacccagttccttatgctggattcctttacacatacaaggacgctattgcaataggtgtaggtattccaatgtctatactaataaagaagaagatctctccttacacagtattggatgaacttaaagagagactaggaattaatgaacttgttaaaggcgggtctcttagggagtattctgcaaaagtcataccagaacagggattcccttcatatagagcctgttctggtaaaatatacctcgcaggtgactccataggtttaattaacgcattaacattcaatggcataggaccggcagttatttctggatctatagcaggtaaagcggctctagagggatatgagtgtttcaagtacgaagaagagcttatgaaagacaaggagattaaaggagttgtaaaggctagacctctgatacaagagttaactaaggaagagaacttgaactattatgtaaacttcctgggggatgcacttcattcatgggcttatggttccctttcccttaatttagatatgcccagacttattaaacacttaatgttaggtatgggggtgttaaaagcatga

SEQ ID NO: 100618 - protein, 394 aa, Sulfolobus acidocaldarius DSM 639
MEFDVIVIGAGPAGSAAALTAAKGGAKVLLLEKGPEPGSKNVSGAMIRTEEIAKVFDTSSMPFERKVKNVDLIFMDSTGKVRISVDISSGLINVGRLKLDKWMAQQAEKAGAVLVTKTTALGVEKDGEKYKVVTDRGSISGSKVVLAEGVNALISMGMKIRPDLEPEHSVQAVKEVYNLNKDEINKRLGFKSDEEGSSWRIFGTNPVPYAGFLYTYKDAIAIGVGIPMSILIKKKISPYTVLDELKERLGINELVKGGSLREYSAKVIPEQGFPSYRACSGKIYLAGDSIGLINALTFNGIGPAVISGSIAGKAALEGYECFKYEEELMKDKEIKGVVKARPLIQELTKEENLNYYVNFLGDALHSWAYGSLSLNLDMPRLIKHLMLGMGVLKA

SEQ ID NO: 100619 - DNA, 1665 bp, Pseudomonas fluorescens Pf-5
  CDS (1)..(1665): transl_table=11
gtggaacgcgaatacatggaattcgacgtggtcatcgtcggtgccggccccgcaggcttgtccgccgcttgccgccttaagcagaaggccgctgaagccgggaaggaaatcagcgtctgcgtggttgaaaaaggctccgaagtcggtgctcacatcctttccggtgccgtgttcgaaccacgggccctgaatgaattgttcccggactggaaggaactgggcgccccgctcaacaccccggtcacccgcgacgacatctatgtcctgcgcagcggcgaaacctccaccaaggttccagacttctttgtgcccaagaccatgcacaacgaaggcaactacatcatttccctgggcaatctgtgccgctggctggcccagcaggccgagaacctgggcgtggaaatctacccgggctttgccgcccaggaagccctgatcgacgaaaacggcgtagtccgcgggattcttaccggcgacatgggtgtcgaccgtgaaggccagccgaaagagggcatgtacacccccggcatggaactgcgcggcaaatacaccctgttcgccgaaggctgccgtggccatatcggcaagcaactgatcaagcagttcaacctggacagcgacgccgacgcccagcactacggcatcggcctcaaggaaatctgggaaatcgacccggccaagcaccagcctggcctggtggtgcacaccgccggctggccgctggacatcatgagcaacgagaacactggcggctccttcctctatcacctggaaaacaaccaggtagtagtgggcctgatcgtcgacctgtcctacgccaacacttacctgtcgccgttcgacgagttccagcgcctcaagcatcacccggtgctcaagcagtacctggaaggcggcaagcgcgtcagctacggcgcccgcgccatctgcaagggcggcctgaactcgctgccgaagatggtgttcaagggtggcgcgctgatcggctgcgaccttggcaccctgaacttcgccaagatcaagggcagccacaccgccatgaagtccggcatgctggccgccgatgcggtagccgactcgctgttcgccggctccgaaggcgccgacgaactcaagagctacgtcgattcgttcaaggccagctggctgtatgaagagctgttcgccagccgtaacttcggcccggccatgcacaagttcggcccgatcatcggcgcgggcttcaactggatggaccagaatatcttcggcggcaaactgccgttcaccctgcacgacaccaagccggactacgcctgcctgaagctggccaaggactgcgtgaagatcgactatccgaaacccgacggcaaactcagcttcgacaagttgagctcggtgttcatctccggcaccaaccatgaagaagaacagccttgccacctgaagctgaccgacccgagcatcccgctgagccgcaacctgccgctgtacgacgaacctgcccagcgttactgcccggccggcgtgtatgaggtgatcacccaggaagatggcgagaagcgcttccagatcaacgcgcagaactgcgtgcactgcaagacttgcgacatcaaggacccggcccagaacattacctgggtcactccggaaggcgccggcggcccgacttacccgaacatgtaa

SEQ ID NO: 100620 - protein, 554 aa, Pseudomonas fluorescens Pf-5
MEREYMEFDVVIVGAGPAGLSAACRLKQKAAEAGKEISVCVVEKGSEVGAHILSGAVFEPRALNELFPDWKELGAPLNTPVTRDDIYVLRSGETSTKVPDFFVPKTMHNEGNYIISLGNLCRWLAQQAENLGVEIYPGFAAQEALIDENGVVRGILTGDMGVDREGQPKEGMYTPGMELRGKYTLFAEGCRGHIGKQLIKQFNLDSDADAQHYGIGLKEIWEIDPAKHQPGLVVHTAGWPLDIMSNENTGGSFLYHLENNQVVVGLIVDLSYANTYLSPFDEFQRLKHHPVLKQYLEGGKRVSYGARAICKGGLNSLPKMVFKGGALIGCDLGTLNFAKIKGSHTAMKSGMLAADAVADSLFAGSEGADELKSYVDSFKASWLYEELFASRNFGPAMHKFGPIIGAGFNWMDQNIFGGKLPFTLHDTKPDYACLKLAKDCVKIDYPKPDGKLSFDKLSSVFISGTNHEEEQPCHLKLTDPSIPLSRNLPLYDEPAQRYCPAGVYEVITQEDGEKRFQINAQNCVHCKTCDIKDPAQNITWVTPEGAGGPTYPNM

SEQ ID NO: 100621 - DNA, 1833 bp, Psychrobacter arcticum 273-4
  CDS (1)..(1833): transl_table=11
atgcaagagcaagacaatcaaacgccagttattgatggtgatactgtgaatattgacacaccaatcgtgacagacacggcaaatccagagccagcagtgataacaccagtcgttgagccagttgctgaaatggtcgtcgtcgacaaagcactagaacctgctgtcgcagcagagcctgaagttgaacgtgaatcaatggaatttgatgtcatcatcgttggtggtggacctgccggtctttcagctgccatccgtctacgccagcttgccatcgcagcaggtaacgatgagtttatggtttgtgtggtcgaaaaaggctcggagtttggcgctcataccctatctggtgcggtcatggaaacacgtgctttggatgaattgattccagattggaaagaaaaaggcgcgccgctgaacgtccctgcgattgaagaccgcgtttatatgttgggttcggcaaccaaatctaccaaactaatggattcaattattcctgccagcatgcataacgaaggcaactatattgtctcattaggcaacgtcgttcgttggttggctgcgcaagcagaagagctggaagtcatgatgttcccaggcttctctgctgatgaaatcctatataatgatgatggttcggtcaaaggcgtcctcacaggcgacatgggtgtggctgccagtggcgaagcgaaacatagcttcgagccaggttatgagctacttggtaaatacaccattttttccgaaggttgccgtggtcatttgggcaagcgcctaatcagccgttttgatctggataaagactccgatccgcagcattatggtattggtctaaaagagctatgggaagtgacgcctgaaaagcatgaagaaggcgtagtgatgcatggttcaggctggccattgactgatactggctcatctggcggttggtggttgtactttgatgaaaacaaccaagtgagctttggtatggtcatcgatttatcatactcaaatccatatatgtcgccatttgatgagatgcagcgtctaaaactacatccgcttattcgtaacgtcttggaaggtggtaagcgtttgtcttacggcgctcgtgcgttgaccaaaggcggtttaaactcgttaccaaaattcactttcccaggaggtgtattggcgggtgatgatgcaggcttcttaaaccctgccaaaatcaaaggcacacatacctcaatgaagtcaggcatgctagctgctgaagcgatttttgaggcggtgcaagctggtcgccaacatgatgacgtagaagcatatagcaccatgtataaagagtcgtggttgtatcaagacaactatgaagcgcgcaactttgctccagctatgcaccgtatgggtcaatggatgggtggcgcctttacctttatcgagcaaaatctgatgggtggcaaaatgcctttgaccattcatgacaatcaaaaagattatgatcagcttgagcgtgcggctcatgcctatcagccaacctatgcaaaaccggatggcaaattggtctttgataaattatcatctgtttttatctcaaacaccaaccatgctgaagatcagccagtacatctgaaattaactgatccaacggtgcctgtcactatcaacttgccactatatgctgagccagcgcgtctgtactgcccagctggggtttatgaaatagttaaagatgccgaaggcgctaaatttgttatcaatgcgcaaaactgtgtccattgcaaaacttgtgatatcaaagacccttcacagaatatcacttgggtaacgccagaaggtggcggcggtcctaactatccaaacatgtaa

SEQ ID NO: 100622 - protein, 610 aa, Psychrobacter arcticum 273-4
MQEQDNQTPVIDGDTVNIDTPIVTDTANPEPAVITPVVEPVAEMVVVDKALEPAVAAEPEVERESMEFDVIIVGGGPAGLSAAIRLRQLAIAAGNDEFMVCVVEKGSEFGAHTLSGAVMETRALDELIPDWKEKGAPLNVPAIEDRVYMLGSATKSTKLMDSIIPASMHNEGNYIVSLGNVVRWLAAQAEELEVMMFPGFSADEILYNDDGSVKGVLTGDMGVAASGEAKHSFEPGYELLGKYTIFSEGCRGHLGKRLISRFDLDKDSDPQHYGIGLKELWEVTPEKHEEGVVMHGSGWPLTDTGSSGGWWLYFDENNQVSFGMVIDLSYSNPYMSPFDEMQRLKLHPLIRNVLEGGKRLSYGARALTKGGLNSLPKFTFPGGVLAGDDAGFLNPAKIKGTHTSMKSGMLAAEAIFEAVQAGRQHDDVEAYSTMYKESWLYQDNYEARNFAPAMHRMGQWMGGAFTFIEQNLMGGKMPLTIHDNQKDYDQLERAAHAYQPTYAKPDGKLVFDKLSSVFISNTNHAEDQPVHLKLTDPTVPVTINLPLYAEPARLYCPAGVYEIVKDAEGAKFVINAQNCVHCKTCDIKDPSQNITWVTPEGGGGPNYPNM

SEQ ID NO: 100623 - DNA, 1605 bp, Candidatus Pelagibacter ubique HTCC1062
  CDS (1)..(1605): transl_table=11
atggagtatgacgtggtaattgttggtggtggcccatcaggactatcgactgctattaaactcaaacaattagatccagaattaaatatttgcctactagaaaaagcatccgaaataggagctcatattttaagtggcaatgtttttgaaactagagcattagatgagttattaccaaactggaaagaacttaattcacctataaaaactaaggtttctaaagaaaaattcttatttttaggaaaatctaaatcattaagctggccaacatggctgctgccatcggttcagcaaaatcataataattacataattagtttagcaaatctatgtagatggctagcagaacaagcagaagctttaggtgttgaaatatttccaggttttcccgcaagtgaaattttatacaatgaagatggatctgttaagggagttgcaactcaagacatgggagtcgataaaaatggaaataaaaaagatggctttgaaccaggcatagaactgttaggaaaagttactgtgtttgcagaaggatgtagaggacatcttggaaaacaattaatagaaaaatataatttatcagaaggtaaagatcctcaacaatatggaattgggtttaaagaaatttgggaaatcagtgaaaaaaatcatgaagagggaatggttatgcataccgcaggttggccactcgataacaatacttatggtggcagctttatgtatcatgcagaaaacaaacaagtttttttaggatatgtaattggtcttgattataaaaacccacatctttcaccgtttgatgaatttcaaagatttaaaactcaccctgcaattaaaaagataattgaaggtggaaaacgtatttcatatggagcaagagctttaattgaaggtggacttcagagtttaccaaaaatgtttatgcctggagctttattaattggttgtgatgcgggaactttgaatatgcctaagattaaaggatcacatactgcaatgaaaagtggaatgattgctgcagaaacaataaacgaacatttaaaagaaaataaagatttatcaatttatgaggataaatttaaaaaaagttggatttatgaggagctctaccaagctcgaaatgttaaaccaagttttagctggggtttaattcttggaataatatttacaggaattgatcaaatattatttagaggaaaattaccttttaccttaagacataagcatgctgaccatgaaacattaaaaccagcaaatgaaatgccaaaaattgattaccctaaaccagataatgtgattacatttgataaaacaagttctgtttatttaacaggaacaaatcataccgacaatcaacctgtacacttacaattaaaagatccgaacttaccgataaattatactttagaaaaatttgatgaacctgctcaaagatattgccccgcaggcgtttatgaagttcaaaatgaaaatggtgtaaataaatttgttataaattctcaaaattgtattcattgcaaaacttgtgatattaaagaaccttctcaaaatattacttgggtaacacccgaaggaagtggtgggcctaaatatggaaatatgtag

SEQ ID NO: 100624 - protein, 534 aa, Candidatus Pelagibacter ubique HTCC1062
MEYDVVIVGGGPSGLSTAIKLKQLDPELNICLLEKASEIGAHILSGNVFETRALDELLPNWKELNSPIKTKVSKEKFLFLGKSKSLSWPTWLLPSVQQNHNNYIISLANLCRWLAEQAEALGVEIFPGFPASEILYNEDGSVKGVATQDMGVDKNGNKKDGFEPGIELLGKVTVFAEGCRGHLGKQLIEKYNLSEGKDPQQYGIGFKEIWEISEKNHEEGMVMHTAGWPLDNNTYGGSFMYHAENKQVFLGYVIGLDYKNPHLSPFDEFQRFKTHPAIKKIIEGGKRISYGARALIEGGLQSLPKMFMPGALLIGCDAGTLNMPKIKGSHTAMKSGMIAAETINEHLKENKDLSIYEDKFKKSWIYEELYQARNVKPSFSWGLILGIIFTGIDQILFRGKLPFTLRHKHADHETLKPANEMPKIDYPKPDNVITFDKTSSVYLTGTNHTDNQPVHLQLKDPNLPINYTLEKFDEPAQRYCPAGVYEVQNENGVNKFVINSQNCIHCKTCDIKEPSQNITWVTPEGSGGPKYGNM

SEQ ID NO: 100625 - DNA, 1662 bp, Colwellia psychrerythraea 34H
  CDS (1)..(1662): transl_table=11
atggaacgcgaatcgatggaatttgacgtagtcattgttggagcagggcccgcaggtctatcaactgcttgtcgattaatgcaattagcacaagaaaaacagcaagaattaatggtttgtgttgttgaaaagggatctgaagttggagcccacattctttcgggtgctgtgtttgaaccaagatctttgaatgaactatttccggattggcaagaacgaaatgcgccattaacgactaaagttaccggcgatgatatttatctattgaataatgaaaattcaggtatcaaattacctaatttttctgtgcctaaaactatgcacaatgacggaaattacattgttagtatgggcaatgtttgtcgttggttagctgaacaagctgaacagctaggtgttgaaattttccctggtttcccggcacaaagtgttatttataatgacgatggtagtgtcggtggtgttatcactggcgacatgggtttagatgctgaaggcaaagaaaaagattcgttcatgccgggtatggaattacgcgctaaatacacggtttttgctgaaggctgtcgaggtcatttgggtaaagagttaatcgaaaaattcaaccttgatgagcaaagttctccacaacattatggtttaggttttaaagaaatttgggatattgacccagcaaaacatcagccaggacttgttgtacatacagccggttggccattagataaaaagactaatggtggtggttacctatatcatgccgaaaacaaccaagtttttgttggtttaattatcgacttaaattatagcaacccgcatttaagtccttttgatgaattccaacgttacaaacatcatcctaagattagtcagtaccttgaaggtggtaaacgtgtttcctatggcgctcgagctatggccaaaggcggttttaattctttacctaaaatgacgatgccaggagcattattagtaggttgtgatgctggtactattaactttgcgaaaattaaaggtaatcacacagcgatgaagtctggcatgattgccgctgaagctattgctcaagcattgattgttggagaagctatcgcagaagaaggtaagcaagatttaactcaatttacgcagttatataaagactcttggttatatgaagagttatacaatacccgtaacttcggtccagctatgcataagtttggtaccatgttgggcggcgcgtacaatacgttagaccaaaacttttttgctggtaaattaccgtttaattttaaagatgatagtgtagattatgctcaattaaagccggctgccgatatgccagttattaattatagtaagccagataataaattaagctttgataaactctcttcagtttttttgtcaaatactaaccatgaagaagagcagccttgtcatttaaaacttaaagatgcagatattcctatcagagttaatttaactaaatacaatgaacctgcacagctttactgtcctgctggtgtgtatgaggttgaaaaaactgaagagggcgacaagtttgtcatcaatgctcaaaactgtattcactgtaaaacatgtgatattaaagatccaagtcaaaatattacttgggttacacctgagggcactggtggtccaaactacccgaacatgtaa

SEQ ID NO: 100626 - protein, 553 aa, Colwellia psychrerythraea 34H
MERESMEFDVVIVGAGPAGLSTACRLMQLAQEKQQELMVCVVEKGSEVGAHILSGAVFEPRSLNELFPDWQERNAPLTTKVTGDDIYLLNNENSGIKLPNFSVPKTMHNDGNYIVSMGNVCRWLAEQAEQLGVEIFPGFPAQSVIYNDDGSVGGVITGDMGLDAEGKEKDSFMPGMELRAKYTVFAEGCRGHLGKELIEKFNLDEQSSPQHYGLGFKEIWDIDPAKHQPGLVVHTAGWPLDKKTNGGGYLYHAENNQVFVGLIIDLNYSNPHLSPFDEFQRYKHHPKISQYLEGGKRVSYGARAMAKGGFNSLPKMTMPGALLVGCDAGTINFAKIKGNHTAMKSGMIAAEAIAQALIVGEAIAEEGKQDLTQFTQLYKDSWLYEELYNTRNFGPAMHKFGTMLGGAYNTLDQNFFAGKLPFNFKDDSVDYAQLKPAADMPVINYSKPDNKLSFDKLSSVFLSNTNHEEEQPCHLKLKDADIPIRVNLTKYNEPAQLYCPAGVYEVEKTEEGDKFVINAQNCIHCKTCDIKDPSQNITWVTPEGTGGPNYPNM

SEQ ID NO: 100627 - DNA, 1656 bp, Pseudomonas syringae pv. phaseolicola 1448A
  CDS (1)..(1656): transl_table=11
gtggaacgcgaatacatggaattcgacgtcgtcatcgtcggagccggcccttccgggctttctgccgcttgccgccttaaacagaaggccgctgaagccgggcaggaaatcagcgtctgcgtggtggaaaaaggctccgaagtcggcgcacacattctgtccggtgccgtgtttgaaccgcgcgcactgaacgagctgtttccaaactggcaggaattgggcgctccgctcaatacacccgtcaagcgtgatgacatctacgtcctgcgcgacgccgaaaaggcgcagaaaattccggactttttcgtccccaagaccatgcacaaccagggcaactacatcatatccctgggcaatctgtgccgctggctcgcccagcaggctgaaaaccttggtgtggaaatctacccgggctttgccgctcaggaagcactgttcgacgaaaacggcgtggtacgcggtatcgttaccggcgatctgggtgtcgaccgcgaaggcaaccccaaggaaggcctgtacacccccggcatggaactgcgcgccaagtacacgctgttcgccgaaggctgccgcggtcacatcggcaagcaattgctcaagcgcttcaatctcgatgacgaagccgatgtacagcattacgccatcggcctgaaggaaatctgggaagtcgacccggccaaacatgaacagggcctggtggtgcacaccgcaggctggccgctggacgatgccaatccgggcggctcgttcctgtaccacttggagaacaatcaggtggtagtcggcctgatcgtcgacctgtcatacagcaacccgtacctgtcgcccttcgacgaattccagcgctacaagcaccacccggtcatcaagcagtaccttgaaggcggcaaacgcatcagctacggcgcacgcgccattgccaagggcggcctgaactcgctgccgaagatggtattccctggcggcgcgttgatcggttgcgacctgggcaccctgaacttcgccaagatcaagggcagccacacggcaatgaagtccggcatgctcgcagccgattcggtggcagatgccctgttcgccggcaaggaaggcggcgacgtgctgacctcctacgtcgatgccttcaaggccagctggctgcatgcagagctgttcgccagccgcaactttggcgtggcgatccacaaatacggcgcgatcaagggtggcgccttcaacttcatcgatcagaacatctttggcggcaagctgccgttcacgctgcacgacaccacgccggactacgcctgcctcaagctggcagcggactcaaagaaaatcgactacccgaaacccgacggcaagctcagcttcgacaagctcagttcggtattcctctccagcaccaaccatgaagaggaacaaccctgccacctgaagctgaccgatccgagcatcccgatcagcaagaacctgccgctgtacgacgagccggcacagcgctattgcccggctggcgtgtatgaagtcatcactaaagaagatggcgaaaagcgctttcagatcaacgcgcagaactgcgtgcactgcaagacctgcgacatcaaggacccttcgcagaacattacctgggttgcaccggaaggcgctggcgggccgacgtacccgaatatgtaa

SEQ ID NO: 100628 - protein, 551 aa, Pseudomonas syringae pv. phaseolicola 1448A
MEREYMEFDVVIVGAGPSGLSAACRLKQKAAEAGQEISVCVVEKGSEVGAHILSGAVFEPRALNELFPNWQELGAPLNTPVKRDDIYVLRDAEKAQKIPDFFVPKTMHNQGNYIISLGNLCRWLAQQAENLGVEIYPGFAAQEALFDENGVVRGIVTGDLGVDREGNPKEGLYTPGMELRAKYTLFAEGCRGHIGKQLLKRFNLDDEADVQHYAIGLKEIWEVDPAKHEQGLVVHTAGWPLDDANPGGSFLYHLENNQVVVGLIVDLSYSNPYLSPFDEFQRYKHHPVIKQYLEGGKRISYGARAIAKGGLNSLPKMVFPGGALIGCDLGTLNFAKIKGSHTAMKSGMLAADSVADALFAGKEGGDVLTSYVDAFKASWLHAELFASRNFGVAIHKYGAIKGGAFNFIDQNIFGGKLPFTLHDTTPDYACLKLAADSKKIDYPKPDGKLSFDKLSSVFLSSTNHEEEQPCHLKLTDPSIPISKNLPLYDEPAQRYCPAGVYEVITKEDGEKRFQINAQNCVHCKTCDIKDPSQNITWVAPEGAGGPTYPNM

SEQ ID NO: 100629 - DNA, 1644 bp, Dechloromonas aromatica RCB
  CDS (1)..(1644): transl_table=11
atgaccatgcgtaccgatcgcgatgcgatggaatacgatgtcgtgatcatcggcggcggcccttcggggctgtcggcggcgatccgcatcaagcagctggccgaacaggctggcaaggaagtgtcggtctgcctgctggagaagggctccgaaatcggcgcccatatcttgtcgggcgccgtgctggaaccgcatgccctgaacgaactgttcccggactggaaggagcgcggtgcgcccctgaacacgccggccggcgaggatcgcttcctgttcctgactgaaggcggttcgttcaagctgccgacgccgccgcagatgtccaaccacggcaactacatcatcagcctgggcaacctctgccgctggctgggtgagcaggccgaggcgctgggtgtcgagatctacccgggcttcgccgccgccgaggtgctctatcacgaggacggttcggtcaagggcgtcgctaccggcgacctgggcatcggcaaggatggccagccgggccataacttccagccgggcatggagttgcatgccaaacagaccatcttcgctgaaggctgtcgcggttcgctgaccaaggaattgtttggccagttcaacctgcgcgacggcgtcgatccgcaaacctacggcatcggcatcaaggaactgtgggaaatcgacccggccaagcaccagcccggcctgatcgtgcatacggtgggctggccggtggattcggccacctatggcggttccttcctctaccacctggaaaacaacctggtggcggtgggctatgtcgtcggcctcgactacaagaacccgtggctgtcgccgtacgaggaattccagcgctacaagacgcacccggccattcgtggcttcttcgagggcggccggcgcatttcctacggtgcccgcgcgctgtccgaaggcggttaccagtccgtgcccaagctgcatttcccgggcggcctgctggttggcgataccgccggctttctcaacgtgccgaagatcaagggcacgcacatggccatggaatccggcatcgttgccgccaaggcggtgttcgagcacctgtgcaaggacaacgccggggccgaggtcgtcgagtatggcgaacagatcaagcagagctggctgtgggccgagttgtacaaggtccgcaatatccgtccggccttcaagtggggcttgctgggtggcctggcctacggcgccatcgacaccttcctgttcggcggcaaggcgccgtggaccatgcgtcatcacgacgaccacagccagctgggcgacaagaacgcttatccgaaaatcgattacccgaagccggatggcaagatcagctttgatcgcctgtcctcggttttcctgtcggcgaccaaccacgaggaaaaccagcagacgcacctgcgcctgaaggatgagtcggtggccatctcagtcaattacgccaagtacggtgcaccggaaacgcgttattgcccggccggcgtgtacgaaatcctcggcgaggaagagggcaagccacggttgcagatcaatggccagaactgtctgcactgcaagacctgcgacatcaaggatccgacccagaatatcaactggacggtgccagaggggggcggcgggccgaattacccaaacatgtag

SEQ ID NO: 100630 - protein, 547 aa, Dechloromonas aromatica RCB
MTMRTDRDAMEYDVVIIGGGPSGLSAAIRIKQLAEQAGKEVSVCLLEKGSEIGAHILSGAVLEPHALNELFPDWKERGAPLNTPAGEDRFLFLTEGGSFKLPTPPQMSNHGNYIISLGNLCRWLGEQAEALGVEIYPGFAAAEVLYHEDGSVKGVATGDLGIGKDGQPGHNFQPGMELHAKQTIFAEGCRGSLTKELFGQFNLRDGVDPQTYGIGIKELWEIDPAKHQPGLIVHTVGWPVDSATYGGSFLYHLENNLVAVGYVVGLDYKNPWLSPYEEFQRYKTHPAIRGFFEGGRRISYGARALSEGGYQSVPKLHFPGGLLVGDTAGFLNVPKIKGTHMAMESGIVAAKAVFEHLCKDNAGAEVVEYGEQIKQSWLWAELYKVRNIRPAFKWGLLGGLAYGAIDTFLFGGKAPWTMRHHDDHSQLGDKNAYPKIDYPKPDGKISFDRLSSVFLSATNHEENQQTHLRLKDESVAISVNYAKYGAPETRYCPAGVYEILGEEEGKPRLQINGQNCLHCKTCDIKDPTQNINWTVPEGGGGPNYPNM

SEQ ID NO: 100631 - DNA, 1647 bp, Dechloromonas aromatica RCB
  CDS (1)..(1647): transl_table=11
atggaacgcgaatccatggaatttgacgtcgtcatcattggtggcggcccggctggcttggcttcggccattcggctgaagcaactggcagcagaaaaaggaactgatctgggcgtctgcctgatcgaaaaaggcgccgaaattggcgcccatattctttccggtgccgtcatggacccgcgcgccctgactgagcttctacccgactggcagaaagacggcgccccgctcaacgcccccgtttccgaagaccgcttctttatcctctccgaaaccggcgccaccaaggtaccgaacagcctgctgcccaactgcttccataacgaaggcaattacgtcatctcgctgggcaatgtctgccgctggctcggcgaacaggcggaagccttgggcgttgaaatctaccccggctttgccggtgccgaagtgctgttcgacgaaaacggtgccgtcaagggtgtagccacgggcgacatgggtcgcctgcacgacggttccgaaggcccgaatttccagatgggcatggaactgctcggcaaatacacgtttttcgctgaaggttgtcgcggccatctcggcaagcagctgatggagaaattcaacctcaatgccgacgccgacccgcaaacctatggcatcggcctcaaggaactgtgggaaatcgagccggacaaacaccagctcggcctcgtcatccacagcggcggctggccgatgcagccggacacctacggtggcggctttctctaccatctggaaaacaaccagatcgccgtcggctttgtcgtcggacttggttacagcaacccgcacctgtcgccctacgaggaattccagcgtttcaagacacatccggaaatccgcaagttcctagaaggtggcaagcgcatcgcctatggtgcccgcgcgctgaccgccggtggcctgcagtccttgcccaagctgaccttccccggcggcgtcctgatcggtgacgatgccggcttgctgaatgccgcccggatcaaggggtcgcactgcgccatcaaatccggcgccctggcggctgaggcctgcttcgaagcgctgacggccgaacgccagcacgacgaactgactgcctacccggaaaccttcaagaagagctggctgttcgaagagctgcatcagacgcgcaatttcaagccatggatggccaagggcctgatgctcggctccatcatgttcggcattgaccaggttctgctgcgcggcaaggcaccatggacgctgcatcacacgacccccgaccacgccaaactgaaaccagcagccgaatgcgaacccatcgcctaccccaagccggatggcgtgatcacctttgaccgcctgtcctccgttttcctctccagcaccaatcacgaggaagaccagccctgccatctgcagttgaaagacgccagcattcctatcagcgtcaatctcgccaaatacgacgccccggaacagcgtttctgcccggctggcgtctatgaaatcctgcgcgatgaaagcggtggtaacccgcgcctgcagatcaacgcgcagaattgcgtacattgcaagacctgcgatatcaaggatccaacccagaacatcaactgggttgttccgcaaggtggcgaaggcccaacttaccccaatatgtaa

SEQ ID NO: 100632 - protein, 548 aa, Dechloromonas aromatica RCB
MERESMEFDVVIIGGGPAGLASAIRLKQLAAEKGTDLGVCLIEKGAEIGAHILSGAVMDPRALTELLPDWQKDGAPLNAPVSEDRFFILSETGATKVPNSLLPNCFHNEGNYVISLGNVCRWLGEQAEALGVEIYPGFAGAEVLFDENGAVKGVATGDMGRLHDGSEGPNFQMGMELLGKYTFFAEGCRGHLGKQLMEKFNLNADADPQTYGIGLKELWEIEPDKHQLGLVIHSGGWPMQPDTYGGGFLYHLENNQIAVGFVVGLGYSNPHLSPYEEFQRFKTHPEIRKFLEGGKRIAYGARALTAGGLQSLPKLTFPGGVLIGDDAGLLNAARIKGSHCAIKSGALAAEACFEALTAERQHDELTAYPETFKKSWLFEELHQTRNFKPWMAKGLMLGSIMFGIDQVLLRGKAPWTLHHTTPDHAKLKPAAECEPIAYPKPDGVITFDRLSSVFLSSTNHEEDQPCHLQLKDASIPISVNLAKYDAPEQRFCPAGVYEILRDESGGNPRLQINAQNCVHCKTCDIKDPTQNINWVVPQGGEGPTYPNM

SEQ ID NO: 100633 - DNA, 1689 bp, Ralstonia eutropha JMP134
  CDS (1)..(1689): transl_table=11
atggatcagcagcaactcctggagcagttcgggccacgtgaggccatggaatacgatgtggtcatcgtcggcggcggtcctgccggcctggccacggccatccgcctcaagcaactggcacaggagaagggcaacgacgtcaacgtctgcgtgctcgaaaagggctcggagcccggcgcgcacatcctgtctggcgccatcatggacccccgcgcactcaatgaactgttcccgaactggaaggaactgggcgcgccgctgaaccagcccgtcaccgaggaccgcttcctgttcctcaacgaatccggctccaagggcaccccgaacgcgctgctgccggaatgcttccacaaccacggcaactacatcgtcagcctgtccaacgtcacgcgctggctgggccagcaggctgaagcgctgggcgtggaaatcttccccggcttcccggccgctgaggtgctctacaacgaagacggctcggtcaagggcgtggccaccggcaacatgggcatcggcaaggaaggcgagcccaccgacaacttccagctcggcatggagctgcatgccaagtacacgattttcgccgaaggcgcgcgcggccatctgggcaagcagctgatcgcgaagttcaagctcgacgccggcaaggacccgcagagctacggtatcggcatcaaggaattgtgggaaatcgacccggccaagcacaagcctggcctggtggttcacaccgccggctggccgctggatccggccacctacggcggctcgttcctgtaccacatggaagacaacaaggtcgcggtcggtttcgtggtcggcctcgactacagcaacccgtggctgtcgccgttcgaggaattccagcgcttcaagacccacccggagatccgcacgttcttcgaaggcggcaagcgcctgtcctacggcgcgcgcgcgattaccgcgggcggcctgctgtcgctgccgaagaccgtgttcccgggcggcgcgctggtcggctgcgatgctggctacctgaatgcctcgcgcatcaagggcagccacgccgcgatcaagaccggcatgatggccgctgaagccgcctatgacgcgctgcaagccggccgccagggcgacgagctgaccgcctacccggccgcgttcgagcagagctggctgcacaaggaactgctgcaggccaagaacttcaagcagtggttcaagaagggccgcaccaccgccacgctgatgaccggcatcgagcaatggcttctgccgaagctcggtatccgcaacccgccctggaccatccaccgcaccaagccggaccacgtctacctgaagccggcggccgagtgcgagaagatcgtctacccgaagccggacggcaagctgaccttcgaccgcctgagctcggtgttcatcagcaacaccaaccacgaagaaaaccagccggctcacctgacgctgaaggacgccagcgtgccggtcaacgtcaactgggaaaagtttgccggccccgaaagccgctactgcccggccggcgtgtacgagttcgtgcaggacgaggcctccggcaaggagcgtctgcagatcaacgcgcagaactgcgtgcactgcaagacctgcgacatcaaggacccgacgcagaacatcgtgtgggtcacgccggaaggcggcggcggcccgaactatgtgaacatgtaa

SEQ ID NO: 100634 - protein, 562 aa, Ralstonia eutropha JMP134
MDQQQLLEQFGPREAMEYDVVIVGGGPAGLATAIRLKQLAQEKGNDVNVCVLEKGSEPGAHILSGAIMDPRALNELFPNWKELGAPLNQPVTEDRFLFLNESGSKGTPNALLPECFHNHGNYIVSLSNVTRWLGQQAEALGVEIFPGFPAAEVLYNEDGSVKGVATGNMGIGKEGEPTDNFQLGMELHAKYTIFAEGARGHLGKQLIAKFKLDAGKDPQSYGIGIKELWEIDPAKHKPGLVVHTAGWPLDPATYGGSFLYHMEDNKVAVGFVVGLDYSNPWLSPFEEFQRFKTHPEIRTFFEGGKRLSYGARAITAGGLLSLPKTVFPGGALVGCDAGYLNASRIKGSHAAIKTGMMAAEAAYDALQAGRQGDELTAYPAAFEQSWLHKELLQAKNFKQWFKKGRTTATLMTGIEQWLLPKLGIRNPPWTIHRTKPDHVYLKPAAECEKIVYPKPDGKLTFDRLSSVFISNTNHEENQPAHLTLKDASVPVNVNWEKFAGPESRYCPAGVYEFVQDEASGKERLQINAQNCVHCKTCDIKDPTQNIVWVTPEGGGGPNYVNM

SEQ ID NO: 100635 - DNA, 1302 bp, Shigella sonnei Ss046
  CDS (1)..(1302): transl_table=11
gtgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacggttcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcggaatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggagccagaaggtggcttgcacagtatgccggtgcaatacgccggtaacggctggctgctggtgggcgatgcgttgcgcagttgcgtcaataccggaatttccgtgcgcggcatggatatggcgctgactggcgcacaggcggcggcacaaacgctaataagcgcctgccagcaccgcgagccgcaaaatctgtttgcgctttatcatcacaacgtagagcgcagcctgctatgggatgttctacaacgttatcagcatgttccggcgcttttgcaacgccctggctggtatcgggcgtggcctgcgttaatgcaggatatttcccgcgatttatgggatcagggtgataaacctgttccaccgctgcgccagttattctggcgtcatttacgtcgtcatggcctgtggcatctggcgggcgatgttatcaggagtctgcgatgtctgtag

SEQ ID NO: 100636 - protein, 433 aa, Shigella sonnei Ss046
MLCSGYLGHDMEDDCDIIIIGAGIAGTACALRCARAGLSVLLLERAEIPGSKNLSGGRLYTHALAELLPQFHLTAPLERRITHESLSLLTPDGVTTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGGICDDLPGGAFLYTNQQTLSLGIVCPLSSLTQSRVPASELLTRFKAHPAVRPLIKNTESLEYGAHLEPEGGLHSMPVQYAGNGWLLVGDALRSCVNTGISVRGMDMALTGAQAAAQTLISACQHREPQNLFALYHHNVERSLLWDVLQRYQHVPALLQRPGWYRAWPALMQDISRDLWDQGDKPVPPLRQLFWRHLRRHGLWHLAGDVIRSLRCL

SEQ ID NO: 100637 - DNA, 1656 bp, Rhodobacter sphaeroides 2.4.1
  CDS (1)..(1656)
atgaccgagcagactccccgcgagcagatggaatatgatgtcgtcatcgtgggggcggggccgtcgggcctgtcggcggctatccggttgaaacagctcgacccggatctgtcggtcgtcctgctcgagaagggctcggaggtgggcgcgcatatcctgtcgggtgcggtgctcgatccggcgggtctgaacgcgctgatccccgactggaaggagaagggcgcgccgctcaacacgccggtgaccgaggatcatttcttcgtcctcacccccgccggccagaccatgctgccctcgtggccggtgccgaagctcatggacaaccacggcaactatgtcgtgtcgatgggcaatgtctgccgctggctcgccacgcaggccgaggagctgggcgtcgagatcttcccgggcatgtcctgttccgagctcgtctatggcgagaacggcgaggtgcgcggcgtggtggcgggcgagttcggcaagaatgccgacggcacgcccggcccgagctacgagcccgggatggagcttctgggcaagtatgtgatgctggccgaaggcgtgcgcggctcgctctccaagcaggtgatggagaagttcgatctccgcaagggctacgggccgcagaaatacggcctcggcatgaaggagatctgggagatcgacccggccaagcacaagccgggccggatctggcacacgatgggctggcctctgggcaagaatgcgggcggcggatcgttcatctatcatgccgagaacaatcaggtcttcatcggcctcgtcgtccacctgaactacgagaacccgcatctctatccctatcaggagttccagcgcttcaagcatcacccgatggtggccgagctgctgaagggcggcaagcgcgtggcctatggcgcgcgggcgatctcggaagggggctaccagtcgctgccgaagatggtcttcccgggcggcgcgctccttggctgctcggccggcatggtcaacgtgccgcgcatcaagggcaaccacaatgccatgctctcgggcaaggccgcggccgaggccgcccatgccgcgatcaaggccggccggcagtcggacgagctgtccgactacgagcagtcggtccgcaaggggcccatcgggcaggacctctggaaggtccgcaacgtcaagccgatctggtcgcatctcgggctctatgcctcgatggcgctgggcgggctcgacatgtggacgaacagcctgttcaacttctcgttcttcggcacgatgaagcaccatcagaccgacgcggccgacaccaagcccgcccgggatttcgcgcccatcgactatcccaagcccgacggcgtcctgtccttcgaccggctgacgaacgtggccttctccttcacgaaccacgaggagagccagcccgcgcatctcaagctcaaggatcccgcgatcccgatcgcggtgaacctgccgaaatatgccgagcctgcgcagcgctactgcccggccggcgtctatgaggtggtgagcgaggcgggccgcgatccgcgcttcgtcatcaacttccagaactgcgtccactgcaagacctgcgacatcaaggatccgagccagaacatcgactggaccacgccgcagggcggggacgggccgaactatcccaacatgtga

SEQ ID NO: 100638 - protein, 551 aa, Rhodobacter sphaeroides 2.4.1
MTEQTPREQMEYDVVIVGAGPSGLSAAIRLKQLDPDLSVVLLEKGSEVGAHILSGAVLDPAGLNALIPDWKEKGAPLNTPVTEDHFFVLTPAGQTMLPSWPVPKLMDNHGNYVVSMGNVCRWLATQAEELGVEIFPGMSCSELVYGENGEVRGVVAGEFGKNADGTPGPSYEPGMELLGKYVMLAEGVRGSLSKQVMEKFDLRKGYGPQKYGLGMKEIWEIDPAKHKPGRIWHTMGWPLGKNAGGGSFIYHAENNQVFIGLVVHLNYENPHLYPYQEFQRFKHHPMVAELLKGGKRVAYGARAISEGGYQSLPKMVFPGGALLGCSAGMVNVPRIKGNHNAMLSGKAAAEAAHAAIKAGRQSDELSDYEQSVRKGPIGQDLWKVRNVKPIWSHLGLYASMALGGLDMWTNSLFNFSFFGTMKHHQTDAADTKPARDFAPIDYPKPDGVLSFDRLTNVAFSFTNHEESQPAHLKLKDPAIPIAVNLPKYAEPAQRYCPAGVYEVVSEAGRDPRFVINFQNCVHCKTCDIKDPSQNIDWTTPQGGDGPNYPNM

SEQ ID NO: 100639 - DNA, 1623 bp, Magnetospirillum magnetotacticum MS-1
  CDS (1)..(1623)
atggaacgtgaatccatggaatttgacgtcgtcgtggtgggtggtgggccttcgggtctgacggccgcgatccgtcttaagcagatcaatcccgaactgaacgtctgcgttctggagaagggctcggaagtgggcgcccatatcctgtcgggcgcggtgatcgagacccgcgccctggcggagctatttcccgactggaaagagcgtgaggccccgctgctgactccggccagcgacgaccgcttcatgttcctgaccgagtccaaggccatccgcctgatgactccgccgcagatgaacaatcacggcaatttcatcgtgtcgctcggcaacttcacccgctggctgggccaacaggccgaggctttgggtgtggagattttcgccggtttcgccgccgccgaggtcctgtatcacgaggacggctcggtcaagggcgtggccaccggcgatatgggcatcggcaaggacggccaacccacccacaactttaccccgggcgtcgagctttgggcccgccagaccatcttctccgagggttgccgcggtagcctcaccaagacgctgttcgagaaattcgacctgcgcgccgagtgcgaggaccagacctacggcatcggcattaaggaattgtgggaggtcgatccggccaagcacaagcccggcaccattctgcacaccgtcggctggccgctcgatacccagacctatggcggctcgttcctctatcacctggagaacaatcaggtggcggtgggcttcgtggtcggcctggactacgccaatccccatctgtcgcccttcgacgaattccagcgcttcaagacccatccggccatccgccccctgttcgagggcggccgccgaatctcctacggcgcccgcgccctgtcggaaggcggcttccagtccattcccaagctgtccttccccggcggcgtgctggtgggcgatacggcgggcttcctcaacgtgcccaagatcaagggcacccacaccgcaatgaagtcggccatggtcgccgccgaggccgtggccgaggccctgggtcatgagggcgggtcgcacgaagtgaccgcctatgccgagcatctgaagaagagctgggtatggtcggaactgcacaccgtgcgcaacatccgtcccagcttccactggggcctgtggggcggcatcgcctattcggcgcttgagacctatctgttcaggggcaagatgccctggacgctccaccaccagcccgaccacctggccctgaagcgggcctcggaatgcccgaagatcacttaccccaagcccgacggcgtggtcagcttcgacaagctgtcctcggtgttcatctcgagcaccaatcacgaggaaaaccagcccgcccatctgaaactgcgtgatgcggcggtgcccatcgccatcaatctcgagcattacgacgcccccgagcagcgctactgcccggctggcgtctatgagatcgtgcgggccgatgacggctccaatccgagactgcagatcaacgcgcagaactgcctgcactgcaagacctgcgacatcaaggaccccacccagaacatcaattgggtggttcccgaaggtggcggtggaccgaactatcccaacatgtaa

SEQ ID NO: 100640 - protein, 540 aa, Magnetospirillum magnetotacticum MS-1
MERESMEFDVVVVGGGPSGLTAAIRLKQINPELNVCVLEKGSEVGAHILSGAVIETRALAELFPDWKEREAPLLTPASDDRFMFLTESKAIRLMTPPQMNNHGNFIVSLGNFTRWLGQQAEALGVEIFAGFAAAEVLYHEDGSVKGVATGDMGIGKDGQPTHNFTPGVELWARQTIFSEGCRGSLTKTLFEKFDLRAECEDQTYGIGIKELWEVDPAKHKPGTILHTVGWPLDTQTYGGSFLYHLENNQVAVGFVVGLDYANPHLSPFDEFQRFKTHPAIRPLFEGGRRISYGARALSEGGFQSIPKLSFPGGVLVGDTAGFLNVPKIKGTHTAMKSAMVAAEAVAEALGHEGGSHEVTAYAEHLKKSWVWSELHTVRNIRPSFHWGLWGGIAYSALETYLFRGKMPWTLHHQPDHLALKRASECPKITYPKPDGVVSFDKLSSVFISSTNHEENQPAHLKLRDAAVPIAINLEHYDAPEQRYCPAGVYEIVRADDGSNPRLQINAQNCLHCKTCDIKDPTQNINWVVPEGGGGPNYPNM

SEQ ID NO: 100641 - DNA, 1656 bp, Pseudomonas aeruginosa UCBPP-PA14
  CDS (1)..(1656)
atggaacgcgaatacatggaattcgacgtcgtcatcgtcggcgccggccccgccggtctgtccgccgcatgccgactgaagcagaaggccgccgaagccggtcaagagatcagcgtctgcgtggtcgagaagggttccgaagtgggcgcccacatcctctccggcgcggtgttcgagccgcgcgcgctgaacgagctgttccccgactggaaggaactcggcgcgccgctcaatactccggtgaccggcgacgacatctacgtcttgaagagcgccgagagcgctaccaaggtgcccaacttcttcgtgcccaagaccatgcacaacgagggcaactatatcatctccctgggcaacctctgccgctggctggcccagcaggccgaaggactgggcgtggagatctacccgggcttcgccgcccaggaagcgctgatcgacgagaacggcgtggtccgcggcatcgtcaccggcgacctcggcgtcgaccgcgaaggcaacccgaaagaaggctactacacccccggcatggagctgcgggccaagtacaccctgttcgccgaaggctgccgcgggcacatcggcaagcaactgatcaagaaatacaacctggacagcaaggccgatgcccagcactacggtatcggcatcaaggaaatctgggacatcgacccgtccaagcacaagcccggcctggtggtccataccgccggctggccgctgaacgacgaaaataccggcggctcgttcctctaccacctggagaacaaccaggtgttcgtcggcctgatcatcgacctgtcctacagcaacccgcacctgtcgccgttcgacgagttccagcgctacaagcaccacccggtggtcaagcagtacctggaaggcggcaagcgcgtggcctacggcgcccgggccatctgcaagggcggcctgaattcgctgccgaagatggtcttccccggcggcgcgctgatcggttgcgacctcggcaccctgaacttcgccaagatcaagggcagccacaccgcgatgaagtccggcatgctcgccgccgacgcgatcgccgaggccctggccgccggccgcgaaggcggcgacgagctgtccaactacgtcgatgcgttcaaggccagctggttgtacgacgaactgttccgcagccgcaacttcggcgcggccatccacaagttcggcgctatcggcggcggcgcgttcaacttcatcgaccagaacatcttcggcggcaagatccccgtcaccctgcatgacgacaagccggactacgcctgcctgaaaaaggccagcgaagcgccgaagatcgactacccgaagccggacggcaagctcagcttcgacaagctgtcctcggtgttcctctccaataccaaccacgaggaagaccagccgatccacctcaagctggccgatgcgagcattccgatcgagaagaacctgccgctctacgacgagccggcccagcgctactgcccggcaggcgtgtacgaagtggtggccaacgacgacggcagcaagcgcttccagatcaacgcgcagaactgcgtgcactgcaagacctgcgacatcaaggacccggcgcagaacatcacctgggtggcgccggaaggtaccggcgggccgaactaccccaacatgtaa

SEQ ID NO: 100642 - protein, 551 aa, Pseudomonas aeruginosa UCBPP-PA14
MEREYMEFDVVIVGAGPAGLSAACRLKQKAAEAGQEISVCVVEKGSEVGAHILSGAVFEPRALNELFPDWKELGAPLNTPVTGDDIYVLKSAESATKVPNFFVPKTMHNEGNYIISLGNLCRWLAQQAEGLGVEIYPGFAAQEALIDENGVVRGIVTGDLGVDREGNPKEGYYTPGMELRAKYTLFAEGCRGHIGKQLIKKYNLDSKADAQHYGIGIKEIWDIDPSKHKPGLVVHTAGWPLNDENTGGSFLYHLENNQVFVGLIIDLSYSNPHLSPFDEFQRYKHHPVVKQYLEGGKRVAYGARAICKGGLNSLPKMVFPGGALIGCDLGTLNFAKIKGSHTAMKSGMLAADAIAEALAAGREGGDELSNYVDAFKASWLYDELFRSRNFGAAIHKFGAIGGGAFNFIDQNIFGGKIPVTLHDDKPDYACLKKASEAPKIDYPKPDGKLSFDKLSSVFLSNTNHEEDQPIHLKLADASIPIEKNLPLYDEPAQRYCPAGVYEVVANDDGSKRFQINAQNCVHCKTCDIKDPAQNITWVAPEGTGGPNYPNM

SEQ ID NO: 100643 - DNA, 1296 bp, Fusobacterium nucleatum subsp. vincentii ATCC 49256
  CDS (1)..(1296): transl_table=11
atgagcgaagaaaaatttgatgccataatcgtaggtggcggtttggcaggttgctctgcagctattgtccttgcaaatgctggacttgcagttcttgtagtggaaagaggagatttttgtggagcaaaaaatatgacaggtggacgactttatggacacagtcttgaaaaaattattccaaactttgcagaggaagctcccatcgaaagaaagataacaagagaaaaaatttctttaatgagtgaggatagttcttttgatatagggtttggatctaaaaagttaagttcaaataatgaaaatgcttcttatacagtgcttcgttctacatttgatagatggttagcttccaaagcagaagaagcaggagcagaaattattcctggaattttagtagatgaactaattctagaagacggaaaagtagtaggagtttctgcaacaggggaagaattatatgcagatgtagtcattcttgcagatggagtaaattctcttttagcacaaagtttaggtatgaaaaaagaattagaacctcatcaagtagctgttggagcaaaagaagttattaaattaggagaagatgttattaatcaacgttttgctgtaaataatggagaaggagtagcatggctttcttgtggtgatcctaccttaggtggatttggaggaggattactttatactaataaagatagtgtttctgttggagtcgttgctactttaagtgatattggacatagtgatttatctatcaatcaattattggatagatttaaagaacaccctgctattgctccatatttagaaggtggaacttctattgaatattcaggtcatttagtcccagaagaagggcttcatatggttccagaattatatagggatggtgttttagtaactggagatgctgctggtttctgtatcaacttaggttttacagttcgtggaatggattttgctattgaatctggtcggcttgctgctgaaacagttatcaaggcacatgaaattggagattttagtgcagctacactatctgattataagaaagctcttgacagcagttttattatggaagacttaaatcaatataagggattccctactttacttggaagaagagaaatttttgaaggtcttcctgcaatggttgatgatattgctacaaaagcatttacagtagatggaaagcaaggacaaagtttgatgatgtatgttattcactctgtggcagaacatacaacagcagcaaaacttgtagattttgttaccacagtattggaggcgttttaa

SEQ ID NO: 100644 - protein, 431 aa, Fusobacterium nucleatum subsp. vincentii ATCC 49256
MSEEKFDAIIVGGGLAGCSAAIVLANAGLAVLVVERGDFCGAKNMTGGRLYGHSLEKIIPNFAEEAPIERKITREKISLMSEDSSFDIGFGSKKLSSNNENASYTVLRSTFDRWLASKAEEAGAEIIPGILVDELILEDGKVVGVSATGEELYADVVILADGVNSLLAQSLGMKKELEPHQVAVGAKEVIKLGEDVINQRFAVNNGEGVAWLSCGDPTLGGFGGGLLYTNKDSVSVGVVATLSDIGHSDLSINQLLDRFKEHPAIAPYLEGGTSIEYSGHLVPEEGLHMVPELYRDGVLVTGDAAGFCINLGFTVRGMDFAIESGRLAAETVIKAHEIGDFSAATLSDYKKALDSSFIMEDLNQYKGFPTLLGRREIFEGLPAMVDDIATKAFTVDGKQGQSLMMYVIHSVAEHTTAAKLVDFVTTVLEAF

SEQ ID NO: 100645 - DNA, 1674 bp, Burkholderia cepacia R18194
  CDS (1)..(1674)
atgacccccgcaagcctcatcgagcaatacggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaagggttccgagatcggcgcgcacatcctgtcgggcgcggtgatggacccgcgcgcgatcaacgaactgttccccgactggaaggaacgcggcgcaccgctcgacgtcgaggtgacggaagaccgcttcctgttcctgtccgagaagggcgcggtcaccacgccgaactgggcgctgcccgccaacttccagaaccacggcaactacgtgatttcgctgggcaacgtcacgcgctggcttggcgcgcaggccgaagcgctgggcgtcgagatcttccccggcttccccgccgccgagatcctgtacaacgacgacggctcggtcaaaggcgtcgcgaccggcaacatgggcgtgggcaaggacggcgagccgaccgagaacttccagctcggcatggagctgcacgcgaagtacacgctgttcgccgaaggctgccgcggccacctcggccgccagctgatctcgaagttcaagctcgacgcgaacgcggaaccgcaggcgtacgggatcggcatcaaggagctgtgggagatcgatccggccaagcacaagccgggcctcgtgatccacacggccggctggccgctgaagtcggatacgtacggcggctcgttcctgtatcacatggacaacaaccaggtcgtggtcggcttcgtggtcggcctgggctacacgaacccgtacctgtcgccgttcgaggaattccagcgctacaagacgcacccgtcgatccgcgcgttcctggaaggcggcaagcgcgtgtcgtacggcgcgcgcgcaatcaccgcgggcgggctgctgtcgctgccgaagacggtgttcccgggcggcgcgctgatcggcgacgacgcgggcttcctgaacgcatcgcgaatcaagggcagccacgcggcgatcaagaccggcatgctggccgccgacgccgcgttcgacgcggtgcaggccggccgccagagcgacgagctcaacgcgtacccggatgccttcaagcagtcgtggctgtacacggagctgtaccgtgcgcgcaacttcaagcagtggatggccaaggggctgtacctcggcacgctgatggtcgggctcgaacagaaggtgatgggcggcaacgtgccgtggacgctgcatcacaagcacgcggaccacgagatgctgaagccggcatcgcaatgcgagccgatcgagtatccgaagccggacggcaagctgacgttcgaccgtctgtcgtcggtgttcatctcgaacacgaaccacgaggagaaccagccggcgcacctgacgctgaaggatgcgaacgtgccggtgaacgtgaacctgcgcacgtacgcggggccggaggggcgcttctgcccggcggccgtgtatgaattcgtgaagaacgacgacggcagcgatcgcctggtgatcaacgcgcagaactgcgtgcactgcaagacctgcgacatcaaggacccgacgcagaacatcgtgtgggtcacgccggaaggtggcggcgggccgaactacccgaacatgtaa

SEQ ID NO: 100646 - protein, 557 aa, Burkholderia cepacia R18194
MTPASLIEQYGPRESMEYDVVIVGGGPAGLSAAIRLKQLAAEKGTEIGVCVLEKGSEIGAHILSGAVMDPRAINELFPDWKERGAPLDVEVTEDRFLFLSEKGAVTTPNWALPANFQNHGNYVISLGNVTRWLGAQAEALGVEIFPGFPAAEILYNDDGSVKGVATGNMGVGKDGEPTENFQLGMELHAKYTLFAEGCRGHLGRQLISKFKLDANAEPQAYGIGIKELWEIDPAKHKPGLVIHTAGWPLKSDTYGGSFLYHMDNNQVVVGFVVGLGYTNPYLSPFEEFQRYKTHPSIRAFLEGGKRVSYGARAITAGGLLSLPKTVFPGGALIGDDAGFLNASRIKGSHAAIKTGMLAADAAFDAVQAGRQSDELNAYPDAFKQSWLYTELYRARNFKQWMAKGLYLGTLMVGLEQKVMGGNVPWTLHHKHADHEMLKPASQCEPIEYPKPDGKLTFDRLSSVFISNTNHEENQPAHLTLKDANVPVNVNLRTYAGPEGRFCPAAVYEFVKNDDGSDRLVINAQNCVHCKTCDIKDPTQNIVWVTPEGGGGPNYPNM

SEQ ID NO: 100647 - DNA, 1686 bp, Rubrivivax gelatinosus PM1
  CDS (1)..(1686)
atgacaccgcaagccctcctcgaccagcacggcccgcgcgaggccatggactacgacgtggtggtggtgggcgcgggacccggcggcctggccacggcgatccgcctgaagcagctcgccgccgaacgcggccaggaggtctccgtcgtcgtgctcgagaagggctccgagcccggcgcccacatcctctcgggcgccgtgatggacccgcgcgcgatcaccgagcttttccccgactggaaggaacgcggcgccccgctggagcagccggtgagcggcgacgacgtgctcttcctctccgagaccggcgccacgcgcacccccgactggctggtgcccgactgcttccacaaccagggcaactacgtcatcagcctgggcgccgtgacccagtggctggcccagcaggccgaggccctgggcgtggagatcttccccggcttcgccgccgccgaagtgctgtacgacgagcagggtgcggtgcgcggcgtcgcgaccggcaacctcggcatcggcaaggacggcgaaccgaccgagaacttccagctcggcatggagctgcgcggcaagtacaccgtgttcgccgaaggcgcccgcgggcacctgggccgccagctcatcgcgaagttccggctcgacgcgggccgcgacccgcagagctatgcgctgggcgtcaaggagctgtgggagatccccgccgcacagcaccgccccggccatgtggtgcacaccgccggctggccgatggactcgcacacctatggcggcggctttctctaccacctggcggacaacaaggtcacgctcggcttcgtgacggggctggactaccagaacccctggctcagcccgttcgaggagatgcagcgctggaagacccacccggccatccgtgcggtgctcgccggtggcaagcgactgggctacggtgcgcgagccatcaccgccggcgggctgctgagcctgcccaagctggtgttcgccggcggtgcgctggtgggctgcgaggccggcacgctgaatgccgcgcgcatcaagggcagccatgccgcgatcaagaccggcatgctgtgcgccgaggcgctggccgaggcgctggcggccgggcgccagcacgacgaactcgccgcctacccggcggccttcgaggcgagctggctgcacgccgagctgcagcgctcgaagaacttcaagcagtggttcaagaagggcaacaccgtgggcgcgctgatgaccggcatcgagcagtggctgctgcccaggctgggcgtgcagcgcccgccgtggacgatccaccgcaccgaggccgatcacgcgcggctcaagccggccgaccagtgcacgccgatcgcctaccccaagcccgacggccagctcaccttcgaccggctgagctcggtgttcatcagcaacaccaaccatgaagagcagcagccggcccacctgacgctgaaggacgcgagcgtgccggtggctgtcaacctggcgacatacgcgggtccggagagccgctactgtccggccggcgtgtacgagttcgtgaagaccgaggccggcaccgaccggctgcagatcaacgcgcagaactgcgtgcactgcaagacctgcgatatcaaggacccgacgcagaacatcgtctgggtcacccccgaggggggcggcgggccgaactacgcaggcatgtga

SEQ ID NO: 100648 - protein, 561 aa, Rubrivivax gelatinosus PM1
MTPQALLDQHGPREAMDYDVVVVGAGPGGLATAIRLKQLAAERGQEVSVVVLEKGSEPGAHILSGAVMDPRAITELFPDWKERGAPLEQPVSGDDVLFLSETGATRTPDWLVPDCFHNQGNYVISLGAVTQWLAQQAEALGVEIFPGFAAAEVLYDEQGAVRGVATGNLGIGKDGEPTENFQLGMELRGKYTVFAEGARGHLGRQLIAKFRLDAGRDPQSYALGVKELWEIPAAQHRPGHVVHTAGWPMDSHTYGGGFLYHLADNKVTLGFVTGLDYQNPWLSPFEEMQRWKTHPAIRAVLAGGKRLGYGARAITAGGLLSLPKLVFAGGALVGCEAGTLNAARIKGSHAAIKTGMLCAEALAEALAAGRQHDELAAYPAAFEASWLHAELQRSKNFKQWFKKGNTVGALMTGIEQWLLPRLGVQRPPWTIHRTEADHARLKPADQCTPIAYPKPDGQLTFDRLSSVFISNTNHEEQQPAHLTLKDASVPVAVNLATYAGPESRYCPAGVYEFVKTEAGTDRLQINAQNCVHCKTCDIKDPTQNIVWVTPEGGGGPNYAGM

SEQ ID NO: 100649 - DNA, 1665 bp, Pseudomonas fluorescens PfO-1
  CDS (1)..(1665)
atggaacgcgaatacatggaattcgacgtggtcatcgtcggtgccggccccgctggcctgtccgccgcctgccgtctgaagcagaaggccgccgaagccggtaaggaaatcagcgtctgcgtggtcgaaaaaggctccgaagtcggcgcacacatcctgtccggtgccgtattcgaaccacgggccctgaacgaactgttcccggactggaaagaactcggcgccccgctgaacacgccagtcacccgcgatgacatcttcgtgctgaaaaacgccgaaagcgcgcaaaaaattcctgacttctttgtgcccaagaccatgcacaacgaaggcaactacattatctccctcggcaacctgtgccgctggctcgctcagcaggccgaaaacctgggcgtggaaatctacccgggcttcgccgctcaggaagcgctgatcgatgaaaacggcgtggtgcgcgggatcatcaccggcgacctcggcgtcgaccgcgaaggccatccgaaagaaggcctgtacaccccgggcatggaactgcgtggcaagtacacgctgttcgccgaaggttgccgtggccacatcggcaagcaactgatcaagcgctataacctggacagcgatgccgacgcccagcactacggcatcgggctgaaggaaatctgggaaatcgacccggccaaacaccagccaggcctggtggtgcacaccgccggttggccgatggacatcatgggcaccgagaacaccggcggctccttcctctatcacctggaaaacaaccaggtggtggtcggtctgatcgtcgacctttcctacagcaacacctacctgtcgccgttcgacgaattccagcgcctcaagcatcacccggtactcaagcagtatctggaaggcggcaagcgcatcagctacggcgcacgtgcgatctgcaagggtggcctgaactcactgccgaaaatggtcttcaagggcggcgcactgatcggttgcgacctcggcactctgaacttcgccaagatcaaaggcagccacaccgcgatgaagtccggcatgctcgccgctgaatccgtggccgacgcgctgttcgctgaaaaggacggcacggaagagctgaccacctacgtcgacgccttcaagaagagctggctctacgaagaactgttcgccagccgcaacttcggcccggcgatccacaagttcggcgctatcgtcggcggcggtttcaactggctggaccagaacatcttcggcggcaaactgccgttcaccctgcacgacaccaagccggactacgcctgcctcaagctcgcggccgactgcaagaagatcgactacccgaaacccgacggcaagatcagcttcgacaagctgagctcggtgttcatctccggtaccaaccatgaagaagaacagccgtgccacctgaaactgaccgatccgaccatcccgctgagcaagaacctgccgctgtacgacgagccggcgcagcgctactgcccggccggcgtgtatgaagtgatcaccaaggaagacggcgagaagcgcttccagatcaacgcccagaactgcgtgcactgcaagacctgtgacatcaaggatccttcgcagaacatcacctgggtgacgccggaaggcgctggcggtccgacctatccaaacatgtaa

SEQ ID NO: 100650 - protein, 554 aa, Pseudomonas fluorescens PfO-1
MEREYMEFDVVIVGAGPAGLSAACRLKQKAAEAGKEISVCVVEKGSEVGAHILSGAVFEPRALNELFPDWKELGAPLNTPVTRDDIFVLKNAESAQKIPDFFVPKTMHNEGNYIISLGNLCRWLAQQAENLGVEIYPGFAAQEALIDENGVVRGIITGDLGVDREGHPKEGLYTPGMELRGKYTLFAEGCRGHIGKQLIKRYNLDSDADAQHYGIGLKEIWEIDPAKHQPGLVVHTAGWPMDIMGTENTGGSFLYHLENNQVVVGLIVDLSYSNTYLSPFDEFQRLKHHPVLKQYLEGGKRISYGARAICKGGLNSLPKMVFKGGALIGCDLGTLNFAKIKGSHTAMKSGMLAAESVADALFAEKDGTEELTTYVDAFKKSWLYEELFASRNFGPAIHKFGAIVGGGFNWLDQNIFGGKLPFTLHDTKPDYACLKLAADCKKIDYPKPDGKISFDKLSSVFISGTNHEEEQPCHLKLTDPTIPLSKNLPLYDEPAQRYCPAGVYEVITKEDGEKRFQINAQNCVHCKTCDIKDPSQNITWVTPEGAGGPTYPNM

SEQ ID NO: 100651 - DNA, 1263 bp, Rhodospirillum rubrum
  CDS (1)..(1263)
atggcgggcaacgccgcctcctacaccctggccaaggccggcctcaacgtcttgcagatcgagcgcggcgaatatcccgggtcgaagaacgttcagggcgccattctgtacgccaatgcggtcgagcagatcattcccggcttccgcgatgacgcgccgctggaacgccacgtcatcgaacagcgcatgtggatgctcgatgaccgctcctatgtgggcagccatttccgcagcgagaacttcaacgaggaaaagcccaaccgctacaccatcatccgcgcccagttcgacaagtggttcaaccgtcaggcccgcgacgccggggcgatggtgatctgcgagaccaccgtgctcgatctgatccgcaacgatgccggcaaggtggtgggcgtgcgctgcgaccgcgagggcggcgaggtctatgccgaggtggtcatcctctgcgacggcgtcaacgccctggtcggccagcgctcgggcatccgctccgagatcagccccgagcacgccgccctggcggtcaaggagatgcacttcctgccgcgcgaggtcatcaacgagcgcttcaacgtgcgcgatgacgaaggcgtggtcatcgaggccctgggcaccgtgacctcgggcatgttgggcaccggcttcctctataccaatggcgagagcatctcgctgggcatcggctgcatcgtgtccgatttcgtcgagaccaagatcggtccggccaagctgcttgaacgcttcaaggcccatccctcgatcgctccgctgatcaggggctccgaggtcaaggaatacgccgcccatctgatccccgaaggcggctataacgcggtgccccagctttacggcgccggctggctgatctgcggcgatgccgcccacttcctcaacgccgcccaccgcgagggctccaatctggcgctcacctccgggcggctggcggcggaaacgatcatcgcgctgaagtccgaaggcaaggcgatgaccgaggccaatctggcgctctatcgccagaagcttgaggaaagcttcgtgctgaaggacctgaagaagtataaggaccttccccacaccctgtggcgcaacaagcagttcgtgacgacctatcccgaattgatggccaaggcggcggagaatttcttccgcgtcgatggtgtcgataagctgaccaaggaaaaagacatcgtgcggagcttccgcaaggcccggggtgttctcggtctggtgggcgacgccgtcaaggtggcgagggcatggcgatga

SEQ ID NO: 100652 - protein, 420 aa, Rhodospirillum rubrum
MAGNAASYTLAKAGLNVLQIERGEYPGSKNVQGAILYANAVEQIIPGFRDDAPLERHVIEQRMWMLDDRSYVGSHFRSENFNEEKPNRYTIIRAQFDKWFNRQARDAGAMVICETTVLDLIRNDAGKVVGVRCDREGGEVYAEVVILCDGVNALVGQRSGIRSEISPEHAALAVKEMHFLPREVINERFNVRDDEGVVIEALGTVTSGMLGTGFLYTNGESISLGIGCIVSDFVETKIGPAKLLERFKAHPSIAPLIRGSEVKEYAAHLIPEGGYNAVPQLYGAGWLICGDAAHFLNAAHREGSNLALTSGRLAAETIIALKSEGKAMTEANLALYRQKLEESFVLKDLKKYKDLPHTLWRNKQFVTTYPELMAKAAENFFRVDGVDKLTKEKDIVRSFRKARGVLGLVGDAVKVARAWR

SEQ ID NO: 100653 - DNA, 1638 bp, Rhodospirillum rubrum
  CDS (1)..(1638)
atgagcgagcgcgaggcgatggaattcgacgtggtcatcgttggcggtggtccctcggggctggcggcggcgatccggctacgtcaactcgccgagcagaccggcaccccctgctcggtctgcgttcttgagaagggctcggagatcggcgcccatatcctgtcgggcgccgtcatcgaaacccgcgccctggatgagctgatccccgattggaaggccaagggggcgccgctcaacgtcgcggccaccgaggatcgcttctggttcctgaccgaacccaaccacatccgcatgccgctgccgccgacgatgaacaatcacggcaattacatcgtcagcctgggcaatgtctgccgctggctggccgaacaggccgaagccgccggggtcgaggtctacgccggcttcgccgccgccgaagtgctttatgacgaacagggcgccgtgcgcggcgtcgccaccggcgacatgggcatcggcaaggatggccagccgacgccggcccatacccccggggtggagttgctggcccgcgtcaccatcttcgccgagggctgtcgcggctcgctgaccaaggggctgctcgcccgctacgacctgaccaaagacgcccagccccagacctatggcatcggactgaaggagctgtgggaggttccgcccgagaaccaccaccagggccatatcctgcacaccatcggctggcccctgcccaccaacacctacggtgggtcgttcctttatcatctggacaacaatcagatcgccgtcggcttcgtcgtcggccttgattaccccaatccctggctgtcgcccttcgaggaattccagcgcttcaagacccatcccagcctgcgcgggatgttcgagggcgggcgacgcatcgcctatggcgcccgcgccctggccgagggcggcctccaatcgctgcccaagctgaccttccccggcggcgttctggtcggcgacacggccggcttcctcaatgttcccaagatcaagggcacccatacggcgatgaagtcggggatggtcgccgccgaagcggtgttcgatcacctgcggcgcggcacggcgggcgaggttcccgattacaccgcccggcttcaagatagttggctgtggagcgagttgcgcggcgtgcgcaacatccgcccggccttccgccatggcctgtgggccggtctggccctggccggcctggacgccctggtgctgcgcggccatgcgccgtggacgctgtcccaccatggcgccgatcacgactctttgaagaaggccgaggcctgcgagaagatcacctatcccaagcccgacggcaaactgagcttcgatcgcctgtcttcggtgttcctctccaataccaatcacgaggaaaaccagccctgccatctgacgctgaaggatgccacggtgccggtggcggtcaatctggcgctgtatggcgggcccgaagcccgttattgcccggccggggtttatgaattcatcgacgacgccgccgctggcggccaacggctgcagatcaacgcccagaactgcgtgcattgcaaaacctgcgacatcaaagatccgacgcaaaatatcaattgggtagtgccccaaggcggcgacggccccaattatcccaatatgtag

SEQ ID NO: 100654 - protein, 545 aa, Rhodospirillum rubrum
MSEREAMEFDVVIVGGGPSGLAAAIRLRQLAEQTGTPCSVCVLEKGSEIGAHILSGAVIETRALDELIPDWKAKGAPLNVAATEDRFWFLTEPNHIRMPLPPTMNNHGNYIVSLGNVCRWLAEQAEAAGVEVYAGFAAAEVLYDEQGAVRGVATGDMGIGKDGQPTPAHTPGVELLARVTIFAEGCRGSLTKGLLARYDLTKDAQPQTYGIGLKELWEVPPENHHQGHILHTIGWPLPTNTYGGSFLYHLDNNQIAVGFVVGLDYPNPWLSPFEEFQRFKTHPSLRGMFEGGRRIAYGARALAEGGLQSLPKLTFPGGVLVGDTAGFLNVPKIKGTHTAMKSGMVAAEAVFDHLRRGTAGEVPDYTARLQDSWLWSELRGVRNIRPAFRHGLWAGLALAGLDALVLRGHAPWTLSHHGADHDSLKKAEACEKITYPKPDGKLSFDRLSSVFLSNTNHEENQPCHLTLKDATVPVAVNLALYGGPEARYCPAGVYEFIDDAAAGGQRLQINAQNCVHCKTCDIKDPTQNINWVVPQGGDGPNYPNM

SEQ ID NO: 100655 - DNA, 1611 bp, Rhodospirillum rubrum
  CDS (1)..(1611)
atgagctttgacgtggtggtggtggggggcggcccctccgggctggccagcgccattcgcctgaagcaattgcgccccgacacctcggtttgtttgatcgagaagggggcggagatcggcgcccatatcctgtcgggcgcggtgatcgaaccccgggccctggatgaattgctgcccgattgggccgagagcgccgagcgcggcgaggcgcccttcgactgtccggcccgcgaggatcgcctgttgctgttaacccgacggcgggcctttcgcctgcccttgccgcgcgaaatgaacaaccatggcaattacatcgtcagcctgggggtgctctgccgctggctggcggcgcgggccgaggccttgggggtcgagatctttcccggcttcgccgccgccgaggtgctttatgacgggaccggcgccgtctgcggcgtggccaccggcgacatgggggtgggccgcgatggtcggccgaccgccgcccatacgcccggcgtcgccttgctcgcccgccagaccctgttcgccgagggctgccggggatcgttgagcgcccaactcggcgatcgcttcgccctgcgccgcgcctgcgatccccaggcctatggccttggcctaaaggaactgtgggagattccggccgagaaccatcagccgggattgatcctgcacaccgccggttggcccttgccgtccgatacctatggcggatcgttcctctatcacctgggaaccaatcaggtggcggtcggctatgtggtggcccttgattacgccaatccctatctgtcgcccttcgaggaattccagcgtcacaagacccatccggcgatcgccgaccatctgcgcggcgggcggcgcatcgcctatggggcgcgggcgctttcggaaggcgggctgcaatccctgccgcaactgacctttcccggcggggcgctgatcggcgataccgccggtttcctcaatgttcccaagatcaagggcacccatgcggcgatgaaatcggcaatgctggcggccgaggcggtggtccgggccttggatgagggcagggtggaggctttgggctacaccccggccttcgccgccagctggctgcacaaggaattgcacgccgtgcgcaatgtgcggcccagcttccgctgggggcggtgggccggcttcgcctatgcgggactggaaagtgtcgttctgcgcggcaaggcgccctggaccctgcgcaaccgcgccgaccacctgcacctgggcaaggcggccgatcaccgacccatcgactatgccaaacccgatggcgtgctgaccttcgaccgcctgtcctcggtctatctgtccaacaccaatcacgtcgaagaccaaccctgccacctgcgtctgaaagaccccgaggtggcgatcgccaccaatctggcggttttcgacgcccccgagcagcgctattgcccggccggcgtctatgaggtggtgcgcgagggcgcggccgagccgcgcctgcagatcaacgcccagaactgcctgcattgcaaaacctgcgacatcaaggatcccacccagaacattgtctggaccgtgcccgaaggcggcggcggcccggcctattcggcgatgtga

SEQ ID NO: 100656 - protein, 536 aa, Rhodospirillum rubrum
MSFDVVVVGGGPSGLASAIRLKQLRPDTSVCLIEKGAEIGAHILSGAVIEPRALDELLPDWAESAERGEAPFDCPAREDRLLLLTRRRAFRLPLPREMNNHGNYIVSLGVLCRWLAARAEALGVEIFPGFAAAEVLYDGTGAVCGVATGDMGVGRDGRPTAAHTPGVALLARQTLFAEGCRGSLSAQLGDRFALRRACDPQAYGLGLKELWEIPAENHQPGLILHTAGWPLPSDTYGGSFLYHLGTNQVAVGYVVALDYANPYLSPFEEFQRHKTHPAIADHLRGGRRIAYGARALSEGGLQSLPQLTFPGGALIGDTAGFLNVPKIKGTHAAMKSAMLAAEAVVRALDEGRVEALGYTPAFAASWLHKELHAVRNVRPSFRWGRWAGFAYAGLESVVLRGKAPWTLRNRADHLHLGKAADHRPIDYAKPDGVLTFDRLSSVYLSNTNHVEDQPCHLRLKDPEVAIATNLAVFDAPEQRYCPAGVYEVVREGAAEPRLQINAQNCLHCKTCDIKDPTQNIVWTVPEGGGGPAYSAM

SEQ ID NO: 100657 - DNA, 1692 bp, Burkholderia fungorum LB400
  CDS (1)..(1692)
ttggagatcggtgctgtgtcaatcccgacattcctgagtgacgatgagatcactcgcgaagcaatcgaatacgacgtcgtgatcgtcggcggcgggccggccggcctgtccgcggcgatccgcctgaagcagctggcagcggaacaaggcgctgaaattggcgtgtgcgtactggaaaaaggctcggagatcggggcgcatatcctctcgggcgcggtgatggatccgcgcgccatgaccgagctgatcccggactggaaggaaaaaggcgcaccgctgacggtggatgtgaccgaagaccgtttcctgttcctgaccgaaaccggttcgaagagcgtaccggtctgggcgttgccggataacttcaaaaaccacggcaactatgtgatcagtctcgcgaacgtgacgcgctggctgggtcagcaggccgaagcactgggtgtcgagatctttccgggttttcccgcagccgagattctgtacaacgaagatggctcggtcaaaggcgtcgcgaccggcaacctcggtatcggcaaggacggccagccaaccgaaaacttccagctcggcatggaactgcacgcgaagtacacgcttttctgtgaaggcgcgcgtgggcacctgggccgtcagctgaacgataaattcaggctgcgcgacggcgtcgatccgcaggtctacggcatcggcatcaaggaactgtgggaaatcgatccgtcgaagcacaagccgggtctggtgatgcacacggccggctggccgctggagagcgacacgtacggtggctcgttcctctatcacatggataacaaccaggtggtggtgggcttcgtggtgggcctcggttataccaatccgtacctgtcgccgttcgaggaattccagcgctacaagacgcatccggaaatccgcaaggtgctcgaaggcggcaagcgtgtgtcgtacggcgcacgggcgatcaccgccggtggcctgatgtcgctgccaaagctggtgttcccaggcggtgcgctggtcggcgacgatgcgggcttcctgaacgcatcgcggatcaagggctcgcacgcggcgatcaagaccggcatgctggccgctgaagcggcgttcgaagcggtgcaggctggacgtcagtcggatgaactgatggcctatccggagagcttcaggacctcgtggctgcacacggaactgcatcgcgcacgtaacttcaagcagtggatgagcaagggcctgtaccttggcacgctgatggtgggcatcgaacagaagctgctgggcggcaatgtgccctggacgctgcatcaccagcactgggatcacgagatgctcaaaccggcttcgcaatgcaagccgatcacgtatccgaagcccgatggcaagctgacgttcgaccgtctctcgtcggtgttcatctcgaacaccaaccacgaagagaaccagcctccacacctgacgctgaaagatccgtccgtgccggtgaacgtgaactggcagacctatgcgggcccggagtcgcgttactgcccggcgcaagtgtacgagttcgtgaagaacgacgacaacaccgaacgcctcgtgatcaacgcgcagaactgcgtgcactgcaagacgtgcgatatcaaggacccgacgcagaacatcgtgtgggtgacgcccgagggtggcggcggtccgaactacccgaacatgtag

SEQ ID NO: 100658 - protein, 563 aa, Burkholderia fungorum LB400
MEIGAVSIPTFLSDDEITREAIEYDVVIVGGGPAGLSAAIRLKQLAAEQGAEIGVCVLEKGSEIGAHILSGAVMDPRAMTELIPDWKEKGAPLTVDVTEDRFLFLTETGSKSVPVWALPDNFKNHGNYVISLANVTRWLGQQAEALGVEIFPGFPAAEILYNEDGSVKGVATGNLGIGKDGQPTENFQLGMELHAKYTLFCEGARGHLGRQLNDKFRLRDGVDPQVYGIGIKELWEIDPSKHKPGLVMHTAGWPLESDTYGGSFLYHMDNNQVVVGFVVGLGYTNPYLSPFEEFQRYKTHPEIRKVLEGGKRVSYGARAITAGGLMSLPKLVFPGGALVGDDAGFLNASRIKGSHAAIKTGMLAAEAAFEAVQAGRQSDELMAYPESFRTSWLHTELHRARNFKQWMSKGLYLGTLMVGIEQKLLGGNVPWTLHHQHWDHEMLKPASQCKPITYPKPDGKLTFDRLSSVFISNTNHEENQPPHLTLKDPSVPVNVNWQTYAGPESRYCPAQVYEFVKNDDNTERLVINAQNCVHCKTCDIKDPTQNIVWVTPEGGGGPNYPNM

SEQ ID NO: 100659 - DNA, 1311 bp, Burkholderia fungorum LB400
  CDS (1)..(1311)
atgaagaagccttcacagttcgatgcgatcgtggtcggcgccggtccgtccggcaacgccgccgcctatacgatggccagggccggcctgaaagtgctgcagatcgagcgcggcgaatatcccggcagcaagaacgtgcagggcgcgatcctgtacgcgaaggcgctcgaagaaatcatcccggacttccgcgacgacgcgccgctggagcgccacatcatcgaacagcggatatggatgctcgacgacacctcgttcgtcggcacgcacatgcgcagcgaggaatacaacaagccgccctataaccgctacacgatcatccgcgcgcagttcgacaagtggttttcatcgaaagtgcgcgaagccggcgccttgctgatctgcgagaccacggtcaagcaactcatcatggacggcgatcaggtggtgggcgtgcagtgcgatcgcgagcatggcgacgtgtacgcggacgtggtggtgctcgccgacggcgtgaattcgacgctcgcgcgcaaggcgggctttcatggagagatcgaagccggcaacgtcgcgctcgcggtcaaggagattctcttcatgcccgaggagacgatccgccagcgctttaacatcggcgaggacgacggtgtcgtgatcgagatggtcggcaggatcaccgacggcatgacgggcaccggctttctttataccaacaaggaatcgctcaccatcggcgtgggctgcatgctgggcgacttcaagaagaaccccaaccgcacgagcccctacgtgctgctcgaaaagatgaagcagcacccgtcgatcgcaccgctgatcgcgggcggcgagatgaaggaatattgcgcgcatctgattccggaaggcggctttcacgccatcccgcgcgtctacggcaacggctggatgatcgtcggcgactcgggtggtttcgtgaacgccgcgcaccgcgaaggctcgaatctcgcgatgaccaccgggcgcctcgccgccgaaacggtgattcacgcgaaagccgcgggcctcggctatcgcgcggccacgctcaaggcctacaaggccgcgctcgaccagagcttcgtgatgaaagacctgcacaagtaccgcgacatgccggccgtgctgcaccagaatccgcagttcttcacgacctaccccgatctcgtggcacgcgccgcgcgcacgatgctcacggtcgacggcaaggacaagaaaagcaaggagcgcgaaattttttcgagcttccgcaaagcccgttcgcttgccggcatggtgggtgacgcctacaaactcctgagggccttccgatga

SEQ ID NO: 100660 - protein, 436 aa, Burkholderia fungorum LB400
MKKPSQFDAIVVGAGPSGNAAAYTMARAGLKVLQIERGEYPGSKNVQGAILYAKALEEIIPDFRDDAPLERHIIEQRIWMLDDTSFVGTHMRSEEYNKPPYNRYTIIRAQFDKWFSSKVREAGALLICETTVKQLIMDGDQVVGVQCDREHGDVYADVVVLADGVNSTLARKAGFHGEIEAGNVALAVKEILFMPEETIRQRFNIGEDDGVVIEMVGRITDGMTGTGFLYTNKESLTIGVGCMLGDFKKNPNRTSPYVLLEKMKQHPSIAPLIAGGEMKEYCAHLIPEGGFHAIPRVYGNGWMIVGDSGGFVNAAHREGSNLAMTTGRLAAETVIHAKAAGLGYRAATLKAYKAALDQSFVMKDLHKYRDMPAVLHQNPQFFTTYPDLVARAARTMLTVDGKDKKSKEREIFSSFRKARSLAGMVGDAYKLLRAFR

SEQ ID NO: 100661 - DNA, 1674 bp, Burkholderia fungorum LB400
  CDS (1)..(1674)
atgacccccgcaagtctcattgagcagtacggtccgcgcgagtcgatggaatacgacgtcgtgatcgtcggcggcgggccggccggcctgtccgcggcgatccgcctgaagcagctggcagcggaacaaggcgctgaaattggcgtgtgcgtactggaaaaaggctcggagatcggggcgcatatcctctcgggcgcggtgatggatccgcgcgcgatgaccgagctgatcccggactggaaggaaaaaggcgcaccgctgacggtggatgtgaccgaagaccgtttcctgttcctgaccgaaaccggttcgaagagcgtgccggtctgggcattgccggataacttcaaaaaccacggcaactatgtgatcagtctcgccaacgtaacgcgctggctgggtcagcaggccgaagcgctgggcgtcgagatttttccgggttttcccgcggccgaaatcctctacaacgacgatggctcggtcaaaggcgtcgcgaccggcaacctcggcatcggcaaggacggccagccaaccgaaaacttccagctcggcatggaactgcacgcgaagtacacgcttttctgtgaaggcgcgcgtggacacctgggccgtcagctgaacgataaattcaggctgcgcgaaggcgtcgatccgcaggtctacggcatcggcatcaaggaactgtgggaaatcgatccgtcgaagcacaagccgggtctggtgatgcacacggccggctggccgctggagagcgacacctacggcggctcgttcctctatcacatggacaacaaccaggtggtggtgggcttcgtggtaggcctcggttataccaatccgtacctgtcgccgttcgaggaattccagcgctacaagacgcatccggaaatccgcaaggtgctcgaaggcggcaagcgtgtgtcgtatggcgcgcgcgcgatcaccgccggtggcctgatgtcgctgccgaagctggtgttcccgggcggtgcgctggtcggcgacgatgcgggcttcctgaacgcatcgcggatcaagggctcgcacgcggcgatcaagaccggcatgctggccgctgaagcggcgttcgaagcggtgcaggctggacgcaccagcgatgaactcaccgcctatccggagagcttcaggacctcgtggctgcacacggaactgcatcgcgcccgcaacttcaagcagtggatgagcaagggcctctacctcggcacgctgatggtcggcatcgaacagaagctgctgggcggcaatgtgccgtggacgctgcatcatcagcactgggatcacgagatgctcaaaccggcttcgcaatgcaagccgatcacgtatccgaagcctgatggcaagctgacgttcgaccgtctctcatcggtgttcatctcgaacacgaaccacgaagagaaccagcccgcacacctgacgctgaaagatccgtccgtgccggtgaacgtgaactggcagacctatgccggtccggagtcgcgttattgcccggcgcaagtgtacgagttcgtgaagaacgacgacaacaccgaacgcctcgtgatcaacgcgcagaactgcgtgcactgcaagacgtgcgatatcaaggacccgacgcagaacatcgtgtgggtgacgcccgagggtggcggcggtccgaactacccgaacatgtaa

SEQ ID NO: 100662 - protein, 557 aa, Burkholderia fungorum LB400
MTPASLIEQYGPRESMEYDVVIVGGGPAGLSAAIRLKQLAAEQGAEIGVCVLEKGSEIGAHILSGAVMDPRAMTELIPDWKEKGAPLTVDVTEDRFLFLTETGSKSVPVWALPDNFKNHGNYVISLANVTRWLGQQAEALGVEIFPGFPAAEILYNDDGSVKGVATGNLGIGKDGQPTENFQLGMELHAKYTLFCEGARGHLGRQLNDKFRLREGVDPQVYGIGIKELWEIDPSKHKPGLVMHTAGWPLESDTYGGSFLYHMDNNQVVVGFVVGLGYTNPYLSPFEEFQRYKTHPEIRKVLEGGKRVSYGARAITAGGLMSLPKLVFPGGALVGDDAGFLNASRIKGSHAAIKTGMLAAEAAFEAVQAGRTSDELTAYPESFRTSWLHTELHRARNFKQWMSKGLYLGTLMVGIEQKLLGGNVPWTLHHQHWDHEMLKPASQCKPITYPKPDGKLTFDRLSSVFISNTNHEENQPAHLTLKDPSVPVNVNWQTYAGPESRYCPAQVYEFVKNDDNTERLVINAQNCVHCKTCDIKDPTQNIVWVTPEGGGGPNYPNM

SEQ ID NO: 100663 - DNA, 1692 bp, Burkholderia fungorum LB400
  CDS (1)..(1692)
atgggcacggacaaatcaatgacccccgcaagtctcattgagcagtacggtccgcgcgagtcgatggaatacgacgtcgtgatcgtcggcggcggcccggccggcctgtccgcggcgatccgcctgaagcagctggcagcggaacaaggcgctgaaattggcgtgtgcgtactggaaaaaggctcggagatcggggcgcatatcctctcgggcgcggtgatggatccgcgcgcgatgaccgagctgatcccggactggaaggaaaaaggcgcaccgctgacggtggatgtgaccgaagaccgtttcctgttcctgaccgaaaccggttcgaagagcgtgccggtctgggctttgccggataacttcaaaaaccacggcaattacgtgatcagtctcgcgaacgtgacgcgctggctgggtcagcaggccgaagcactgggcgtcgagatttttccgggttttcccgcagccgagattctgtacaacgacgatggctcggtcaaaggcgtcgcgaccggcaacctcggtatcggcaaggacggccagccgaccgaaaacttccagctcggcatggaactgcacgcgaagtacacgcttttctgtgaaggcgcgcgtgggcacctgggccgtcagctgaacgacagattcaggctgcgtgaaggcgtcgatccgcaggtctacggcatcggcatcaaggaactgtgggaaatcgatccgtcgaagcacaagccgggtctggtgatgcacacggccggctggccgctggagagcgacacctacggcggctcgttcctctatcacatggacaacaaccaggtggtggtgggcttcgtggtaggcctcggctacacgaatccgtacctgtcgccgttcgaggaattccagcgctacaagacgcatccggcgatccgcgcggtgctcgaaggcggcaagcgtgtgtcgtacggcgcgcgcgccatcacggcgggtggcctgatgtcgctgccgaaactggtgttcccgggcggtgcgctggtcggcgacgatgcgggcttcctgaacgcatcgcggatcaagggctcgcatgcggcgatcaagactggcatgctggccgctgaagcggcgttcgaagcggtgcaggctggacgcaccagcgatgaactcaccgcctatccggagagcttcaggacctcgtggctgcacacggaactgcaccgcgcgcgtaacttcaagcagtggatgagcaagggcctgtacctcggcacgctgatggtgggcatcgaacagaagctgctgggcggcaatgtgccgtggacgctgcatcatcagcactgggatcacgagatgctcaaaccggcttcgcaatgcaagccgatcacgtatccgaagcctgatggcaagctgacgttcgaccgtctctcatcggtgttcatctcgaacacgaaccacgaagagaaccagcccgcacacctgacgctgaaagatccgtccgtgccattgaacgtgaactggcagacctatgccggtccggagtcgcgttattgcccggcgcaagtgtacgagttcgtgaagaacgacgacaacaccgaacgcctcgtgatcaacgcgcagaactgcgtgcattgcaagacgtgcgatatcaaggacccgacacagaacatcgtgtgggtgacgcccgagggtggcggcggtccgaactacccgaacatgtaa

SEQ ID NO: 100664 - protein, 563 aa, Burkholderia fungorum LB400
MGTDKSMTPASLIEQYGPRESMEYDVVIVGGGPAGLSAAIRLKQLAAEQGAEIGVCVLEKGSEIGAHILSGAVMDPRAMTELIPDWKEKGAPLTVDVTEDRFLFLTETGSKSVPVWALPDNFKNHGNYVISLANVTRWLGQQAEALGVEIFPGFPAAEILYNDDGSVKGVATGNLGIGKDGQPTENFQLGMELHAKYTLFCEGARGHLGRQLNDRFRLREGVDPQVYGIGIKELWEIDPSKHKPGLVMHTAGWPLESDTYGGSFLYHMDNNQVVVGFVVGLGYTNPYLSPFEEFQRYKTHPAIRAVLEGGKRVSYGARAITAGGLMSLPKLVFPGGALVGDDAGFLNASRIKGSHAAIKTGMLAAEAAFEAVQAGRTSDELTAYPESFRTSWLHTELHRARNFKQWMSKGLYLGTLMVGIEQKLLGGNVPWTLHHQHWDHEMLKPASQCKPITYPKPDGKLTFDRLSSVFISNTNHEENQPAHLTLKDPSVPLNVNWQTYAGPESRYCPAQVYEFVKNDDNTERLVINAQNCVHCKTCDIKDPTQNIVWVTPEGGGGPNYPNM

SEQ ID NO: 100665 - DNA, 1650 bp, Novosphingobium aromaticivorans DSM 12444
  CDS (1)..(1650)
atgagcgaacgggaatcgatgccgtatgacgtcgttatcgtcggcggcggtccggcggggctggcagcctcgatccggttgaagcaggtgaatcccgaaatttcggtctgcatcctcgaaaagggttcggaaatcggcgcgcacattctttcgggcgcggtggtcgatcccaaggcgcttgacgaactgctgcccgaatggcgcgagcagggctgcccgatggccgaagtgcccgtgaccgacaactggcattgggtgctctcgaagaagggcaagatgtcgatcccacactggccgatgcctccgttcatgtcgaacgacggcaactacaccggttcgctcggcaacctgtgccgctggctggccgagcaggcgatggaactgggcgtggaaatcttccccggctttcctgccgccgaagtgctgttcgatgaaaatggcgcggtcatgggcgtcgcgaccggcgacatgggcgtggccaaggacggttcgcacaagcccgactaccagccgggcatggaacttcacgccaagtacaccctcttcgcagagggcgcacgcgggcatctgaccaagcgcctgaaggctcacttcgacctcgagcgcgattgcgagccgcaggtctacggcatcggcatcaaggaactgtgggacatcgatccggccaagcacgtgccgggccgcgtcattcacacgcagggctggccgctgtcggagtcgaactcatggggcggtggtttcctttaccaccaggccaacaaccaggtggcgctcggtttcgtcaccgcgctcgattacgccaacccctatgtctatccgttcgaggaattccagcgctggaagcagcacccggaaatccgcgcgatcctcgagggcggtcgccgcgtttcctacggggcgcgtgcgatcaacgagggtggctggcagtccgtgccgcgcctgtcgttccctggcggcgcgctgatcggttgctccgcaggcttcgtcaacgtgccgcgcatcaagggcagccacaccgcgatgaagagcgggatgctggcggccgattccatcgtggcggccatcgcggcgggccgcgagaaggacgacatggtcgaatacgacactgccgtccgcgaaagctggatcgccacggaactcaagaaggtccagaacgcgcagccgctcgtcgccaagttcggcggtgaactgggcaccgtgctggcgggggcggacatgtggcttcgcactgtcggcggcttcggcatctggaagccgatgaagcaccaccgcgacagcgaggcgacccagcgcgccgacctctacaagccgatcgcctatcccaagcccgatggcgtcatcaccttcgaccgtctgaccagcgtctcgttttcctataccaaccacgaggaggaccagccctgtcacctcgtgctcaaggacccggaggtgccgacgcgcatcaacctgccgctctatgccgggcccgagcagcgctattgcccggcgggcgtctacgagtacgtcggcgtcgaggaaggcaatccgcgccttcagatcaacgcgcagaactgcgtccactgcaagacctgcgacatcaaggacatgacccagaacatcgactgggtcacgcccgaaggcggcggtggcccgaactacccgaacatgtga

SEQ ID NO: 100666 - protein, 549 aa, Novosphingobium aromaticivorans DSM 12444
MSERESMPYDVVIVGGGPAGLAASIRLKQVNPEISVCILEKGSEIGAHILSGAVVDPKALDELLPEWREQGCPMAEVPVTDNWHWVLSKKGKMSIPHWPMPPFMSNDGNYTGSLGNLCRWLAEQAMELGVEIFPGFPAAEVLFDENGAVMGVATGDMGVAKDGSHKPDYQPGMELHAKYTLFAEGARGHLTKRLKAHFDLERDCEPQVYGIGIKELWDIDPAKHVPGRVIHTQGWPLSESNSWGGGFLYHQANNQVALGFVTALDYANPYVYPFEEFQRWKQHPEIRAILEGGRRVSYGARAINEGGWQSVPRLSFPGGALIGCSAGFVNVPRIKGSHTAMKSGMLAADSIVAAIAAGREKDDMVEYDTAVRESWIATELKKVQNAQPLVAKFGGELGTVLAGADMWLRTVGGFGIWKPMKHHRDSEATQRADLYKPIAYPKPDGVITFDRLTSVSFSYTNHEEDQPCHLVLKDPEVPTRINLPLYAGPEQRYCPAGVYEYVGVEEGNPRLQINAQNCVHCKTCDIKDMTQNIDWVTPEGGGGPNYPNM

SEQ ID NO: 100667 - DNA, 1623 bp, Microbulbifer degradans 2-40
  CDS (1)..(1623)
atggagtacgacgttgtagttgttggtgccggccccgcaggcctaagcgcagcgtgccgtttaaaacaactccagccagacgtttctgtgtgtgtcgtcgaaaaagggtctgaggttggtgcacacattctctctggtgctgtacttgaacccactgcccttaccgaactcttccccgattggaaagagcgccaagcgccgttacacaccgctgtaagcgaagacaatatttacctcatgcaatccggcgagtcggccatgagtattcccaatctcttcgcgccctataccatgcacaatgaaggcaactatataattagccttggtaatctttgccgctggttagccgagcaggcagaagcactagaggtagaggttttccctggctttaccgctgccgaagtattgttcgacgataataactgtgttgctggcattattactggcgacatgggagtgggtgtaaacggcgaagaaaaagacagctacacacccggtatggagttacgtgcaaaatacaccttgtttgctgaaggctgccgagggcacttgggcaagcaactaatcgaacactacaaactagacgaaggtaaagacccgcagcactacggtattggtattaaagagctgtggaaaattccggcggataaacacaagcaagggcttgtagtacatagcgcgggctggccactttctgagagcggctcggcaggcggtggttttttataccatttcgaagataaccaagtagctgttggcttaattaccgacctctcctactctaacccatatgttagcccatttgatgaatttcaacgctacaaacaccaccctaaaattgctcaatacttagaaggcggcgaacgcattgcctatggcgctagagcaattactaagggtggtttgcagtctcagcctaaaatgcattttgctggtggcctactcattggtgatgacgccggcactttaaactttgccaaaattaaaggttcgcacacagcaatgaagagcggcatggtagcggctgaggttgtaaataaggcattgcaagcgggtagctcgcaaacagatttggttgagtttgaacaggcctacaaagaaagttgggcatataaagaattgcacgcacaacgcaattttggccctgcgcaacacaagtggggcaatttgttaggctcggcctatgcctttattgatatgaatatatttcgcggcgccctaccatggaccctgcgtgaccccaagcccgattacgcgcaaatggtgccggcgaaagatgctaaacccatcaactaccctaaaccagataacaaattgagctttgataagctttcgtcagtcttcttatcgaataccaaccatgaggaagatcaaccagtacatttaaagctgattgacccaagcttgccaatcgataaaaacctaccactttataacgagccagctcagcgctattgccctgcaggtgtttacgaggttgtggaagatgccgctggtaaacgcttccaaataaatgcccagaattgcgtacattgtaaaacttgcgacattaaagacccgctgcaaaatattacctgggtaacccctgaaggcggtggcgggccgaattaccctaatatgtaa

SEQ ID NO: 100668 - protein, 540 aa, Microbulbifer degradans 2-40
MEYDVVVVGAGPAGLSAACRLKQLQPDVSVCVVEKGSEVGAHILSGAVLEPTALTELFPDWKERQAPLHTAVSEDNIYLMQSGESAMSIPNLFAPYTMHNEGNYIISLGNLCRWLAEQAEALEVEVFPGFTAAEVLFDDNNCVAGIITGDMGVGVNGEEKDSYTPGMELRAKYTLFAEGCRGHLGKQLIEHYKLDEGKDPQHYGIGIKELWKIPADKHKQGLVVHSAGWPLSESGSAGGGFLYHFEDNQVAVGLITDLSYSNPYVSPFDEFQRYKHHPKIAQYLEGGERIAYGARAITKGGLQSQPKMHFAGGLLIGDDAGTLNFAKIKGSHTAMKSGMVAAEVVNKALQAGSSQTDLVEFEQAYKESWAYKELHAQRNFGPAQHKWGNLLGSAYAFIDMNIFRGALPWTLRDPKPDYAQMVPAKDAKPINYPKPDNKLSFDKLSSVFLSNTNHEEDQPVHLKLIDPSLPIDKNLPLYNEPAQRYCPAGVYEVVEDAAGKRFQINAQNCVHCKTCDIKDPLQNITWVTPEGGGGPNYPNM

SEQ ID NO: 100669 - DNA, 1650 bp, Erythrobacter litoralis HTCC2594
  CDS (1)..(1650): transl_table=11
atgagcgaacgcgaatccatgccgtgcgatgtcgtgatcgtcgggggcggcgttgccggcctcgctgcggcgatccgtctcaagcagatcaacgaagaactcgaagtcgtcgtgctcgagaaaggctcggagatcggcgcgcatatcctgtccggagcggtggtcgatcccaagtcgctcgacgaactgctgcctgaatggcgcagcatggattgcccgatggcggagaccccggtgaccgacaattggcactggatgctgtcaaagaatggcaagatttccgtcccgcacctcgccatgccgcccttcatgtcgaatgccggttgctacaccggttcgctcggcaatctcacccgctggctcggcgagcaggccgaagggctgggcgtgatggtcttccccggcttcccagccagcgaagtcatgttcgacgagaaaggcgcggtgaagggcgtcatcacgcaggacatgggcattgccgaagacggcagccacaagcccgactaccagcccggcatggagatcgaggccaagtacaccttcttcgccgagggcgcgcgcggcaacctgaccaagcagctcaaggcgaagttcgacctcgaagccgattgtgagccgcaggtctacggtctcggcatcaaggaattgtgggacatcgatcccgacaagcacgtgccgggccgcgtgctgcacacgcagggctggccgctttcggaaagcgacagctggggcgggggcttcctctaccaccaggccaacggccaggtcgcgctcggtttcgtgaccgcgctcgattacaaaaacccttgggtttccccctaccaggaattccagcgctggaagcagcacccggcgatccgcgaatatctcgaaggcggcaagcgtgtcgcttacggcgcgcgcgcgatcaacgaaggtggctggcagtccgtgcccaggctcgccttccccggcggcgcactgatcggttgcgcggcaggcttcgtcaacgtcccgcgcatcaagggcagccataccgcgatgaagagcggcatgctggcggcggaatccgccgccgctgcgatcgcggcggagcgcgagcatgacgagctggccgattacgacagcaatctgcgcgacagctggatcgcgaccgagctcaagaaggccaggaacgcgcagccgctggtcgccaagtatggcggcgacatcggcactgtgctggccggcgccgacatgtggatgcgcgccctgaaaatcggcctgcccttcacgatgaagcacgatcccgattacaccaaaacgggccgtgccgatctttatcccatcatcgactatcccaagcccgatggcgagatcaccttcgataagctgaccaatgtggcttacagctacaccaaccatgccgaagaccagccggtccacctgcaggtgaaggactgggagctgcagaaggaaagcgagctcggcgtctatggcgggccctcggcgcgctattgcccggcgggtgtctatgaatggctggaggacgaagactcgggcgagatgaagttccagatcaatgcccagaactgcgtccactgcaagacttgcgacatcaaggacccgaaccagaacatcaactgggtcacgcccgaaggcggcggcgggccgaactatccgaatatgtga

SEQ ID NO: 100670 - protein, 549 aa, Erythrobacter litoralis HTCC2594
MSERESMPCDVVIVGGGVAGLAAAIRLKQINEELEVVVLEKGSEIGAHILSGAVVDPKSLDELLPEWRSMDCPMAETPVTDNWHWMLSKNGKISVPHLAMPPFMSNAGCYTGSLGNLTRWLGEQAEGLGVMVFPGFPASEVMFDEKGAVKGVITQDMGIAEDGSHKPDYQPGMEIEAKYTFFAEGARGNLTKQLKAKFDLEADCEPQVYGLGIKELWDIDPDKHVPGRVLHTQGWPLSESDSWGGGFLYHQANGQVALGFVTALDYKNPWVSPYQEFQRWKQHPAIREYLEGGKRVAYGARAINEGGWQSVPRLAFPGGALIGCAAGFVNVPRIKGSHTAMKSGMLAAESAAAAIAAEREHDELADYDSNLRDSWIATELKKARNAQPLVAKYGGDIGTVLAGADMWMRALKIGLPFTMKHDPDYTKTGRADLYPIIDYPKPDGEITFDKLTNVAYSYTNHAEDQPVHLQVKDWELQKESELGVYGGPSARYCPAGVYEWLEDEDSGEMKFQINAQNCVHCKTCDIKDPNQNINWVTPEGGGGPNYPNM

SEQ ID NO: 100671 - DNA, 1773 bp, Azotobacter vinelandii AvOP
  CDS (1)..(1773): transl_table=11
atgagtttgccgcgccgtcgcgcgggtcgcgaatgcatccgctcccaccgatggcacggcgagagggttggtgccgcgccgtggccgtcgactcacaacaacaagatcgaggagaaacgcaccatgcgcgaagccatggaattcgacgtggtcatcgtcggcgccggcccggcgggcctgtccgccgcctgccggctgatgcaactggccaacgaacagggccggccgctggaagtctgcgtggtggagaagggctccgaggtcggggcgcacatcctctccggcgcggtgttcgagtcccgcgccctggaagaactgtttcccgactggcgggaacgcggcgcaccgctgcacaccccggtcagcgccgacgaggtctacctgctcaaggacgccgaacgggcgctgaaactgcccgacgcgctgctgccgaaaagcctgcacaacgccggcaaccacatcgtcagtctcggcaacctggtgcgctggctgggcgagcaggccgaggcgctgggcgtgcaggtgttccccggcttcgccgccgcggaagtgctccacgacgaaaacggccgggtcaggggcgtggccaccggcgacatgggcgtggccgccgacggcagccacaaggacggcttcatgccgggcatggaactgcacgcccgctacaccctgttcgccgagggctgccgcggccacctgggcaagcaactgatcgaacgcttcggactggccggggacaccgacccgcagcactacggcctgggcatcaaggagctgtgggacatcgagccgtcccgccaccggcccgggctggtgatccacggcgccggctggccgctggacaaggacagcggcggcggcttcttcctctaccacgccgagaaccaccaggtggtggtcggcctgatcgtcgatttgaactacgccaacccctggctgagtcccttcgacgagttccagcgcctcaagcaccaccccgtgctgaagcagtacctggaaggcggcaagcgggtctcctacggcgcgcgggccatcgccaagggcggcttcaacgccctgccggagatggcttttccgggcggcctgctgctcggctgcgacgccgggaccctgaacgtggcgaagatcaagggcagccacacggcgatgaaatcggggctgctggcggcggagacggtgttcgccgcgcttctggaggaactgccggacagcgcctgggcaccgcgctggaaggcggccttcgaggcctcctggttgcacgaagaactccatcgctcgcgcaacttcggcccggcgctgcaccggctcgggccgctggccggcggggcgttcaatttcgtcgaacagaatgtcttcgccggccggctgccgttcaccctgcacgaccgcgaggccgaccacgcccggctgcgcccggcggcggagtgtccgcccatcgtctacccgaagccggacggggtgctgggcttcgacaggctcggctcggtgttcctctccaacaccaaccacgaggaggaccagccctgccacctgcggctggccgacccggccatcccgatcggtcgcaacctgccgctgtacgccgaaccggcgcagcgctactgcccggcgggggtgtacgaggtgctgggggaggagcagggcggaccacggctgcagatcaacgcgcagaactgcctgcactgcaagacctgcgacatcaaggacccggcgcagaacatcgtctggacgacgcccgagggcggtggcgggccgaactatcccaatatgtag

SEQ ID NO: 100672 - protein, 590 aa, Azotobacter vinelandii AvOP
MSLPRRRAGRECIRSHRWHGERVGAAPWPSTHNNKIEEKRTMREAMEFDVVIVGAGPAGLSAACRLMQLANEQGRPLEVCVVEKGSEVGAHILSGAVFESRALEELFPDWRERGAPLHTPVSADEVYLLKDAERALKLPDALLPKSLHNAGNHIVSLGNLVRWLGEQAEALGVQVFPGFAAAEVLHDENGRVRGVATGDMGVAADGSHKDGFMPGMELHARYTLFAEGCRGHLGKQLIERFGLAGDTDPQHYGLGIKELWDIEPSRHRPGLVIHGAGWPLDKDSGGGFFLYHAENHQVVVGLIVDLNYANPWLSPFDEFQRLKHHPVLKQYLEGGKRVSYGARAIAKGGFNALPEMAFPGGLLLGCDAGTLNVAKIKGSHTAMKSGLLAAETVFAALLEELPDSAWAPRWKAAFEASWLHEELHRSRNFGPALHRLGPLAGGAFNFVEQNVFAGRLPFTLHDREADHARLRPAAECPPIVYPKPDGVLGFDRLGSVFLSNTNHEEDQPCHLRLADPAIPIGRNLPLYAEPAQRYCPAGVYEVLGEEQGGPRLQINAQNCLHCKTCDIKDPAQNIVWTTPEGGGGPNYPNM

SEQ ID NO: 100673 - DNA, 1653 bp, Azotobacter vinelandii AvOP
  CDS (1)..(1653): transl_table=11
gtggaacgcgaatacatggaattcgacgtcgtcatcgtcggcgccggtcccgccggtctgtcggccgcctgccgactgaagcagcaggccgccgaatccggccaggagatcagcgtgtgcgtggtcgagaagggttccgaggtcggcgctcacattctctccggcgccgtcttcgaaccgcgtgccctgaacgaactcttcccggactggaaggagctgggcgctccgctgaacaccccggtcaagcgcgacgacatctatctgttcaggagcgccgaaaaggccatcaggctgccggacttcctcgtgcccaggaccatgcacaacgagggcaattacatcatttccctgggcaacctgtgccgctggctggcccagcaggccgaagccctgggcgtggaaatctacccgggcttcgccgcccaggaggcgctgatcgacgacggcggcacagtgcgaggcatcgtcaccggcgacctgggcgtcgaccgcgaaggcaggccgaaggacagctatacccccggcatggagctgcgcggcaagtacaccctgttcgccgaaggttgccgcggccacatcggcaagcaactgatcgcccgctaccggctggacgaccaggccgatgtccagcactacggcatcggcatcaaggagatctgggacgtcgagccggcccgccacgagcagggcctggtggtgcacaccgccggctggccgctggacgacgacaacccgggcggctccttcctctatcacctggaaaacggccaggtggtggtcggtctgatcgtcgacctgtcctacagcaatcccttcctgtcgcccttcgacgagttccagcgctacaagcaccatccggcgatcgcccgctacctggaaggcggcaagcgggtggcttacggcgctcgcgccatctgcaagggcggcctgaattcgctgccgaagatggtcttccccggtggcgcgctgatcggctgcgacctgggcaccctgaacttcgccaagatcaagggcagccacaccgccatgaagtccggcatgctggccgccgatgcggtcctcgccgccctcgccggcggcagccagggcggcgacgaactgaacggctacgtcgagtcgttcaagtccagctggctgtacgacgaactgttccgcagccgcaacttcggcgccgccatccacaagttcggcgcgctggccggcggggccttcaacttcatcgaccagaacctgttcggcggcaagatcccgttcaccctgcacgacgacaacccggaccacgcctgcctgaagctggcctccgaatcgaagcggatcgactatcccaagccggacggcaagctcagtttcgacaagctcagctcggtattcctctccaataccaaccatgaagaagaccagccctgccacctgcgcctggccgatccgagcatcccgatcacccgcaacctgccgctgtacgacgagccggcgcagcgctactgcccggccggcgtctacgaggtggtgagccaggacgacggcagcccgcgcttccagatcaacgcgcagaactgcgtgcactgcaagacctgcgacatcaaggacccagcgcagaacatcacctgggtggccccggaaggcgccggcggtcccaactaccccaacatgtaa

SEQ ID NO: 100674 - protein, 550 aa, Azotobacter vinelandii AvOP
MEREYMEFDVVIVGAGPAGLSAACRLKQQAAESGQEISVCVVEKGSEVGAHILSGAVFEPRALNELFPDWKELGAPLNTPVKRDDIYLFRSAEKAIRLPDFLVPRTMHNEGNYIISLGNLCRWLAQQAEALGVEIYPGFAAQEALIDDGGTVRGIVTGDLGVDREGRPKDSYTPGMELRGKYTLFAEGCRGHIGKQLIARYRLDDQADVQHYGIGIKEIWDVEPARHEQGLVVHTAGWPLDDDNPGGSFLYHLENGQVVVGLIVDLSYSNPFLSPFDEFQRYKHHPAIARYLEGGKRVAYGARAICKGGLNSLPKMVFPGGALIGCDLGTLNFAKIKGSHTAMKSGMLAADAVLAALAGGSQGGDELNGYVESFKSSWLYDELFRSRNFGAAIHKFGALAGGAFNFIDQNLFGGKIPFTLHDDNPDHACLKLASESKRIDYPKPDGKLSFDKLSSVFLSNTNHEEDQPCHLRLADPSIPITRNLPLYDEPAQRYCPAGVYEVVSQDDGSPRFQINAQNCVHCKTCDIKDPAQNITWVAPEGAGGPNYPNM

SEQ ID NO: 100675 - DNA, 1299 bp, Azotobacter vinelandii AvOP
  CDS (1)..(1299): transl_table=11
atggctgaaagattcgacgtgatcgtggtcggcgccggcatggccggtaacgccgccgcatacaccctggccaagggggggctcaaggtgctgcagatcgagcggggcgaaacccccggttcgaagaacgtgcagggcgccatcctctatgccgacgccatcgagaagatcattcccgacttccgcgacgacgcgcccctggagcggcacctgatcgagcagcgcgtgtgggtgatggacgacgcttcctacgtcggtacccactaccgttcggaggacttcaacaagccgccctacaaccgctacaccatcatccgcgtgcatttcgaccagtggttcaacaagaaggcccgcgaggccggcgtgctgaccatctgcgaaaccaccgtcaccgatctgctgatcgagggtggcaaggtggtgggcgtgcgcaccgatcgccagggcggcgaagtccgtgccgacgcggtgatcctggccgacggggtgaactcgcgcctggcggtgaaggccggcttccagccggagatcaagcccgagaacgtggccctggcggtgaaggaaatccatttcctgccccaggaaaccatcgaggcgcgcttcaacatcggcgaagaggaaggcgtggccatcgagatggccggcaagatcagcgccggcatgatgggcaccggcttcctctacaccaacaaggagtcgatcaccctgggggtcggctgcatgctgtccgacttcaagcagcagaagatctccccctatgagctgctggaccggatgaagacccacccctccatcgcgcccttgatcgccggcagcgagatgaaggagtacgccgcccacctgatccccgaaggcggctacaacgccattccccaggtatacggcgacggctggatgatcgccggcgacgccggccagttcgtcaacggcatccatcgcgaaggctccaacctggccatgaccaccggcatgctggcggcccagaccctggtcgagctgcgggccgcggacaagcccttcagcgccgccaacctggccgagtacaagaagaagctggacgacagcttcgtcatgaaggacctgaagaagtaccggcgcatgccggagatcttccacaagaacaagcagttcttcaccacctatccggacctgctctccagggccgcgcagacccttatccgggtcgatggcgtggacaagaaaaccaaggaaaaggaaatcaagaaaagcttcatcgcctcacgttcgctgttcgggctgatcggcgatgccttcaagttctggcgtgccgtcgagtaa

SEQ ID NO: 100676 - protein, 432 aa, Azotobacter vinelandii AvOP
MAERFDVIVVGAGMAGNAAAYTLAKGGLKVLQIERGETPGSKNVQGAILYADAIEKIIPDFRDDAPLERHLIEQRVWVMDDASYVGTHYRSEDFNKPPYNRYTIIRVHFDQWFNKKAREAGVLTICETTVTDLLIEGGKVVGVRTDRQGGEVRADAVILADGVNSRLAVKAGFQPEIKPENVALAVKEIHFLPQETIEARFNIGEEEGVAIEMAGKISAGMMGTGFLYTNKESITLGVGCMLSDFKQQKISPYELLDRMKTHPSIAPLIAGSEMKEYAAHLIPEGGYNAIPQVYGDGWMIAGDAGQFVNGIHREGSNLAMTTGMLAAQTLVELRAADKPFSAANLAEYKKKLDDSFVMKDLKKYRRMPEIFHKNKQFFTTYPDLLSRAAQTLIRVDGVDKKTKEKEIKKSFIASRSLFGLIGDAFKFWRAVE

SEQ ID NO: 100677 - DNA, 1809 bp, Azotobacter vinelandii AvOP
  CDS (1)..(1809): transl_table=11
gtgtgggagcggattcatccgcgacctgccgaaggcagccggaggccttgtgcccactccagtcgcgaatgcatccgctcccaccgatggcacggcgagggggttggtgccgcgccgtggccgtcgactcacaacaacaagatcgaggaggaacgcaccatgcgcgaagccatggaattcgacgtggtcatcgtcggcgccggcccggcgggcctgtccgccgcctgccggctgatgcaactggccaacgaacagggccggccgctggaagtctgcgtggtggagaagggctccgaggtcggggcgcacatcctctccggcgcggtgttcgagtcccgcgccctggaagaactgtttcccgactggcgggaacgcggcgcaccgctgcacaccccggtcagcgccgacgaggtctacctgctcaaggacgccgaacgggcgctgaaactgcccgacgcgctgctgccgaaaagcctgcacaacgccggcaaccacatcgtcagtctcggcaacctggtgcgctggctgggcgagcaggccgaggcgctgggcgtgcaggtgttccccggcttcgccgtcgcggaagtgctccacgacgagaacggccgggtcaagggcgtggtcaccggcgacatgggcgtggccgccgacggcagccacaaggacggcttcatgccgggcatggaactgcacgcccgctacaccctgttcgccgagggctgccgcggccacctgggcaagcaactggtcgaacgcttcggactggctggggacaccgacccgcagcactacggcctgggcatcaaggagctgtgggacatcgagccgtcccgccaccggcccgggctggtgatccacggcgccggctggccgctggacaaggacagcggcggcggcttcttcctctaccacgccgagaaccaccaggtggtggtcgggctgatcgtcgatttgaactacgccaacccctggctgagtcccttcgacgagttccagcgcctcaagcaccaccccgtgctgaaacagtacctggaaggcggcaagcgggtgtcctacggggcgcgggccatcgccaagggcggcttcaacgccctgccggagatggcttttccgggcggcctgctgctcggctgcgatgccgggaccctgaacgtggcgaagatcaagggcagccacacggcgatgaagtcggggctgctggcggcggagacggtgttcgccgcgcttctggaggaactgccggacagcgcctgggcgccgcgctggaaggcggccttcgaggcttcctggctgcacgaggagctgtaccgctcacgcaacttcggcccggcgctgcaccggctcgggccgctggccggcggggcgttcaacgtcgtcgaacagaatgtcttcgccggccggctgccgttcaccctgcacgaccgcgaggccgaccacgcccggctgcgcccggcggcggagtgtccgcccatcgtctacccgaagccggacggggtgctgggcttcgacaggctcggctcggtgttcctctccaacaccaaccacgaggaggatcagccctgccacctgcggctggccgacccggccatcccgatcggtcgcaacctgccgctgtacgccgagccggcgcagcgctactgcccggcgggggtgtacgaggtgctggaggaagagcagggcggtccgcggctgcagatcaacgcgcagaactgcctgcactgcaagacctgcgacatcaaggacccggcgcagaacatcgtctggacgacgcccgagggtggtggcggacccaattatccgaacatgtag

SEQ ID NO: 100678 - protein, 602 aa, Azotobacter vinelandii AvOP
MWERIHPRPAEGSRRPCAHSSRECIRSHRWHGEGVGAAPWPSTHNNKIEEERTMREAMEFDVVIVGAGPAGLSAACRLMQLANEQGRPLEVCVVEKGSEVGAHILSGAVFESRALEELFPDWRERGAPLHTPVSADEVYLLKDAERALKLPDALLPKSLHNAGNHIVSLGNLVRWLGEQAEALGVQVFPGFAVAEVLHDENGRVKGVVTGDMGVAADGSHKDGFMPGMELHARYTLFAEGCRGHLGKQLVERFGLAGDTDPQHYGLGIKELWDIEPSRHRPGLVIHGAGWPLDKDSGGGFFLYHAENHQVVVGLIVDLNYANPWLSPFDEFQRLKHHPVLKQYLEGGKRVSYGARAIAKGGFNALPEMAFPGGLLLGCDAGTLNVAKIKGSHTAMKSGLLAAETVFAALLEELPDSAWAPRWKAAFEASWLHEELYRSRNFGPALHRLGPLAGGAFNVVEQNVFAGRLPFTLHDREADHARLRPAAECPPIVYPKPDGVLGFDRLGSVFLSNTNHEEDQPCHLRLADPAIPIGRNLPLYAEPAQRYCPAGVYEVLEEEQGGPRLQINAQNCLHCKTCDIKDPAQNIVWTTPEGGGGPNYPNM

SEQ ID NO: 100679 - DNA, 1311 bp, Burkholderia vietnamiensis G4
  CDS (1)..(1311): transl_table=11
atgaaaaaaccgtcgcaattcgacgcgatcgtcgtcggcgcggggccgtcgggcaatgccgcggcctacacgatggcgaaagccggcctcaaggtgctgcagatcgagcgcggcgagtatccgggcagcaagaacgtgcaaggcgcgatcctctacgcgaaggcgctcgaggagatcatccccgactttcgcgacgacgcgccgctcgagcgtcacatcatcgagcagcgcctgtggatgctcgacgagacgtcgttcgtcggcacgcacgtgcgcagcgacgactacaacaagccgccgtacaaccgctacacgatcatccgcgcgcagttcgacaagtggttctcgtcgaaggtgcgcgaggccggcgcgctggtcatctgcgagacgaccgtcaaccatctgatcctcgacggcgaccaggtggtcggcgtgcagtgcgatcgcgagcagggcgacgtgtacgccgacgtcgtgatcctcgccgacggcgtgaattcgacgcttgcgcgcaaggccggtttccacgacgagatcgacgccggcaacgtcgcgctcgccgtcaaggaaatcctgttcatgccggaggagacgatccgtcagcgcttcaacatcggcgaggacgaaggcgtcgtgatcgagatggtcggccggatcaccgacggcatgatgggcacgggcttcctgtacacgaaccgcgaatcgctgacgatcggcgtcggctgcatgctgtccgatttcaagcagaacgcgaaccgcacgagcccgtacgtgctgatcgagcagatgaagcgccatccggcgatcgcgccgctgatcgagggcggcgagatgaaggagtactgcgcgcacctgatcccggaaggcggcttccacgcggtgccgcgcgtgtacggcaacggctggatgatcgtcggcgactcgggcggcttcgtcaacgccgcgcaccgcgaaggctcgaacctcgcgatgacgaccgggcgcctcgcggccgagacggtgatcgcggcgaaggcggccggccgcggctatcgcgcgggcgagctgaaggcgtacaaggcgaagctcgacgacagcttcgtgatgaaggatctgtacaagtaccgcgacatgccggacacgctgcaccgcaatccgcaattcttcacgacctatccggatctggtcgcgaacgccgcgcgcacgatgatcaccgtcgacggcgtcgacaagaagaccaaggagcgcgcgatcgtgtcgagcttccgcaagagccgttcgttcgccggcctggtcggcgacgcgttcaaaatctggagggcattccgatga

SEQ ID NO: 100680 - protein, 436 aa, Burkholderia vietnamiensis G4
MKKPSQFDAIVVGAGPSGNAAAYTMAKAGLKVLQIERGEYPGSKNVQGAILYAKALEEIIPDFRDDAPLERHIIEQRLWMLDETSFVGTHVRSDDYNKPPYNRYTIIRAQFDKWFSSKVREAGALVICETTVNHLILDGDQVVGVQCDREQGDVYADVVILADGVNSTLARKAGFHDEIDAGNVALAVKEILFMPEETIRQRFNIGEDEGVVIEMVGRITDGMMGTGFLYTNRESLTIGVGCMLSDFKQNANRTSPYVLIEQMKRHPAIAPLIEGGEMKEYCAHLIPEGGFHAVPRVYGNGWMIVGDSGGFVNAAHREGSNLAMTTGRLAAETVIAAKAAGRGYRAGELKAYKAKLDDSFVMKDLYKYRDMPDTLHRNPQFFTTYPDLVANAARTMITVDGVDKKTKERAIVSSFRKSRSFAGLVGDAFKIWRAFR

SEQ ID NO: 100681 - DNA, 1674 bp, Burkholderia vietnamiensis G4
  CDS (1)..(1674): transl_table=11
atgacccccgcaagcctcatcgagcaatacggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaaaggttccgagatcggcgcgcacatcctgtcgggcgcggtgatggacccacgcgcgatcaccgagctgttccccgactggaaggaacgcggcgcgccgctcaccgtcgaggtgaccgaagatcgcttcctgttcctgtccgagcagagcgcggtcacgacgccgaactgggcgttgcccgacaacttcaagaatcacggcaactacgtgatctcgctgggcaacgtcacgcgctggctcggcacgcaggccgaagcgctcggcgtcgagatcttccccggctttccggccgcggagatcctctacaacgacgacggctcggtgaagggcgtcgccaccggcaacatgggcgtaggcaaggacggcgagccgaccgagaacttccagctcggcatggaactgcacgcgaagtacacgctgttcgccgagggttgccgcggtcatctgggccgccagctgatctcgaagttcaagctcgacgcgaacgcggatccgcaagcgtacgggatcggcatcaaggagctgtgggagatcgatccggcgaaacacaagccgggcctcgtgatccacacggccggctggccgctgaagtcggacacctacggcggctcgttcctgtaccacatggacaacaatcaggtcgtggtcggcttcgtggtcggcctcggctacacgaacccgtacctgtcgccgttcgaggagttccagcgctacaagacgcatccgtcgatccgcgcattcctcgaaggcggcaagcgcgtgtcgtacggtgcacgtgcgatcaccgcgggcgggctgctgtcgttgccgaagactgtgttcccgggcggcgcgctgatcggcgacgacgcgggctttttgaacgcgtcgcggatcaagggcagccacgcggcgatcaagactggcatgctggccgccgacgcggcgttcgatgcggtgcaggccggccgccagtcggacgagctgcacgcctacccggacgcattccggcagtcgtggctgtacaccgagctgtaccgcgcgcgcaacttcaagcagtggatggccaaggggctgtacctcggcacgctgatggtcgggctcgagcagaaggtgatgggcggcaacgtgccgtggacgctgcaccacaagcatgcggaccacgagatgctgaagcccgcgtcgcaatgcacgccgatcgagtatccgaagccggacggcaagctgacgttcgacaggttgtcgtcggtgttcatctcgaacacgaaccacgaggagaaccagccggcgcatctgacgctgaaggatgcgagcgtgccggtgaacgtgaacctgcgcacctacgcggggccggagggacggttctgcccggcagcggtatacgagttcgtgaagaacgacgacggcagcgaccgcctcgtgatcaacgcgcagaactgcgtgcactgcaagacctgcgacatcaaggacccgacgcagaacatcgtgtgggtcacgccggaaggcggcggcgggccgaattatccgaacatgtaa

SEQ ID NO: 100682 - protein, 557 aa, Burkholderia vietnamiensis G4
MTPASLIEQYGPRESMEYDVVIVGGGPAGLSAAIRLKQLAAEKGTEIGVCVLEKGSEIGAHILSGAVMDPRAITELFPDWKERGAPLTVEVTEDRFLFLSEQSAVTTPNWALPDNFKNHGNYVISLGNVTRWLGTQAEALGVEIFPGFPAAEILYNDDGSVKGVATGNMGVGKDGEPTENFQLGMELHAKYTLFAEGCRGHLGRQLISKFKLDANADPQAYGIGIKELWEIDPAKHKPGLVIHTAGWPLKSDTYGGSFLYHMDNNQVVVGFVVGLGYTNPYLSPFEEFQRYKTHPSIRAFLEGGKRVSYGARAITAGGLLSLPKTVFPGGALIGDDAGFLNASRIKGSHAAIKTGMLAADAAFDAVQAGRQSDELHAYPDAFRQSWLYTELYRARNFKQWMAKGLYLGTLMVGLEQKVMGGNVPWTLHHKHADHEMLKPASQCTPIEYPKPDGKLTFDRLSSVFISNTNHEENQPAHLTLKDASVPVNVNLRTYAGPEGRFCPAAVYEFVKNDDGSDRLVINAQNCVHCKTCDIKDPTQNIVWVTPEGGGGPNYPNM

SEQ ID NO: 100683 - DNA, 1629 bp, Burkholderia mallei 10229
  CDS (1)..(1629)
atggaatacgacgtcgtgatcgtcggcggcggccccgcaggcctgtcggcggccatccggctcaagcagctcgccgccgagaaaggtgcggaaatcggcgtgtgcgtgctcgaaaagggctcggagatcggcgcgcacatcctgtcgggcgccgtgatggacccgcgcgcgatcaccgaactgttccccgactggaaggaaaagggggcgccgctcaacgtcgacgtcaccgaggaccgcttcctgttcctgaccgagaaaagctcgttccaggtacccaactgggcactgccggacaatttcaagaaccacggcaattacgtgatcagcctcggcaacgtcacgcgctggctcggccagcaggcggaagccctgggcgtcgagatcttcccgggcttcccggccgccgagatcctctataacgacgacggctcggtcaagggcgtcgcgacgggcaacatgggcgtcggcaaggacggcgagccgaccgagaacttccagctcggcatggagctgcacgcgaagtacacgctcttttgcgaaggcgcgcgcggccacctcggccgccagttgatggacaagttcaagctgaacgcgaacagcgacccgcaggcgtacgggatcggcatcaaggagctgtgggagatcgatccggtcaagcacaagccgggcctcgtgatccacacggccggctggccgctgtcgtcggacacgtacggcggctcgttcctgtatcacatggacaacaatcaggtcgtcgtcggcttcgtcgtcggcctcgcgtactcgaacccgtacctgtcgccgttcgaggagttccagcgctacaagacgcatccggcgatccggccgttcctcgaaggcggcaagcgcgtgtcgtacggcgcgcgcgcgatcaccgcgggcggcctgctgtcgctgccgaagacggtgttcccgggcggcgcgctcgtcggcgacgacgcgggcttcctgaacgcgtcgcggatcaagggcagccatgcggcgatcaagaccggcatgctcgccgccgaagccgcgttcgacgcggtgcaggcgggccgccaggccgacgaactgaccgcttacccggacgcgttcaagacgtcctggctgcacaccgagctctatcgcgcgcgcaacttcaagcagtggatgggcaaggggctgtatctcggcacgctgatggtcggcgtcgagcagaagctgatgaacggcaacgtgccgtggacgctgcatcaccagcacggcgaccacgagatgctgaagcccgcgtcgcagtgccagccgatcgactatccgaagccggacggcaagctgacgttcgaccggctgtcgtcggtattcatctcgaacacgaaccatgaggagaaccagcccgcgcacctgacgctgaaggacgcgagcgtgccggtcaacgtcaatctgcgcacgtatgcggggccggaagcgcgcttctgcccggccgccgtctatgaattcgtgaagaacgacgacggcagcgaccgcctcgtgatcaacgcgcagaactgcgtgcactgcaagacctgcgacatcaaggatccgacgcagaacatcgtgtgggtcacgccggaaggcggcggcgggccgaactacccgaacatgtga

SEQ ID NO: 100684 - protein, 542 aa, Burkholderia mallei 10229
MEYDVVIVGGGPAGLSAAIRLKQLAAEKGAEIGVCVLEKGSEIGAHILSGAVMDPRAITELFPDWKEKGAPLNVDVTEDRFLFLTEKSSFQVPNWALPDNFKNHGNYVISLGNVTRWLGQQAEALGVEIFPGFPAAEILYNDDGSVKGVATGNMGVGKDGEPTENFQLGMELHAKYTLFCEGARGHLGRQLMDKFKLNANSDPQAYGIGIKELWEIDPVKHKPGLVIHTAGWPLSSDTYGGSFLYHMDNNQVVVGFVVGLAYSNPYLSPFEEFQRYKTHPAIRPFLEGGKRVSYGARAITAGGLLSLPKTVFPGGALVGDDAGFLNASRIKGSHAAIKTGMLAAEAAFDAVQAGRQADELTAYPDAFKTSWLHTELYRARNFKQWMGKGLYLGTLMVGVEQKLMNGNVPWTLHHQHGDHEMLKPASQCQPIDYPKPDGKLTFDRLSSVFISNTNHEENQPAHLTLKDASVPVNVNLRTYAGPEARFCPAAVYEFVKNDDGSDRLVINAQNCVHCKTCDIKDPTQNIVWVTPEGGGGPNYPNM

SEQ ID NO: 100685 - DNA, 1674 bp, Burkholderia cenocepacia AU 1054
  CDS (1)..(1674): transl_table=11
atgacccccgcaagcctcatcgagcaatacggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaagggttccgagatcggcgcgcacatcctgtcgggcgcggtgatggacccgcgcgcgatcaccgagctgtttcccgactggaaggagcgcggcgcgccgctcgacgtcgaggtgacggaagaccgcttcctgttcctgtccgagaagagcgcggtgaccacgccgaactgggcgctaccggacaacttcaagaatcacggtaattacgtgatctcgctgggcaacgtcacgcgctggcttggggcacaggccgaggcgctcggtgtggagatcttccccggctttcccgccgcggaaatcctctacaacgacgacggctcggtcaaaggcgtcgccaccggcaacatgggcgtgggcaaggacggcgagccgaccgagaacttccagctcggcatggagctgcacgcgaagtacacgctgttcgccgaaggctgccgcggccatctgggccgccagctgatctcgaagttcaagctcgacgcgaacgccgatccgcaggcatacgggatcggcatcaaggaactgtgggaaatcgacccggccaagcacaagccgggcctcgtgatccacacggccggctggccgctgaagtccgacacgtacggcggctcgttcctgtatcacatggacaacaaccaggtggtggtcggcttcgtggtcggcctgggctatacgaacccgtacctgtcgccgttcgaggaattccagcgctacaagacgcatccgtcgatccgcgcgttcctcgaaggcggcaagcgcgtgtcgtacggcgcgcgcgcgatcacggccggcggcctgctgtcgctgccgaagacggtgttcccgggcggcgcgctgatcggcgacgacgcgggcttcctgaacgcatcgcggatcaagggcagccacgcggcgatcaagaccggcatgctggcggccgacgccgcattcgacgcggtgcaggccggccgccagtcggacgagctcaatgcgtacccggatgcgttcaagcaatcgtggctgtacacggagttgtaccgcgcgcgcaacttcaagcagtggatggccaagggcctgtacctgggcacgctgatggtcgggctcgagcagaaggtgatgggcggcaacgtgccgtggacgctgcaccaccagcatgcggaccacgagatgctgaagccggcgtcgcagtgcgagccgatcgcgtatccgaagccggacggcaagctgacgttcgaccggctgtcgtcggtattcatctcgaacacgaaccacgaggagaaccagccggcgcacctgacgctgaaggacgcgagcgtgccggtgaacgtgaacctgcgcacgtacgcggggccggaggcgcgcttctgcccggcggcggtgtacgagttcgtgaagaacgacgacggcggcgatcggctcgtgatcaacgcgcaaaactgcgtgcactgcaagacctgcgacatcaaggacccgacgcagaacatcgtgtgggtcacgcccgaaggcggcggcgggccgaattatccgaacatgtaa

SEQ ID NO: 100686 - protein, 557 aa, Burkholderia cenocepacia AU 1054
MTPASLIEQYGPRESMEYDVVIVGGGPAGLSAAIRLKQLAAEKGTEIGVCVLEKGSEIGAHILSGAVMDPRAITELFPDWKERGAPLDVEVTEDRFLFLSEKSAVTTPNWALPDNFKNHGNYVISLGNVTRWLGAQAEALGVEIFPGFPAAEILYNDDGSVKGVATGNMGVGKDGEPTENFQLGMELHAKYTLFAEGCRGHLGRQLISKFKLDANADPQAYGIGIKELWEIDPAKHKPGLVIHTAGWPLKSDTYGGSFLYHMDNNQVVVGFVVGLGYTNPYLSPFEEFQRYKTHPSIRAFLEGGKRVSYGARAITAGGLLSLPKTVFPGGALIGDDAGFLNASRIKGSHAAIKTGMLAADAAFDAVQAGRQSDELNAYPDAFKQSWLYTELYRARNFKQWMAKGLYLGTLMVGLEQKVMGGNVPWTLHHQHADHEMLKPASQCEPIAYPKPDGKLTFDRLSSVFISNTNHEENQPAHLTLKDASVPVNVNLRTYAGPEARFCPAAVYEFVKNDDGGDRLVINAQNCVHCKTCDIKDPTQNIVWVTPEGGGGPNYPNM

SEQ ID NO: 100687 - DNA, 1674 bp, Burkholderia cenocepacia AU 1054
  CDS (1)..(1674): transl_table=11
ttgaccacacaggacttgctcgcgcaatacggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaagggttccgagatcggcgcgcacatcctgtcgggcgcggtgatggacccgcgcgcgatcaccgagctgtttcccgactggaaggaacgcggcgcgccgctcgacgtcgaggtgacggaagaccgcttcctgtttctgtccgagaagagcgcggtgaccacgccgaactgggcgctgccggacaacttcaagaaccacggcaattacgtgatctcgctgggcaacgtcacgcgctggcttggagcacaggccgaggcgctgggcgtcgagatcttccccggcttccccgctgccgagattctctacaacgacgacggctcggtcaaaggcgtcgccaccggcaacatgggcgtgggcaaggacggcgagccgaccgagaacttccagctcggcatggagctgcacgcgaagtacacgctgttcgccgaaggctgccgcggccatctgggccgccaactgatctcgaagttcaagctcgacgcgaacgccgatccgcaggcgtacgggatcggcatcaaggaactgtgggaaatcgacccggccaagcacaagccgggcctcgtgatccacacggcgggctggccgctgaagtccgacacgtacggcggctcgttcctgtatcacatggacaacaaccaggtggtggtcggcttcgtggtgggcctgggctacacgaacccgtacctgtcgccgttcgaggaattccagcgctacaagacgcatccgtcgatccgcgcgttcctcgaaggcggcaagcgcgtgtcgtacggcgcacgcgcgatcacggcgggcggcctgctgtcgctgccgaagacggtgttcccgggcggcgcgctgatcggcgacgacgcgggcttcctgaacgcgtcgcggatcaagggcagccacgcggcgatcaagaccggcatgctggccgccgatgccgcattcgacgcggtgcaggccggccgccagtcggacgagctcaatgcgtacccggacgcgttcaagcaatcgtggctgtacacggagctgtaccgcgcgcgcaacttcaagcagtggatggccaagggcctgtacctgggtacgctgatggtggggctcgagcagaaggtgatgggcggcaacgtgccgtggacgctgcatcaccagcacgcggaccacgagatgctgaagccggcggcgcagtgcgagccgatcgcgtatccgaagccggacggcaagctgacgttcgaccggctgtcgtcggtattcatctcgaacacgaaccacgaggagaaccagccggcgcacctgacgctgaaggacgcgagcgtgccggtgaacgtgaacctgcgcacgtacgcggggccggaggcgcgcttctgcccggcggcggtgtacgagttcgtgaagaacgacgacggcggcgagcgcctcgtgatcaacgcgcagaactgcgtgcactgcaagacctgcgacatcaaggacccgacgcagaacatcgtgtgggtcacgcccgaaggcggcggcgggccgaattacccgaacatgtaa

SEQ ID NO: 100688 - protein, 557 aa, Burkholderia cenocepacia AU 1054
MTTQDLLAQYGPRESMEYDVVIVGGGPAGLSAAIRLKQLAAEKGTEIGVCVLEKGSEIGAHILSGAVMDPRAITELFPDWKERGAPLDVEVTEDRFLFLSEKSAVTTPNWALPDNFKNHGNYVISLGNVTRWLGAQAEALGVEIFPGFPAAEILYNDDGSVKGVATGNMGVGKDGEPTENFQLGMELHAKYTLFAEGCRGHLGRQLISKFKLDANADPQAYGIGIKELWEIDPAKHKPGLVIHTAGWPLKSDTYGGSFLYHMDNNQVVVGFVVGLGYTNPYLSPFEEFQRYKTHPSIRAFLEGGKRVSYGARAITAGGLLSLPKTVFPGGALIGDDAGFLNASRIKGSHAAIKTGMLAADAAFDAVQAGRQSDELNAYPDAFKQSWLYTELYRARNFKQWMAKGLYLGTLMVGLEQKVMGGNVPWTLHHQHADHEMLKPAAQCEPIAYPKPDGKLTFDRLSSVFISNTNHEENQPAHLTLKDASVPVNVNLRTYAGPEARFCPAAVYEFVKNDDGGERLVINAQNCVHCKTCDIKDPTQNIVWVTPEGGGGPNYPNM

SEQ ID NO: 100689 - DNA, 1674 bp, Burkholderia pseudomallei 1655
  CDS (1)..(1674)
atgacccccgcaagcctcatcgagcaatacggcccgcgcgaatcgatggaatacgacgtcgtgatcgtcggcggcggccccgcaggcctgtcggcggccatccggctcaagcagctcgccgccgagaaaggtgcggaaatcggcgtgtgcgtgctcgaaaagggctcggagatcggcgcgcacatcctgtcgggcgccgtgatggacccgcgcgcgatcaccgaactgttccccgactggaaggaaaagggggcgccgctcaacgtcgacgtcaccgaggaccgcttcctgttcctgaccgagaaaagctcgttccaggtgcccagctgggcactgccggacaatttcaagaaccacggcaattacgtgatcagcctcggcaacgtcacgcgctggctcggccagcaggcggaagccctgggcgtcgagatcttcccgggcttcccggccgccgagatcctctacaacgacgacggctcggtcaagggcgtcgcgacgggcaacatgggcgtcggcaaggacggcgagccgaccgagaacttccagctcggcatggagctgcacgcgaagtacacgctcttttgcgaaggcgcgcgcggccacctcggccgccagttgatggacaagttcaagctgaacgcgaacagcgacccgcaggcgtacgggatcggcatcaaggagctgtgggagatcgatccggtcaagcacaagccgggcctcgtgatccacacggccggctggccgctgtcgtcggacacgtacggcggctcgttcctgtatcacatggacaacaatcaggtcgtcgtcggcttcgtcgtcggcctcgcgtactcgaacccgtacctgtcgccgttcgaggagttccagcgctacaagacgcatccggcgatccggccgttcctcgaaggcggcaagcgcgtgtcgtacggcgcgcgcgcgatcaccgcaggcggcctgctgtcgctgccgaagacggtgttcccgggcggcgcgctcgtcggcgacgacgcgggcttcctgaacgcgtcgcggatcaagggcagccatgcggcgatcaagaccggcatgctcgccgccgaagccgcgttcgacgcggtgcaggcgggccgccaggccgacgaactgaccgcttacccggacgcgttcaagacgtcctggctgcacaccgagctctatcgcgcgcgcaacttcaagcagtggatgggcaaggggctgtatctcggcacgctgatggtcggcgtcgagcagaagctgatgaacggcaacgtgccgtggacgctgcatcaccagcacggcgaccacgagatgctgaagcccgcgtcgcagtgccagccgatcgactatccgaagccggacggcaagctgacgttcgaccggctgtcgtcggtattcatctcgaacacgaaccatgaggagaaccagcccgcgcacctgacgctgaaggacgcgagcgtgccggtcaacgtcaatctgcgcacgtatgcggggccggaagcgcgcttctgcccggccgccgtctatgaattcgtgaagaacgacgacggcagcgaccgcctcgtgatcaacgcgcagaactgcgtgcactgcaagacctgcgacatcaaggatccgacgcagaacatcgtgtgggtcacgccggaaggcggcggcgggccgaactacccgaacatgtga

SEQ ID NO: 100690 - protein, 557 aa, Burkholderia pseudomallei 1655
MTPASLIEQYGPRESMEYDVVIVGGGPAGLSAAIRLKQLAAEKGAEIGVCVLEKGSEIGAHILSGAVMDPRAITELFPDWKEKGAPLNVDVTEDRFLFLTEKSSFQVPSWALPDNFKNHGNYVISLGNVTRWLGQQAEALGVEIFPGFPAAEILYNDDGSVKGVATGNMGVGKDGEPTENFQLGMELHAKYTLFCEGARGHLGRQLMDKFKLNANSDPQAYGIGIKELWEIDPVKHKPGLVIHTAGWPLSSDTYGGSFLYHMDNNQVVVGFVVGLAYSNPYLSPFEEFQRYKTHPAIRPFLEGGKRVSYGARAITAGGLLSLPKTVFPGGALVGDDAGFLNASRIKGSHAAIKTGMLAAEAAFDAVQAGRQADELTAYPDAFKTSWLHTELYRARNFKQWMGKGLYLGTLMVGVEQKLMNGNVPWTLHHQHGDHEMLKPASQCQPIDYPKPDGKLTFDRLSSVFISNTNHEENQPAHLTLKDASVPVNVNLRTYAGPEARFCPAAVYEFVKNDDGSDRLVINAQNCVHCKTCDIKDPTQNIVWVTPEGGGGPNYPNM

SEQ ID NO: 100691 - DNA, 1656 bp, Chromohalobacter salexigens DSM 3043
  CDS (1)..(1656): transl_table=11
gtggaacgcgaatacatggatttcgacgtcgtcatcgtcggcgccggccctgcggggctttcggccgcctgtcgcttgatgcagcaggccaacgaggcgcagcgcgaactcagtgtctgcgtggtcgagaaaggctccgaggtgggcgcgcatatcctctccggagcggtgctcgagccgcgcgccctgcgcgagctgttccccgactgggaatcgcgcggcgcccctctgaccacgccggtcgtcagcgatgacctgtatctgctcaaggacgccaagaatgcgcagaagcttcccaacgcgctgatccccaagagcatgcacaacaccggcggcgcgtacgacaactacgtgatcagtgccggcaacctgtgccgctggctggccgaacaggccgagcagctgggcgtggagatatttcccggcttcgccgcccaggagaccctgcacgacgaggacggcacggtacgcggcatcgtcgtcggcgacatgggcgtggccgccgatggcagcgagaagcccgggcacatgccgggcatggagcttcgcgccaagtacacgctgttctccgagggcgcccgcggccatctcggcaagcggctgatccagcgcttctcgctcgacgagggttgcgatccccagcattacgccctgggcctcaaggaactgtgggacgtgccggccgacaagcacgagcccggacgcgtactgcacggctccggctggccgctgcccggcgacacccacggcggctggtttctctaccatgccgagaaccagcaggtcgtggtcggcctgatcgtcgacctgtcctacgacaacccttacctgtcgcctttcgacgaattccagcgcatgaagcaccacccggtgctcaagcagtacctggaaggcggttcgcgcgtttcctatggggcacgcgccattaccaagggcggcgccaacagcctgcccaaaatgacctttcccggcggcctgttgatcggctgcgacgccggtacgctcaacttcgccaagatcaagggcattcacatggcgatgaaatccggcctggtggcggccgagagcgtgttcgaggccttcgtgggcggcgacgagggcggccaggagctgtcttccttcaccaccaagtggcgcaacagctgggcctgggcggaattgcacgaaagccgcagcttcggccccgcgattcacaagtacggcaccgtcaagggcggcgcctacaacttcctggaccagtggctgggcggcaagctgcccaccgtgcacgacaccacgcccgaccatgccagcatgcgccatgccagcgaggcgacgcccatcgagtatcccaagcccgatggcaagctgtccttcgacaaggcctcgtcggtcttcctctccaataccaaccatgaagaggaccagccctgccacctgcggctcaccgatcccgagattccggtgcgcgtcaatctcccggaatacgccgagcccgcgcagcgctattgccccgccggggtctacgaaatcgtcgaggaaaacggcgagcccaggttccagatcaacttccagaactgcgtgcactgcaagacctgcgacatcaaggacccgtcccagaacatcacctgggtcgcgccggaaggcggcggtgggcccaactaccccaacatgtag

SEQ ID NO: 100692 - protein, 551 aa, Chromohalobacter salexigens DSM 3043
MEREYMDFDVVIVGAGPAGLSAACRLMQQANEAQRELSVCVVEKGSEVGAHILSGAVLEPRALRELFPDWESRGAPLTTPVVSDDLYLLKDAKNAQKLPNALIPKSMHNTGGAYDNYVISAGNLCRWLAEQAEQLGVEIFPGFAAQETLHDEDGTVRGIVVGDMGVAADGSEKPGHMPGMELRAKYTLFSEGARGHLGKRLIQRFSLDEGCDPQHYALGLKELWDVPADKHEPGRVLHGSGWPLPGDTHGGWFLYHAENQQVVVGLIVDLSYDNPYLSPFDEFQRMKHHPVLKQYLEGGSRVSYGARAITKGGANSLPKMTFPGGLLIGCDAGTLNFAKIKGIHMAMKSGLVAAESVFEAFVGGDEGGQELSSFTTKWRNSWAWAELHESRSFGPAIHKYGTVKGGAYNFLDQWLGGKLPTVHDTTPDHASMRHASEATPIEYPKPDGKLSFDKASSVFLSNTNHEEDQPCHLRLTDPEIPVRVNLPEYAEPAQRYCPAGVYEIVEENGEPRFQINFQNCVHCKTCDIKDPSQNITWVAPEGGGGPNYPNM

SEQ ID NO: 100693 - DNA, 1776 bp, Polaromonas sp. JS666
  CDS (1)..(1776): transl_table=11
atgagcgatcagtcgggcgcctggattcgcgacttaaaattgccgcggaacagacaacgatcacccaaatcattatcagcgagtcccccgatgaatacccaagaagttctggcgcagtttggtccccgtgaagcgatggaatacgacgtcgtcgttgtcggcggcggcccgggtggactggccactgcaattcgcctgaagcagctggccgccgaaaaaggcacggatatttccgtcgtcgtgctcgaaaaaggttcagagcccggcgcgcacattctttcaggggccgtgatggatcccaaggccatcaccgaactgattcccgagtggaaggcgctgggcgcgccactgaaccagccggtcacgacggatgaagtcctgttcctcagcgaaacaggcgccacacgaacgcccgccttcctcatgcccgactgcatgcacaacgaaggcaactatgtcatcagcttgggcaatgtggtgcgctggctggcgcagcaggccgaaaccatcggcgtggaaattttcccgggcttcgcggccgccgaagtgctgtacaacgaggacggctcggtgaagggggtcgccaccggcaacctcggtattggcaaggatggcgagccgacagacaacttccagctgggcatggagttgcatggcaagtacaccgtgtttgccgaaggcgcgcgcggccacctgggccgccagctgatcagccgcttcaagctggacgaaggcaaggacccgcaggcctatgcgctgggcgtgaaggagctgtgggagattgatccggccaaacacaaacccggcctggtcattcacaccgccggctggcccatggacagcaagacctatggcggcggcttcatgtaccacctggaagacaacaaggtcacgctgggcctggtcaccggcctcgattacaccaacccctacctcagcccttttgaggaaatgcagcgctggaaaacgcatcccagcatcaggcaatacctggaaggcggcaagcgcatcagctacggtgcgcgcgccatcacggccgggggcgcattgagcctgcccaaaacggtgttccctggcggtgcgctggtcggctgtgaagccggttacctcaatgccgcgcgcatcaagggcagccacgccgcaatcaagagcggcatgctggccgcggaggccgcttatgccgcggtgacgtcgggccgccagcacgacgagctgagcgcctaccccgaagcctatgccagcagctggctggcgcaggagctgggtcagtcgcgcaacttcaaggcgtggttcaagaagggcttgtacatgggatccttcatgaccggcatcgagcagtggctgctgcccaggctgggcatcaagagcccgccctggacgattcaccgcacccagcccgattacgccatgctcaagccggccgcagagtgccagcccatcgtctaccccaaacccgacaacaagatcacctttgaccgcctgacgtcggtgttcgtgtccaacaccaaccatgaagagcaccagccggcgcacctgacactcaaggacgcgaacgttccggtcaatatcaacctggccacctatgccggccccgagagccgctattgcccggccggcgtgtatgagtttgtgaagaacgccgacaacacggaccgcctgcagatcaacgcgcaaaactgcgtgcactgcaagacctgtgacatcaaggacccgacgcagaacattgtctgggtcacccccgaaggtggcggcgggcccaactacagcggcatgtaa

SEQ ID NO: 100694 - protein, 591 aa, Polaromonas sp. JS666
MSDQSGAWIRDLKLPRNRQRSPKSLSASPPMNTQEVLAQFGPREAMEYDVVVVGGGPGGLATAIRLKQLAAEKGTDISVVVLEKGSEPGAHILSGAVMDPKAITELIPEWKALGAPLNQPVTTDEVLFLSETGATRTPAFLMPDCMHNEGNYVISLGNVVRWLAQQAETIGVEIFPGFAAAEVLYNEDGSVKGVATGNLGIGKDGEPTDNFQLGMELHGKYTVFAEGARGHLGRQLISRFKLDEGKDPQAYALGVKELWEIDPAKHKPGLVIHTAGWPMDSKTYGGGFMYHLEDNKVTLGLVTGLDYTNPYLSPFEEMQRWKTHPSIRQYLEGGKRISYGARAITAGGALSLPKTVFPGGALVGCEAGYLNAARIKGSHAAIKSGMLAAEAAYAAVTSGRQHDELSAYPEAYASSWLAQELGQSRNFKAWFKKGLYMGSFMTGIEQWLLPRLGIKSPPWTIHRTQPDYAMLKPAAECQPIVYPKPDNKITFDRLTSVFVSNTNHEEHQPAHLTLKDANVPVNINLATYAGPESRYCPAGVYEFVKNADNTDRLQINAQNCVHCKTCDIKDPTQNIVWVTPEGGGGPNYSGM

SEQ ID NO: 100695 - DNA, 1794 bp, Polaromonas sp. JS666
  CDS (1)..(1794): transl_table=11
gtgacggcgcaccgcgcaccgcaccgccgctgccagccgacagcggcccttaaccacctccttagccagcttcggccccagggtcgccaacttttttactctcttcgcatgatgccctcctccctgcttgaacaatacggcccccgcgaatccatggactacgacgtggtagtcgtcggcggcggccccggcggcctggccacggccatccgcctcaagcagctggccgccgaaaaaggccaggatgtgtccgtcgtggtgctggaaaaaggctccgcccccggcgcccacatcctctcgggcgccgtcatggacccgatcgccctgaacgaacttttccccaactggaaagcgatgggcgcgccgctgaaccagcccgtcagcggtgacgacgtgctgttcctcacagagaccggcgccaaacgcacgcccgacttcctggtgcccgactgcttccacaacgagggcaactacgtcatcagcctcggggccctgacccaatggctgggcgcgcaggccgaaacgctgggcgtggaaattttccccggcttcaccgctgccgaggtgctgtataacgacaacggttcagtcaaaggtgtcgccaccggcaaccttggcattggcaaggacggccagccgcatgagggctttcagctcggcatggaactgcacgccaagtacaccattttttccgaaggcgcgcgcggccatctcggcaagcaactcatcgccagatacaagctcgacgcgggccgcgacccgcaaagccatgccctgggcatcaaggagctgtgggagatcgacccggcccgcgcccagcctggccgggtgctgcacacggccggctggccgatggacagccaaacctatggcggcggctttctctaccacctcgaaggcaacctggtcacgctcggctttgtcaccgggctcgactacaagaatccctggctcagtccctttgaggaaatgcagcgctggaagacccacccggccatccgcgcccacatcgaaggcggcaagcgcatcagttacggcgcgcgcgccatcaccgccggcggcctgctcagcctgcccaagaccgtgttcccgggcggcgcgttgatcggctgcgatgccggctacctgaacgccgcacgcatcaagggcagccacgccgccatcaagagcggcatgctggccgccgaggccgcattcgacgccctcgccgccggtcgcagcggtgacgaactcagcgcctaccccacagcgttcgaaaacagctggctgcataccgaactcgaccagtcgcgcaacttcaagcaatggttcaaaaaaggcagcctggtcggcgccctgatgaccggcatcgagcagtggctgctgcccaggctcggcatcaagcgtccgccctggacgattcaccgcacccaggccgaccacgcctgcctgcgcccggccgccgagatgccgcagatcagctaccccaagcccgacggcaagctcaccttcgaccgcctctccagcgtcttcatcagcaacaccaaccacgaagaaaaccagcccgcgcacctgacactcaaagacgccagcgtgccggtgcggatcaacctggcgaactacgccggccccgagagccgctactgcccggccggcgtgtacgagtttgtgaagaacgacgatgactcggaccggctgcagatcaacgcccagaactgcgtgcactgcaagacctgcgacatcaaggacccgacgcaaaacatcgtctgggtcacacccgaaggcggcggcgggccgaactacgcgggcatgtag

SEQ ID NO: 100696 - protein, 597 aa, Polaromonas sp. JS666
MTAHRAPHRRCQPTAALNHLLSQLRPQGRQLFYSLRMMPSSLLEQYGPRESMDYDVVVVGGGPGGLATAIRLKQLAAEKGQDVSVVVLEKGSAPGAHILSGAVMDPIALNELFPNWKAMGAPLNQPVSGDDVLFLTETGAKRTPDFLVPDCFHNEGNYVISLGALTQWLGAQAETLGVEIFPGFTAAEVLYNDNGSVKGVATGNLGIGKDGQPHEGFQLGMELHAKYTIFSEGARGHLGKQLIARYKLDAGRDPQSHALGIKELWEIDPARAQPGRVLHTAGWPMDSQTYGGGFLYHLEGNLVTLGFVTGLDYKNPWLSPFEEMQRWKTHPAIRAHIEGGKRISYGARAITAGGLLSLPKTVFPGGALIGCDAGYLNAARIKGSHAAIKSGMLAAEAAFDALAAGRSGDELSAYPTAFENSWLHTELDQSRNFKQWFKKGSLVGALMTGIEQWLLPRLGIKRPPWTIHRTQADHACLRPAAEMPQISYPKPDGKLTFDRLSSVFISNTNHEENQPAHLTLKDASVPVRINLANYAGPESRYCPAGVYEFVKNDDDSDRLQINAQNCVHCKTCDIKDPTQNIVWVTPEGGGGPNYAGM

SEQ ID NO: 100697 - DNA, 1677 bp, Chlorobium limicola DSM 245
  CDS (1)..(1677): transl_table=11
gtgcatcagaaacgagaatcacttgcattcgatgtggtatttgcagggggcggaccggcaaatcttgccgccgccatccatctgaaaaaccttatcggagatcataataaccgtaacggctccaatcgggttgaagcagagatagcccttatcgataaaggacgtcacgctggtgcacacctcctttccggcgcagtgctcgatacaagggcgcttgaagagctgatgccggattaccgggagcggaactgcccgcttgaaacgtctgtcgccgccgaaggggttttctttttgacggagaagaaaaagttcgccttcccttttctgccggaaccgttccggaacaagggttatccttttgtctcactcagcagattcggagcctggctggccggcgaagcggaaaaagccggcgtgcagctcttcgacaatactgcggccaccgctccccttgtggaagagggtacggtttgcggagtgcttaccggcgaccttggtcttgaccggcagggcaaccaaaagccggactaccttgccggtattgaactcagggcaaaaatcaccgtattcggcgaaggagctgcgggaaacctgacggacgaattgcagagagcatttcccgttcaaaccggatcatcggcacagctctacgaaaccggagtcaaggaggtatggcgcattccggcagggcgcatggaagcaggtgatgcccggcataccttcgggtacccccttccgtcggaaacctatggaggaggctggctctatgcattcacgaacaccgacctttcggtcggattcgtcacggctatagatcggacggcgccaatgagcgacccgcatctgaatctgcagcttttcaagcagcatccttttgttgcatcgatcctcgaagggggcacgctcgtcgaatatggcgccaaagccattacctcaggagggctgaacgccatggcgcgcatcttcgggccgggatttctggtaaccggcgagtccgccggcatgctcaacatgcagcgactcaaagggatacatctcgccatgaaatccggcatgctggccgccgaaaccatttttgaagcgcttctgcgcaacgacttttcggctgcaatgctgcagggttatgaaacgcggttcagaaactcctgggcgtatgaggaactgcttgccgcccgaaacttccggcaggctttcgataacggtctctattacggtcttctgcagtcgggaatggaactgaagtttcccggagtatcgctcgcatccgggtttctccggaaaaaagagggttccggagagcttcggcaggagaaaaagagattttccggtgctccccccaaacctttccaccctgacggaaaactcaccttcggcaaggaagagtgcctctaccgttcgggtaccatgcatgaggagaaccagccttgccacctccggatcaacccctccgacatggcggagatctgccttgaacggtgcagggaggagtatggcaacccctgctcccggttctgtccggcaaaggtgtacgaattcaccgaaacgccggaaccggcgctgaaaatcaatgcatcgaactgcctgcactgcaagacctgtacgcttgccgacccttacggaatcatttcctggactccacccgagggcggcggcggaccaggctataaactcagttag

SEQ ID NO: 100698 - protein, 558 aa, Chlorobium limicola DSM 245
MHQKRESLAFDVVFAGGGPANLAAAIHLKNLIGDHNNRNGSNRVEAEIALIDKGRHAGAHLLSGAVLDTRALEELMPDYRERNCPLETSVAAEGVFFLTEKKKFAFPFLPEPFRNKGYPFVSLSRFGAWLAGEAEKAGVQLFDNTAATAPLVEEGTVCGVLTGDLGLDRQGNQKPDYLAGIELRAKITVFGEGAAGNLTDELQRAFPVQTGSSAQLYETGVKEVWRIPAGRMEAGDARHTFGYPLPSETYGGGWLYAFTNTDLSVGFVTAIDRTAPMSDPHLNLQLFKQHPFVASILEGGTLVEYGAKAITSGGLNAMARIFGPGFLVTGESAGMLNMQRLKGIHLAMKSGMLAAETIFEALLRNDFSAAMLQGYETRFRNSWAYEELLAARNFRQAFDNGLYYGLLQSGMELKFPGVSLASGFLRKKEGSGELRQEKKRFSGAPPKPFHPDGKLTFGKEECLYRSGTMHEENQPCHLRINPSDMAEICLERCREEYGNPCSRFCPAKVYEFTETPEPALKINASNCLHCKTCTLADPYGIISWTPPEGGGGPGYKLS

SEQ ID NO: 100699 - DNA, 1674 bp, Chlorobium phaeobacteroides BS1
  CDS (1)..(1674): transl_table=11
gtgcaagctgaaagagaatcactcgactttgatattgtgttcgtgggcgccggaccggcaaacctcactgcggccattgacctgcaacgcctgattaaccggcataatgcatcggcgacaacaatcctcgaacctgaaattgcgatactcgagaaaggccggtacgtgggagctcaccttctttccggcgcaattctcgatcctgccgtattcaatcagttcatgcccgatttcctccaaagaggatgcccgctcgaagccgaagtcacccgggattcggcctggtttctcttcggacagaaaaaaatccagataccctatcttcccgaaccgttccgcaacaggggcaacagacttgtctctctgagtaaactcggagcatggctggcaggagaagctgaatcgctgggcatcaacatattcgacaacaccgccgcggttgaaccggtcatcgaaaacggccgcgtaacaggggtcataacggacgacaagggaatcgacaaagcgggaaacgccaaatcaggagcggaaccaggaatgcggctcaacgcgaaaactgtcgtggtgggtgaaggttctcacggctcgattttccgcaagctcgatcgtgcgttcgctctttcggaagagagccggaagcagatctatgaaaccggtgtcaaggagttttggaaaatacctgaaggcagaatcgaggccggtgaggtccggcacacgttcggctatccgctgccttcatcgatatacggaggaggctggctctatgcgttctctgatacggaggtatccctcgggtttgtcacttcagctgaaccggagcggccggaagtggattcccactacaatctgcagctgttcaaacaacatccgttcattagctccatcatccgggacggacaactgatggagtttggcgccaagaccattacatcaggaggtttccatgctatgccgaagccttcagggcccggatttctgcttaccggagaaaccgccggtctggtaaacatgcagcgtctgaaaggccttcacctggcaatgcagtcagggattatggcagcagagacactctttgcctctctgctgacggatgacttttcagagaaagcgctccattcctatcgcgaacgccttgaaaattccgaagcatacaaagagatgcatatggcgggaaattaccggcaggcatttgaaaacggtctctatacaggactcatgcaggcaggtctttctttgaaaatacccggcctcctgccctcggaaaaagccgcagcttcagcagaaaacaaaccggataccggcaaaaagcactacttgaagtggatacagaaaaaagccgcattcaggcctgacgacgcattgaccttctcaaaaagcaccgacctctatgcctcaggaacggtacatgaagaagaccaaccctgccatctgctgataacaacagaggacataaccgatatctgcctgaaaaaatgtactgaagcgttcggtaacccctgccagcatttctgcccggcaggagtctacgaaatcaatcatgacgccgatccgtttctcagactgtcgccttcgaactgcctgcactgtaaaacctgtgaaatcatcgatccgtatggcagtattacctgggtgcctccggagggcggcggcggccccggttacagatcaagctga

SEQ ID NO: 100700 - protein, 557 aa, Chlorobium phaeobacteroides BS1
MQAERESLDFDIVFVGAGPANLTAAIDLQRLINRHNASATTILEPEIAILEKGRYVGAHLLSGAILDPAVFNQFMPDFLQRGCPLEAEVTRDSAWFLFGQKKIQIPYLPEPFRNRGNRLVSLSKLGAWLAGEAESLGINIFDNTAAVEPVIENGRVTGVITDDKGIDKAGNAKSGAEPGMRLNAKTVVVGEGSHGSIFRKLDRAFALSEESRKQIYETGVKEFWKIPEGRIEAGEVRHTFGYPLPSSIYGGGWLYAFSDTEVSLGFVTSAEPERPEVDSHYNLQLFKQHPFISSIIRDGQLMEFGAKTITSGGFHAMPKPSGPGFLLTGETAGLVNMQRLKGLHLAMQSGIMAAETLFASLLTDDFSEKALHSYRERLENSEAYKEMHMAGNYRQAFENGLYTGLMQAGLSLKIPGLLPSEKAAASAENKPDTGKKHYLKWIQKKAAFRPDDALTFSKSTDLYASGTVHEEDQPCHLLITTEDITDICLKKCTEAFGNPCQHFCPAGVYEINHDADPFLRLSPSNCLHCKTCEIIDPYGSITWVPPEGGGGPGYRSS

SEQ ID NO: 100701 - DNA, 1647 bp, Jannaschia sp. CCS1
  CDS (1)..(1647): transl_table=11
atgtccaaaatcgaacgcgagagcatggaatacgacgttgtcatcgtgggtgcgggccccgctggcctgtcggcggcgatccggctgaaacagttggacgcggagctgaatgtcgtcgtgttggagaaggggtccgaggtgggcgcgcatatcctgtcgggcgcggttctggacccggttggcctggatgcgctgatccccgactggcaggacaagggcgcgccgctgaatgtgccggtgaaggacgacaacttctacatgttgggtgaggcgggcggcatccgtatccccaacttccccatgccgccgctgatgaacaaccacggcaattacatcgtttccatgggcaacgtctgtcgctggatggcggagcaggccgaggcgctgggggtggagatcttccccggtatggcgtgttcggagctggtatatggcgataacggcgaagtgcggggcgtcgtcgcgggcgtgtttggattggaggccgacgggtccatcggggaaggcacggagcccggtatggaactgcttggcaagtacgtgttcctgtccgaaggcgtgcgcgggagcctgagccaggaggtcatcgggaagtacaatcttgccaccggatatgagccgcagaaatacggcctcggcatgaaagagatctgggagattgatcccgaaaagcaccgtgaaggcagcgtgacccacacgatgggctggcctctgggcaagaacgctggcggcggcagctttatctatcaccttgagaataatcaggtttacgtgggtttcgtcgttcacctgaactataagaacccgcatctgttcccttacatggaattccagcgtttcaagcatcacccgatggtggcggagcttctgaagggcggaaagcgcatcgcatacggtgcccgcgccatcaccgaaggcggctatcagtccatgtgcaagatggtggcccccggcgtggcgttgctgggctgttccgtgggcatggttaacgtgccgcgcatcaagggcaaccacaacgcgatgctgtccggtaaggcagcggcggaggcggcatatgctgcgatccaggacggtcgggcgtccgacgaattgtccgattatgagattgaagtgcgcgaaggggctatcggtcaggacctgaaaaaggtgcgcaatgtcaagccgatgtggtcgcagaaaggccttgtggcctcgctggcgtttggcggtctggacatgtggaccaacacgcttggcttcagcctgtttggcacgatgaagcacggcaagacggatgcagacgcgaccgagaaggccgcacgctggaacccgattgagtatccgaaacccgatggtgtgctgtcctttgatcggctgaccaacgtcgccttctccttcaccaaccatgaggaaagccaacccgcacacctgcggttgcgcgacagcaccgtgcccgttgcggtgaacctgccagattatgcgggcccgtcgcaaaggtactgcccggcgggggtttatgagttcgtgaaggatggggacgacgacaagttcgtgatcaacttccagaactgcgttcactgcaagacctgtgacatcaaggacccgtcccagaacatccactggacggtgccccagggcggtgacgggccgaattaccccaacatgtga

SEQ ID NO: 100702 - protein, 548 aa, Jannaschia sp. CCS1
MSKIERESMEYDVVIVGAGPAGLSAAIRLKQLDAELNVVVLEKGSEVGAHILSGAVLDPVGLDALIPDWQDKGAPLNVPVKDDNFYMLGEAGGIRIPNFPMPPLMNNHGNYIVSMGNVCRWMAEQAEALGVEIFPGMACSELVYGDNGEVRGVVAGVFGLEADGSIGEGTEPGMELLGKYVFLSEGVRGSLSQEVIGKYNLATGYEPQKYGLGMKEIWEIDPEKHREGSVTHTMGWPLGKNAGGGSFIYHLENNQVYVGFVVHLNYKNPHLFPYMEFQRFKHHPMVAELLKGGKRIAYGARAITEGGYQSMCKMVAPGVALLGCSVGMVNVPRIKGNHNAMLSGKAAAEAAYAAIQDGRASDELSDYEIEVREGAIGQDLKKVRNVKPMWSQKGLVASLAFGGLDMWTNTLGFSLFGTMKHGKTDADATEKAARWNPIEYPKPDGVLSFDRLTNVAFSFTNHEESQPAHLRLRDSTVPVAVNLPDYAGPSQRYCPAGVYEFVKDGDDDKFVINFQNCVHCKTCDIKDPSQNIHWTVPQGGDGPNYPNM

SEQ ID NO: 100703 - DNA, 1299 bp, Desulfitobacterium hafniense DCB-2
  CDS (1)..(1299): transl_table=11
atgagcgcagacaaatatgaagtgatcatcatcggcgcgggtctggcggggctgagtgcggcttacaagctggccaaggccggaatggaagttgtggtagtggaacggggagattatcccggaagcaagaatctgagcggaggcgtgctgtacagccggattttggatcagcttattcctgacttctgggaagaagcgcctattgaacgctatattaccaactaccttaccaccctgatgacccccacagattacgttaacatcgaatacaaagatcaggaactggccaagcccccttacaatgcggtcacggttttaagagcaaaatttgaccgctggctggcggaaaaagctgaagaagcgggagccatgatcgtaacaggagttaaagttgacaaggtgctgaaagaagggggcagaattaccggaattaccaccggcgatgaagagatgctggctgacgtggtcatcgcagccgacggcatcaactccttcattgctcaggaggccggtctgcggggagagattgagccggctcacctggcggtgggagccaaggctttgatagagcttcctcagcaagcaattgaagagcgcttcagactggaggggaatgaaggaacggcttatgccatgctgggcgacgccactcatggtgtggccggcggcggcttcttttataccaatcgggaaagcctgtccatcggcgtagtcatgcgcctggatgacttggtcaaagaaaaggtaaagccctttgaagtcctggatgatctgctccggcatcccctggttgcgcccctggtcaaggatggaaccatgacggaatacggggcccatctgacggcagaaggcggtgtgcatatggttccctcccagcttcatacggatgggatgctgattgtgggagatgccgccgggtttaccatcaacagtggtctggtcatcaggggcatggacctggccataggttcgggaatggcggcggcggaagctgtccttgaagccaaagaacgaggagattacagcgccgcagctttaagctcctatcagcgcaaattggatgaaggctttatcatgaaagatttgaaactctacgccaaagccgtggattttatggaaacagaccggctctataaaaactatgctcctctggccaaccacttgttcggcagaatttataaccacgatctcagccccaaagaacatctttggaaatcggtcctgggctctgtgcaggaaagcggaatatcctggctagacctggcccgggacggtatcaagggggtgcgggccctatga

SEQ ID NO: 100704 - protein, 432 aa, Desulfitobacterium hafniense DCB-2
MSADKYEVIIIGAGLAGLSAAYKLAKAGMEVVVVERGDYPGSKNLSGGVLYSRILDQLIPDFWEEAPIERYITNYLTTLMTPTDYVNIEYKDQELAKPPYNAVTVLRAKFDRWLAEKAEEAGAMIVTGVKVDKVLKEGGRITGITTGDEEMLADVVIAADGINSFIAQEAGLRGEIEPAHLAVGAKALIELPQQAIEERFRLEGNEGTAYAMLGDATHGVAGGGFFYTNRESLSIGVVMRLDDLVKEKVKPFEVLDDLLRHPLVAPLVKDGTMTEYGAHLTAEGGVHMVPSQLHTDGMLIVGDAAGFTINSGLVIRGMDLAIGSGMAAAEAVLEAKERGDYSAAALSSYQRKLDEGFIMKDLKLYAKAVDFMETDRLYKNYAPLANHLFGRIYNHDLSPKEHLWKSVLGSVQESGISWLDLARDGIKGVRAL

SEQ ID NO: 100705 - DNA, 1293 bp, Desulfitobacterium hafniense DCB-2
  CDS (1)..(1293): transl_table=11
atggaaaagtttgatgtaatcgtcgttggcggcggtccagccggcctatctgctgccattagtgctgcacaagccggcatgaagactgctgttattgaacggggagactatcccggtactaaaaatgtcatgggtggggtactctatactgaggctaccaatgaagtcgtacctgatttttggaaggaagctccgctggaaagaccggttattgagcagcgctatgctttcttaagcaaagacgagatactctccgccggttatcgcgatccggcctggggacaaccgccttacaatgcccacaccgtattgagagtaaaatttgaccgctggctggccgatcaagcggtcaaggccggagttatgatcatcacggagacgttggttgaggatctcctctatcacggcgatgatgtggtcggcgttcgcaccggtcgtgctgaaggagacctgggagcgcaagtggtcatcttagcggaaggggcgaataatttcctggcctgcaaggctggactggctaagcctctgcgccctgagaatatggccgtggtcgttaaagaaattattgaacttcctcctgagaaaatcgaagaccgtttctgcctggagcctcatgaaggggcaaccatcgaacttttcggtgattcgacagatggcatgatgggaacatccttcatctataccaacaaaaactctctttccattggggtgggggccatggttcactccatgtctgaaaaaggctggtcccctaatgatctcctggaaaacctaaaggccaaaccttatgtcaaacgattgctgcagggtggggaaaccaaggaatacttggctcacctgatcccggaaggcggttacaatgctatacccaagctttatcggcaaggggttatggtcgtcggtgacacagccatgttcgttaacggcttgaaccgtgaaggctccaacttagcgatgatttccggtaaaattgccggaaaagtagctgctgaggccattcaatccggagatctcagcgcccatggtatgagtgtctatgagagccgtctccgtgactcgtttgtgatcaaagacctctacaagttcagaaagctcatgcctttcatcgagtccaatccccacctgctgggccaatatccggaaatcctcaaccaggcagcccggatgtacttcacagcagatggcacacccaaggcacaagtgttcagcaatattatggatatgatgtttaagaagcggaccaagaccggacttgtcaaagatatgtttaatgcttggagggcactgaaatga

SEQ ID NO: 100706 - protein, 430 aa, Desulfitobacterium hafniense DCB-2
MEKFDVIVVGGGPAGLSAAISAAQAGMKTAVIERGDYPGTKNVMGGVLYTEATNEVVPDFWKEAPLERPVIEQRYAFLSKDEILSAGYRDPAWGQPPYNAHTVLRVKFDRWLADQAVKAGVMIITETLVEDLLYHGDDVVGVRTGRAEGDLGAQVVILAEGANNFLACKAGLAKPLRPENMAVVVKEIIELPPEKIEDRFCLEPHEGATIELFGDSTDGMMGTSFIYTNKNSLSIGVGAMVHSMSEKGWSPNDLLENLKAKPYVKRLLQGGETKEYLAHLIPEGGYNAIPKLYRQGVMVVGDTAMFVNGLNREGSNLAMISGKIAGKVAAEAIQSGDLSAHGMSVYESRLRDSFVIKDLYKFRKLMPFIESNPHLLGQYPEILNQAARMYFTADGTPKAQVFSNIMDMMFKKRTKTGLVKDMFNAWRALK

SEQ ID NO: 100707 - DNA, 1293 bp, Desulfitobacterium hafniense DCB-2
  CDS (1)..(1293): transl_table=11
atgtctgatgatcgatttgatgccattgtggtcggtggcgggatagccggtactgtgaccgcatatctgctggccaaggaaggtctggaagtcatgctggtcgagcgggggaattactccggcagcaagaatgtaaccggcggacgcatttacagccatagcctggaaaagatcatgcccaactttgcccaggaagcgccggtagaacgtaaaattacccgtgaaaaaatcagcctgatgacagaagaaagcaatgtcacccttgatttcagttccaccaaactgggagaacaaggccgtgattcctattccgtcttaagaggcgtttttgaccagtggctggccactaaagcggaagaggcgggggttcagatcatccccggtatccgtgtcgatgatttgatccttagagaaggaaaggtctgcggaatcattgccggtgaggatgaactggaagccaatgtgacgattttagccgatggggtaaactctctgctggctcagaaattaggtttccgagatgagctgcagcctaaccaggttgccgtaggggccaaagaaatcattgaattaccggcacagaccattgaagaccgcttcaactgcaaaaaaggggagggaacctcttggctgtttgccgggaccccttcggcagggaaagttggcgggggattcatttatactaacaaagaaagcatttcactaggggtggtcagtactttaagcgagttgatcaaagccaacaaaacccttccgcaaatgctggaggattttaaagcccatccctccatcgaaccgttaatcaaaggcggcaagatggtggagtattccggccacctggttcccgaagggggactgaccatggtgcccaagatcattggccatggtgtccttgttgtgggagatgcggccggattctgtattaacttaggctacgctgtgcgggggatggactttgcggtgggttctgcggaatgtgcggccaaagcagtgctgaaagccaaagaagcccaggatttcagtgagagttctcttcagtgctatcagcttttcttggatgaaagcttcgtcatgaaggatctgaaacaatacaggaattttcctcatttccttgaggaaacccccaggatttttgatggctatcccaggctggcggcagatatcatgaaagacctatttgtggtgaccgacaatccaccccaaccccttatgaaaatgatgatgaaaaatatcagggaaatcggactgctgaacattgccaaggactgctggaaaggagtgcgttccctatga

SEQ ID NO: 100708 - protein, 430 aa, Desulfitobacterium hafniense DCB-2
MSDDRFDAIVVGGGIAGTVTAYLLAKEGLEVMLVERGNYSGSKNVTGGRIYSHSLEKIMPNFAQEAPVERKITREKISLMTEESNVTLDFSSTKLGEQGRDSYSVLRGVFDQWLATKAEEAGVQIIPGIRVDDLILREGKVCGIIAGEDELEANVTILADGVNSLLAQKLGFRDELQPNQVAVGAKEIIELPAQTIEDRFNCKKGEGTSWLFAGTPSAGKVGGGFIYTNKESISLGVVSTLSELIKANKTLPQMLEDFKAHPSIEPLIKGGKMVEYSGHLVPEGGLTMVPKIIGHGVLVVGDAAGFCINLGYAVRGMDFAVGSAECAAKAVLKAKEAQDFSESSLQCYQLFLDESFVMKDLKQYRNFPHFLEETPRIFDGYPRLAADIMKDLFVVTDNPPQPLMKMMMKNIREIGLLNIAKDCWKGVRSL

SEQ ID NO: 100709 - DNA, 1293 bp, Desulfitobacterium hafniense DCB-2
  CDS (1)..(1293): transl_table=11
atgtcggaggataaattcgatgcaatagtcgtcggaggcgggatcgccggaacagtagccgcttatttgctggctaaggagggcttggaagtcatccttgtggaacggggcaattatgcagggagcaagaatatgacaggcgggcggatctatagccatagcctggggaagatcatgccggattttgcccgggaagcccctgtcgaacgccgaattaccagagaaaagatcagcttaatgaccgatgaaagcaatgtcactttggatttttattcttctaagctgggtgtgcagggcagtgattcttattccattttgagaggggtcttcgatcagtggctggctgaaaaggctgaggaggccggtgtacagattataccggggatccgggtcgatgacctaattattcgggaaggaaaagtctgcggtgtggtggcaggagaggatgagctggaagccaatatcacaattctcgccgatggtgtcaattcgctcctggctcagaaattgggatttaggggagagttggcagcccaccatgtggccgtgggagcgaaagaaatcatcgaattgccaccccaggttattgaagaccgttttaactgcaacggcaatgaaggaacggcctggctatttgccgggtatccctcggatgggcgtgtagggggcggattcctgtataccaataaatcgagcatttccctgggagtagtcacgaccttaagtgatgtgatcaaaggaagcaaaaccgtacctcagatgttggaggattttaaacagcatccggctgtccagccgcttattaaggatggcaagatgattgaatactccggtcatcttgtacctgaagccggattagccatgatccccaagattgtaggcaatggagttttggtcgtcggcgatgccgccggattctgcatcaatttaggctatatggtacgggggatggactttgcggtggcatcggccgaatgtgcggctaaagcagtacttaaagccaaagaagcgcaggatttcagcgagggataccttcattgctaccaggggttattggagcagagcttcgttatgcaggatttaaaacgatataaagatttcccccacttcctggaggaaaccccgagaattttcaatgagtatcctaaaatggcagctgatcttctggcagacatgtttgtggtcaagggagaaccggcccagcccttaagaaaaaccatcatgcagcatgtgaacaagataggattgctgaacattatcaaagacggctggaagggggtgcgttcactatga

SEQ ID NO: 100710 - protein, 430 aa, Desulfitobacterium hafniense DCB-2
MSEDKFDAIVVGGGIAGTVAAYLLAKEGLEVILVERGNYAGSKNMTGGRIYSHSLGKIMPDFAREAPVERRITREKISLMTDESNVTLDFYSSKLGVQGSDSYSILRGVFDQWLAEKAEEAGVQIIPGIRVDDLIIREGKVCGVVAGEDELEANITILADGVNSLLAQKLGFRGELAAHHVAVGAKEIIELPPQVIEDRFNCNGNEGTAWLFAGYPSDGRVGGGFLYTNKSSISLGVVTTLSDVIKGSKTVPQMLEDFKQHPAVQPLIKDGKMIEYSGHLVPEAGLAMIPKIVGNGVLVVGDAAGFCINLGYMVRGMDFAVASAECAAKAVLKAKEAQDFSEGYLHCYQGLLEQSFVMQDLKRYKDFPHFLEETPRIFNEYPKMAADLLADMFVVKGEPAQPLRKTIMQHVNKIGLLNIIKDGWKGVRSL

SEQ ID NO: 100711 - DNA, 1200 bp, Methanococcoides burtonii DSM 6242
  CDS (1)..(1200): transl_table=11
atgatatacgatgtagtggttgtcggtgcaggaccaacgggctctaccgcagcacgttatgcaacaatgggcggtgcgaaggtgcttatcatcgaagagcatttttccatcggatctcccgtagaatgtacaggattattaagtacgcgtgctgtttcggaatgtgatgtgcgccctgaagatgattttgtactgaacagtgtccgcggggctttcgttaattctcctaacggaacctgtttgcctattgatggaaagcggacaaaggcctacgtagtttccaggaagatatttgaccgccatcttgtatcacttgcagttgataccggagcagagcttatgcttaagggcagggtcacagggattcaacaaaaggacggcatacaacttctttcagtaatccacatgggaaagatgataaccgtcagatctaaagttgtcatcggtgcagatggtgtcaagagcaacgttgccagatatacagggcttgggaaagttgataggattctttcaggagtacagatcgaagccgtttatagctcaaatgacactgattttgtggaattgttcgttggctcacaggcacccggattctttgcatggacagtacccgtaaatgaaaggatatcaaggataggactggcagtagaaccaggtaatgaacacaatgcaataaactacctgaggaaaattgtgaacaagaacaaacatcttgcaggcaattgcaccaacaatatgctagaccttgttgttgggggaataccgatcggtccgctcaagagaacatattcggatggtattctcattgcaggtgatgcagccggacaggttaaaccgacatcagggggtggcgtatatacgggtgcagtttgtgcaaagatggctggacaggttgcagccgaagctgttagtgaggaaaacttttcggcaaaccgactgaaagaatatgaaagcagatggaaatcagctcttggtcgtgaacttagaacaggaatgaagatacacgattttgtaggcgggttgaccgataaagagctggatgaccttatcggctcaatgaacaataatgcgattcttgaacttatcacaaaatatggagatatggaccatccatccatactcctcaagaaactactgaaccctatgaactcacgtcatctgatcggggttttcagagcatttgcaaaagctgttctgtga

SEQ ID NO: 100712 - protein, 399 aa, Methanococcoides burtonii DSM 6242
MIYDVVVVGAGPTGSTAARYATMGGAKVLIIEEHFSIGSPVECTGLLSTRAVSECDVRPEDDFVLNSVRGAFVNSPNGTCLPIDGKRTKAYVVSRKIFDRHLVSLAVDTGAELMLKGRVTGIQQKDGIQLLSVIHMGKMITVRSKVVIGADGVKSNVARYTGLGKVDRILSGVQIEAVYSSNDTDFVELFVGSQAPGFFAWTVPVNERISRIGLAVEPGNEHNAINYLRKIVNKNKHLAGNCTNNMLDLVVGGIPIGPLKRTYSDGILIAGDAAGQVKPTSGGGVYTGAVCAKMAGQVAAEAVSEENFSANRLKEYESRWKSALGRELRTGMKIHDFVGGLTDKELDDLIGSMNNNAILELITKYGDMDHPSILLKKLLNPMNSRHLIGVFRAFAKAVL

SEQ ID NO: 100713 - DNA, 1227 bp, Methanococcoides burtonii DSM 6242
  CDS (1)..(1227): transl_table=11
atgaaagaccaatatgatctagtagttgtaggtgccggccccgcaggttcgatcgcagcgacaaccgctgctaaaaaaggactctctgtccttatgctcgagaagcggcaggagataggggaacctgtaagatgtgctgaaggtgttggtaaaaaaaggttgagacagcacattgaacttgatgagaaatggctgtgtggtgaggttagtagtgccaagattatttcacccaacggtacaaccctaacaatggctgaggaagatgccggatctgaggttggttatgtcctggatcgtaagatatttgaccgtacccttgtggaactgagtggtgaagccggtgtggatatcatggtaaaggcaagggttaccggtcttatcattgaggaaaatactgtttgtggtgttgagatgatgcatcttggcaagacctattcaatccgctctaagcttgtcatcggtgccgatggtgtagaatccaaggtgggcagatgggcaggtattgacacgtcattaaaaccatctcatattgaaacatgtgctcagttccttgttagtggggttgatattgaccaaagctcctgttatttttacatgggcaacaaagttgcacctggtgggtatgtctgggtgttcccgaaaggtaataacatggcaaatgtgggtattggtattctcggcagtcgtgccggagaaaagaagcccattgagtacctgaccgatttcgttgaggcaaactatccgaacggctctatcattgagcaagttgcgggtgcggttcctgcaagtggtcccatcgaaaagaccattgcaaatggtctgatgcttgtcggggatgctgcaaggcaatctgatccattcacaggtggtggcattagcaatgcaatggatgccgggctgtatgccggtgaggttgcagccgaggctattgctcaggatgatgtgtctgaaaagatacttcagaaatacgaaaaacgctggcgtgggtcctttggtaatgaaattgccaataatctgatcgtgaaggagacttttttcagtctttctgatgaagaccttgattcacttgcactatcgataaaggatgtcgatttcaagaagatggacctgatcgatttcatagcagcacttttcaaggctaacaagaagcttctctggaacttgcgaccgttgttcacacagaagttaaagcagaagttctctggattgacaaaattcaaaaggtaa

SEQ ID NO: 100714 - protein, 408 aa, Methanococcoides burtonii DSM 6242
MKDQYDLVVVGAGPAGSIAATTAAKKGLSVLMLEKRQEIGEPVRCAEGVGKKRLRQHIELDEKWLCGEVSSAKIISPNGTTLTMAEEDAGSEVGYVLDRKIFDRTLVELSGEAGVDIMVKARVTGLIIEENTVCGVEMMHLGKTYSIRSKLVIGADGVESKVGRWAGIDTSLKPSHIETCAQFLVSGVDIDQSSCYFYMGNKVAPGGYVWVFPKGNNMANVGIGILGSRAGEKKPIEYLTDFVEANYPNGSIIEQVAGAVPASGPIEKTIANGLMLVGDAARQSDPFTGGGISNAMDAGLYAGEVAAEAIAQDDVSEKILQKYEKRWRGSFGNEIANNLIVKETFFSLSDEDLDSLALSIKDVDFKKMDLIDFIAALFKANKKLLWNLRPLFTQKLKQKFSGLTKFKR

SEQ ID NO: 100715 - DNA, 1650 bp, Methylobacillus flagellatus KT
  CDS (1)..(1650): transl_table=11
atgcaacgcgatgtaatgaattatgacgtattgatcgtcggcgctggcccatctggactgtccgccgcgatccgcatcaagcagctggcgctggaacaggggcgtgaaatcaacgtctgcgtactggaaaaaggcgccgaggtaggcgcacatattctttcaggcgccgtgatcgacccgattgccctcaatgaactgattcccgactggaaggaaaaaggcgctccgcttcatacccccgtcactgacgaccacttcctcgtcttgagcgaggaaaaaagtttcgacatcccagccaagctgatcccacccctcatgaacaaccatggtaattacatcgtcagtttgggcgacgtttgccgctggctgggcgaacaagcggaagccctgggcgtggaaatctaccccggtttcagtgctgccgaggtcatttatgatgaagctggcgttgtccaaggggtcatcaccggtgacatgggccgcgacaaggaaggtcacgaaaaaccgggatttgcactgggcatggaactgcgcgcgcactacaccctgtttgcggaaggcgcgcgcggatcgctgaccaaggacctcaccgagcatttccagcttcgcgcattatcagagccacagaaattcggtatcggcttcaaggaaatctggcagatcgagccggaaaaatccaagcccggctcggtcatgcattcgcaaggctggccattggacaacagcacaggcggtggatcattcatctatcatctgaaggaaaacaccgtggccatcggcttcgtagtgcacctcaactacagcaacccgcacctgagcccattcgatgagttccagcgtttcaagacacaccctgccattcgcccgctgttggagggcggcaaacgccttagctacggtgcacgcgcgctgacagaaggcggcctgcaatccatcccgcgcctggctttcccaggcggcttgctgatcggctgcactgccggcttcatgaacgtgccacgcatcaagggctcccacaatgccatgaagtcgggcatgctcgcggctgaagccgtggtggaagccctggcgcaggaatcatttggcgccacgctggaaagctacccggacaaaatccgcaactcgtggatatggaaagacctgcacgcagtgcgcaacgtcaagcccgccctttcgcgcttcggcaatatccttggcagcatgtatggcggcatggaaatgtggctggcctcgttcggcatcaccacgccctggacactgtcacatggcaaagccgatcacgagtgcctcaaaccggcagcagcctgcccgaaaattacctatcccaaaccggatggcgtggttagcttcgacaaattgtcatcggtgtatctcaccaatgtcttccacgaggaagaccagccttgccacctggtattgcgcgaccagagcattccggtcgacatcaacctgccgcagtacgacgcgccagaacaacgctattgccctgcaggggtctatgaaatcgtcaccaatgagggcaacccgagattgcagatcaatgcatccaattgcattcactgcaagacctgtgacatcaaggatccattgcagaacatcaactggcgcacgccggaaggcggcggtggaccaaactacgtcagcatgtaa

SEQ ID NO: 100716 - protein, 549 aa, Methylobacillus flagellatus KT
MQRDVMNYDVLIVGAGPSGLSAAIRIKQLALEQGREINVCVLEKGAEVGAHILSGAVIDPIALNELIPDWKEKGAPLHTPVTDDHFLVLSEEKSFDIPAKLIPPLMNNHGNYIVSLGDVCRWLGEQAEALGVEIYPGFSAAEVIYDEAGVVQGVITGDMGRDKEGHEKPGFALGMELRAHYTLFAEGARGSLTKDLTEHFQLRALSEPQKFGIGFKEIWQIEPEKSKPGSVMHSQGWPLDNSTGGGSFIYHLKENTVAIGFVVHLNYSNPHLSPFDEFQRFKTHPAIRPLLEGGKRLSYGARALTEGGLQSIPRLAFPGGLLIGCTAGFMNVPRIKGSHNAMKSGMLAAEAVVEALAQESFGATLESYPDKIRNSWIWKDLHAVRNVKPALSRFGNILGSMYGGMEMWLASFGITTPWTLSHGKADHECLKPAAACPKITYPKPDGVVSFDKLSSVYLTNVFHEEDQPCHLVLRDQSIPVDINLPQYDAPEQRYCPAGVYEIVTNEGNPRLQINASNCIHCKTCDIKDPLQNINWRTPEGGGGPNYVSM

SEQ ID NO: 100717 - DNA, 1299 bp, Moorella thermoacetica ATCC 39073
  CDS (1)..(1299): transl_table=11
atggctgagcgctttgaggtagtagttgtcggggccggtccggccggcctggcggcggccctgaccctggcccgggccggggtggaagtaattgtctttgagcgtggagaacacccgggcagcaaaaacgttatgggtggcgtcctctaccgccacccgacagaaactgtggtccccgggttttaccaccaggctcccctggaacgaccggtggtggaacagcgcctgtggttgctcaccgaggaggcggccctgaccctgggctataaagatatggtttttgccggcgaacccttcaatgcctttaccgtcctgcgggcccgttttgaccgctggctggccgaccaggccgtagccgccggggcgcttttgatcaacgaaaccgtcgtcgaagacctcctgtgggaaaacgagcgcgtcgtcggggtacggacaggccgggaagggggcgatgtgcgggcggaagtggttatcctggccgagggggccaactccctgttgacccagaaggccgggctgaaacccgacggcattaacaccaaccagctggccgtggccgtgaaggagattattgccctgccccgggaaaaaatcgaggatcgttttaacctggaagagggccagggctgcaccattgaactcctgggggaagccaccaaggggatgctgggcaccgcctttatctataccaataaggactccctctccgtaggtgtgggggtcctcctggcgagcctggtgcgccgccgcctgaaccccaacgacctcctggagcacctgaaatcccaccccatggtacgtcctctcctggccgggggcgagagcaaggagtaccagggacatcttatccccgagggcggttaccaggctgttcctaaactctacggcaacggcgtcctggtagtcggggatgccgccatgctggtcaacgggattcaccgggaaggttccaatctggccctgacctccggcctgctggcagccaggactatcctggccgccagggagaagggtgactacagtgaagccaacctggccccttatcgccaggccctggaggagagctttgtcctgaaggacctgaagaaataccagcgggccccatttttcttcgaccagaacccccaattcttcaccctgtaccccggcctcctctcccgggccgccagggagtttttaaccgttgacaacgtccccaagcgtgagaagcagaagcggattttgcgggagattaccacctcccgcagccgtttccagattgcccgcgatctctataacctctggagggtgatgggctga

SEQ ID NO: 100718 - protein, 432 aa, Moorella thermoacetica ATCC 39073
MAERFEVVVVGAGPAGLAAALTLARAGVEVIVFERGEHPGSKNVMGGVLYRHPTETVVPGFYHQAPLERPVVEQRLWLLTEEAALTLGYKDMVFAGEPFNAFTVLRARFDRWLADQAVAAGALLINETVVEDLLWENERVVGVRTGREGGDVRAEVVILAEGANSLLTQKAGLKPDGINTNQLAVAVKEIIALPREKIEDRFNLEEGQGCTIELLGEATKGMLGTAFIYTNKDSLSVGVGVLLASLVRRRLNPNDLLEHLKSHPMVRPLLAGGESKEYQGHLIPEGGYQAVPKLYGNGVLVVGDAAMLVNGIHREGSNLALTSGLLAARTILAAREKGDYSEANLAPYRQALEESFVLKDLKKYQRAPFFFDQNPQFFTLYPGLLSRAAREFLTVDNVPKREKQKRILREITTSRSRFQIARDLYNLWRVMG

SEQ ID NO: 100719 - DNA, 1665 bp, Sphingopyxis alaskensis RB2256
  CDS (1)..(1665): transl_table=11
gtgattgcggtgagcgaacgggaatcgatgccctatgacgtggtcattgtcggtgcgggtccggcagggctttcggcggcgatccgcctcaaacaactggcaaacgaagcgggcggcgaattgtcggtgtgcattctcgaaaaagggtcggaggtcggcgcgcacatcctgtcgggggcggtcatcgatccccggtcgctcgacgaactattgcccgaatggcgcaccatgggttgtccgctggccgaggtgccggtcaacgacaaccagcattgggtgctcaccaagaacaggaagttcagcctgcccgagttcatctcgccccccttcatgcacaacgagggcacctatacgggcagcctcggtaatctttgccgctggcttgcggagcaagccgaagggcttggggtcgaaatcttccccggctttccggcggcggaaatcctttacaatgacgatggttcggtcaaaggcgtcgccaccggcgacatgggcgtcgcgcgcgacggcagccacaaggctgactacgcccctggcctcgaactccacgctaaatataccttctttgccgaaggcgcacgcggacatctgaccaagatgctgaaatcgcaattcgcgcttgatgccgattgcgaaccgcaagtctatggacttggcgtcaaggaactgtgggacatcgaccccgaaaatcacgcgccggggcgtgtgatccacacgcagggctggccgctcgacgaacatgccaatggcgggggcttcctctatcatcaagcgaacgggcaggttgcgctgggttttgtgacctggctcaactatcgcaatccgcacatctccccctttcaggaaatgcagaagtggaagacgcatcccgagatcgcgaagattctgaagggcggcaagcgcgtttcctatggcgcgcgcgcgatcagcgacggcggctatcagtcggtgccgaaactggctttccccggtggcgcgttgataggagacagcgccggtttcctcaacgtgccacggatcaagggcacgcacacctcgatgaagtcgggcatgatggcggccgaagcggcctttgccgctgtgagcgcggggcgcgcgggcgacacgctcgacgcctatcaggccgcctatgacgacagttgggtcaagaaagaactcagcgtcgtgcgcaacgtgctgccgctcgtcgaaaaatggggcgacctcggcggaacgatccttgcgggcatcaccatgtgggccgaaacgctcaagatcaaaatgccgttcacgatgaagcatcatcccgacaatgagacgctctatcgcgccgacatgatgccgaagcccgactatccgaaacccgacggcgtgctgacctttgaccgcctctcttcggtgttcctgtcgaacaccaaccatgaggaggaccagcccgtccacctccagctcaaggatccgtcgatcccggtcgaatataatctgccgctctatgatgagcctgcccagcgttattgccccgccggggtctatgaaattgtcgggcaggaagagggcaatccccggttcgtgatcaacgcgcagaattgtgtgcattgcaagacgtgtgacatcaaggatccgacccagaacatcaactgggtcacccccgaaggcggcggagggcccaattatccgaatatgtaa

SEQ ID NO: 100720 - protein, 554 aa, Sphingopyxis alaskensis RB2256
MIAVSERESMPYDVVIVGAGPAGLSAAIRLKQLANEAGGELSVCILEKGSEVGAHILSGAVIDPRSLDELLPEWRTMGCPLAEVPVNDNQHWVLTKNRKFSLPEFISPPFMHNEGTYTGSLGNLCRWLAEQAEGLGVEIFPGFPAAEILYNDDGSVKGVATGDMGVARDGSHKADYAPGLELHAKYTFFAEGARGHLTKMLKSQFALDADCEPQVYGLGVKELWDIDPENHAPGRVIHTQGWPLDEHANGGGFLYHQANGQVALGFVTWLNYRNPHISPFQEMQKWKTHPEIAKILKGGKRVSYGARAISDGGYQSVPKLAFPGGALIGDSAGFLNVPRIKGTHTSMKSGMMAAEAAFAAVSAGRAGDTLDAYQAAYDDSWVKKELSVVRNVLPLVEKWGDLGGTILAGITMWAETLKIKMPFTMKHHPDNETLYRADMMPKPDYPKPDGVLTFDRLSSVFLSNTNHEEDQPVHLQLKDPSIPVEYNLPLYDEPAQRYCPAGVYEIVGQEEGNPRFVINAQNCVHCKTCDIKDPTQNINWVTPEGGGGPNYPNM

SEQ ID NO: 100721 - DNA, 1650 bp, Shewanella baltica OS155
  CDS (1)..(1650): transl_table=11
atggaacgcgaatcaatggaattcgatgttgttatcgtcggcgcaggtccagcaggcttggccaccgcgtgtcgattaatgcaaatatcacaggattcaggtaaagaaattaccgtctgtgtggtcgaaaaaggctcagaagtgggcgcgcatattctgtcaggcgcagtgttcgagccaaaagtgctagacgagctgttcagcgactggcgtgagaaagacgcaccagtgaaaaccgctgtcacccacgacgaaatctacctgctcagctccgccaccgacggccgagtgatgcctaatgcctttgtgccaaaaaccatgcacaacgacggcaattttattatcagtgtcggtaatctatcgcgctggcttgctaatcgcgccgaagaactcggtgtcgaaatattccccggctttgccgccagtgaattgctatttaacgtcgataacagcgttaaaggtattttgattggcgatatgggtgtgggcgccgatggtgagcctaaagacagctttatgcccggcatggaactgcatgctaaatatactgttttctcagagggttgccgcggccacttaggcaagcaacttatcgaaaaataccatttagataatggtaaaaccccccagcattacggcttaggcttcaaagaaatttggaaagtccccgctgagcaacacgagcaaggtaaagtggtgcacacaggtggctggccattaaccgagggcgcatcgggtggcggcttcctttatcacatggaagataaccagattgcggtcggcctcattatcgatttgaactacaagaatccgcatctgagtccatttgacgaattccagcgctataaaactcatcctgtgattgcaaagtatttaaccggcggcgaacgcctcagttacggcgcccgtgcgattactaaaggcggcttgaactcgcttcctaagatgagcttccccggcggcctgatcatcggctgtaacgctgggactttgaatttcgcgaaaatcaaaggcactcacactgcgatgaagagcggtatcgttgcggcagaaaccttaggcaaagccatgatggcgggtgttgaaggcggtaaagatctcgactgttaccaaactcatatcgaagaaagctggctgcatgaagaactgcataaatcgcgcaactttggccctgcgatgcataagtttggcacctatttaggcggcgccttcaattacatagatcaaaactggtttggcggaaagttccctatcacgctgcgtgatgaacacccagactatgcgcaaatggcctccgtgagcgcttacagcaagattgattacccaaaacccgatggcaaactcagtttcgacaaactgtcctctgtgtatctgtcgagcacttatcatgaagaagatcagccctgccatttacgtcttaaagacagcagcattccactgggtattaacctgactcagtttaatgagccagcacaacgttattgccctgccggtgtgtatgaaatcgtcgaagaggcgggtcagcctaagtttgtgatcaatgcgcaaaactgcattcactgcaaaacctgcgacattaaagatcctagccaaaacatcacttgggtgacgcctgaaggcggtggtggtcctaactaccccaacatgtaa

SEQ ID NO: 100722 - protein, 549 aa, Shewanella baltica OS155
MERESMEFDVVIVGAGPAGLATACRLMQISQDSGKEITVCVVEKGSEVGAHILSGAVFEPKVLDELFSDWREKDAPVKTAVTHDEIYLLSSATDGRVMPNAFVPKTMHNDGNFIISVGNLSRWLANRAEELGVEIFPGFAASELLFNVDNSVKGILIGDMGVGADGEPKDSFMPGMELHAKYTVFSEGCRGHLGKQLIEKYHLDNGKTPQHYGLGFKEIWKVPAEQHEQGKVVHTGGWPLTEGASGGGFLYHMEDNQIAVGLIIDLNYKNPHLSPFDEFQRYKTHPVIAKYLTGGERLSYGARAITKGGLNSLPKMSFPGGLIIGCNAGTLNFAKIKGTHTAMKSGIVAAETLGKAMMAGVEGGKDLDCYQTHIEESWLHEELHKSRNFGPAMHKFGTYLGGAFNYIDQNWFGGKFPITLRDEHPDYAQMASVSAYSKIDYPKPDGKLSFDKLSSVYLSSTYHEEDQPCHLRLKDSSIPLGINLTQFNEPAQRYCPAGVYEIVEEAGQPKFVINAQNCIHCKTCDIKDPSQNITWVTPEGGGGPNYPNM

SEQ ID NO: 100723 - DNA, 1653 bp, Shewanella amazonensis SB2B
  CDS (1)..(1653): transl_table=11
atggaacgcgaattcatggagttcgatgttgttatcgtgggtgcaggccctgccggattggcgacagcctgccgcttaatgcagattagccgtgatgcagaaaaggaactgaccgtttgcgtggttgaaaaaggttctgaggtcggcgcacatattttatcgggcgccgtgtttgagcccaatgtgctggatgagctgttccctgattggcgtgaaacgggcgctccgctcaataccgccgtgacccacgatgaaatccatctgctcaagtccccccaggacggcaaactgatgcccaatgccatggtgcccaaaaccatgcacaacgaaggcaactacatcattagtgtaggcaacctggtgcgatggctcggcggtcgcgccgaagagctgggtgtggaaattttcccgggctttgccgccagtgaactcctgtttaacgacgatggcagcgttaaaggcatcctcatcggtgacatgggcataggcgctaatggtgagcccaaagacagttttatgcccggcatggagctgcacgccaaatacactgtgtttgccgagggctgtcgcggtcatctcggtaagcagttgattgaaaagttccacttggacaacggcaagaccccacagcattacggtctgggtttcaaagaactgtggaaagtacccgaaggcaagcacacgccgggactggtggtgcataccggtggctggccgttgaccgagtccaagtcatccggtggtggcttcctctaccatatggaagataaccaggtggtggttggcctcattatcgacctgaattaccagaatccgcacctgagccccttcgatgagtttcagcgttacaagacccatccggtgattgcccagtatctggaaggcggcgagcgcatctcttacggcgcccgtgccattaccaagggtggcctgaactctctgcccaagatgagtttccccggtggtttgctgattggctgtgatgcaggcactctgaactttgccaagattaaaggcacacataccgccatgaagagtggcatagtggcggctgaaaccctggccgaagccctgtttgttggggtcgaggggggtaaggatctggattgcttccaggagcgatttgagcagagctggcttggtgatgaactgcaccgctcccgtaactttggcccggccatgcacaagttcggtaccttcctgggcggcgccttcaactttatcgaccagaatatcttcggcggcaagttacccattaccctgcgtgacaacaaagcggattacgcccaaatggggctggcgagtgattaccccaaaatcgactatcccaaggccgacggtaagctgagtttcgacaaactctcgtctgtctatttgtccaacaccttccatgaggaagatcagccctgccatctgcgcctcaaggatgccaccattccgctggcggtaaacctgccaaggtttgatgagccggctcagcgttactgccctgccggtgtgtatgaagtggtcgaagaagcgggtgaaaagaagttcgttatcaacggccagaactgcatccactgcaagacctgtgatatcaaggaccccagccagaacattacctgggtaacgccagaaggcgccggtggccccaactatcccaacatgtaa

SEQ ID NO: 100724 - protein, 550 aa, Shewanella amazonensis SB2B
MEREFMEFDVVIVGAGPAGLATACRLMQISRDAEKELTVCVVEKGSEVGAHILSGAVFEPNVLDELFPDWRETGAPLNTAVTHDEIHLLKSPQDGKLMPNAMVPKTMHNEGNYIISVGNLVRWLGGRAEELGVEIFPGFAASELLFNDDGSVKGILIGDMGIGANGEPKDSFMPGMELHAKYTVFAEGCRGHLGKQLIEKFHLDNGKTPQHYGLGFKELWKVPEGKHTPGLVVHTGGWPLTESKSSGGGFLYHMEDNQVVVGLIIDLNYQNPHLSPFDEFQRYKTHPVIAQYLEGGERISYGARAITKGGLNSLPKMSFPGGLLIGCDAGTLNFAKIKGTHTAMKSGIVAAETLAEALFVGVEGGKDLDCFQERFEQSWLGDELHRSRNFGPAMHKFGTFLGGAFNFIDQNIFGGKLPITLRDNKADYAQMGLASDYPKIDYPKADGKLSFDKLSSVYLSNTFHEEDQPCHLRLKDATIPLAVNLPRFDEPAQRYCPAGVYEVVEEAGEKKFVINGQNCIHCKTCDIKDPSQNITWVTPEGAGGPNYPNM

SEQ ID NO: 100725 - DNA, 1674 bp, Pelodictyon phaeoclathratiforme BU-1
  CDS (1)..(1674): transl_table=11
atgcaacaagaacgagaatccatcgaatttgacatcgttttcgtcggcgccggtccggcaaaccttgcatcagccatccagctccagcggctgatcaggcagcacaaccgccaatcggcaaaccctctcgaagccaccatagcgctcatcgacaagggacgctacccaggcgctcacctgctctccggcgccctgcttgacccgaaagccctcgaagaatttatgccagactaccgggagcagggctgcccgattgaagccaccgtctcaaaggagagcctctggctgctgcaaagcaagagaaaattccccgtcccctttgttcccgaacggttcagcaacaaaggagccctgctcgtctcgctcagccgcctcggcgcatggatggcggaaaaagccgaagaggaggaaatccaactcttcgacaacaccgcagcttcagccccctttatcgaaaacggcaggcttgccggcatcattaccgacgacaagggactcgataaaaaaagcaatcagaagcccggctatgaacccggtctgctgctcaaaagcaaggtcaccgttatcggcgaaggctccgacggctcactcttccgccagctctctgcacactttccgaccggcagccttccgcagcgctacgaaaccggagtaaaagagacctggcaaatacccgaagggcgggtcatagcaggagaggtacaccacaccttcggcttcccttttgagtcggacgtctacggtggcggctggctctacgccttctctccaacactcgtctccgtcggatgcatctcctcggtggggcctgaatcgccgatatgcgacccccacctcaacctgcagcgcttcaaactccatccgctgatggccaacatcctcaaatttggaaccatggttgaggcgggtgcaagaaccatcagctccggcggcctcgatgccatgccaccgctcagcggccccggctttctcatcaccggcgaatcggccggaatggtgaacatgcagcgccacaaaggaatacacctcgccatgaaatccggtctccttgccgccgaaaccctcttcgaagcgctgctgcacaacgatttctccaccgaacgactcaaccattatgaggagcggttcaaaagctcatgggcatacgaagagctgcacgccgcccggaactaccggacagccttcgacaaagggctctaccccggactccttcaggcaggcctccagctcagctttcccggcctcaatctgaaaaaaaaccagacaagcctgccaggcctcgaacccattccggtccccggcatgaaaaaaagagagaacgccaattccgcaatcccggaattcagggcagacggcatccggacattcagcaaagagaggagcctctaccactccggtgtcatgcacgaagagaaccagccctgccacctccatatcaaacccgaagatatcgcagaaatctgcctcaaaaagtgccttgtagagttcggcaacccctgccagcacttctgccccgcagccgtctacgaaatcaccaccgaacccctcccggcgctcaggctcaacccctccaactgcctccactgcaaaacctgcgaagtagccgacccctacgccatcatcacctggacaacacccgaaggcggcggcggccccggctacaagctgagctaa

SEQ ID NO: 100726 - protein, 557 aa, Pelodictyon phaeoclathratiforme BU-1
MQQERESIEFDIVFVGAGPANLASAIQLQRLIRQHNRQSANPLEATIALIDKGRYPGAHLLSGALLDPKALEEFMPDYREQGCPIEATVSKESLWLLQSKRKFPVPFVPERFSNKGALLVSLSRLGAWMAEKAEEEEIQLFDNTAASAPFIENGRLAGIITDDKGLDKKSNQKPGYEPGLLLKSKVTVIGEGSDGSLFRQLSAHFPTGSLPQRYETGVKETWQIPEGRVIAGEVHHTFGFPFESDVYGGGWLYAFSPTLVSVGCISSVGPESPICDPHLNLQRFKLHPLMANILKFGTMVEAGARTISSGGLDAMPPLSGPGFLITGESAGMVNMQRHKGIHLAMKSGLLAAETLFEALLHNDFSTERLNHYEERFKSSWAYEELHAARNYRTAFDKGLYPGLLQAGLQLSFPGLNLKKNQTSLPGLEPIPVPGMKKRENANSAIPEFRADGIRTFSKERSLYHSGVMHEENQPCHLHIKPEDIAEICLKKCLVEFGNPCQHFCPAAVYEITTEPLPALRLNPSNCLHCKTCEVADPYAIITWTTPEGGGGPGYKLS

SEQ ID NO: 100727 - DNA, 1671 bp, Prosthecochloris aestuarii DSM 271
  CDS (1)..(1671): transl_table=11
gtgaacctggatagagaatcactcgatttcgacatcgtcctcataggtgcaggcccggccaatctcgctcttgccctgcatctgcagcgtctcatcgagagccataacagcaatgagaaaacaacgctcgaacccgcaatagccattctcgaaaaaggaggctattgcggagcccacctgctgtcgggagccatcctcgatccggcaatactggaaacgttcatgccggacttccgtcaacgaggatgcccgattgaagccgtgatagagaaggaatccgtctggtttctcaccccaaggaaaaaattcacgatcccctacctgcccgaaccgttcaaaaacaaaggaaatctgctgatctctctgtcgcgcttcggcgggtggctccgtgacgaggcagaagcagccgggataaccgtgcttgacaacacggctgcggcaaagccggttatcgaacacggccggctgacagcgatcatcaccgacgacaaggccgtcaaccgcgaaggcagaccaaagcccggcttcgaaccgggaatacgacttaacgccagagcgtttgtgatcggagaaggcgcaaggggctccatcttcaaatcactcgacagcacattcgggcttcaacctgcagaaaccgtgcagacctatgaaaccggggtaaaagaggtctggcggattcctgcaggacgcatcaatccaggaaccatacaccacacattcggctatccgctccagccctccgtctacggaggaggatggatctacgcactttctgatacggaactctcgctgggcttcgtctccgccgcagaacccgacaacccgaacgtcgatcctcacctcaacctgcagcgattcaaagaacatccactgctacggtccctcatcgaagggggaacaatgctcgaatacggagccaaagccattacttcaggaggctaccatgccatgccggaactttcaggtcccggtttcctgctgaccggtgaaagcgccgggatgctcaatatgcagcgacttaaaggcattcacctggccattgagtcaggggtcatggcagctgaaactctcttccagtcgctcgtcgacaacgatttttcaaaccgggccctctcgaagtatcgtgaccgttttgaaggttcctcagcccggaaagaactcttcaaggcgcgtcactaccgcaacgccttcaatcaaggtctctacagcggacttatgaacgccggcatccagttaaaactaccggggctgaaccttgccgccgccacaacggcaaacgaaaaacatcttgttccgggcagaaaagagtacagtgcatttctgaacagcaaagcatccttcaaacctgaccagtcgatcaccttttcaaaaagctcagatctgttcagctcaggcactcgccatgaagaagatcagccctgccatctgatcatagcgaaagaaaagatcgatgaaatctgcagcaaacgctgcgccacggagttcggcaacccctgccagcatttctgccctgcaggggtctacgaaatcgatctccatgccatcccgattctcaagctcaacccctccaactgccttcactgcaaaacctgcgacattgccgacccgtatggaatcataacctggaccccacccgaaggcggcggaggtcccgcctatacactcagctga

SEQ ID NO: 100728 - protein, 556 aa, Prosthecochloris aestuarii DSM 271
MNLDRESLDFDIVLIGAGPANLALALHLQRLIESHNSNEKTTLEPAIAILEKGGYCGAHLLSGAILDPAILETFMPDFRQRGCPIEAVIEKESVWFLTPRKKFTIPYLPEPFKNKGNLLISLSRFGGWLRDEAEAAGITVLDNTAAAKPVIEHGRLTAIITDDKAVNREGRPKPGFEPGIRLNARAFVIGEGARGSIFKSLDSTFGLQPAETVQTYETGVKEVWRIPAGRINPGTIHHTFGYPLQPSVYGGGWIYALSDTELSLGFVSAAEPDNPNVDPHLNLQRFKEHPLLRSLIEGGTMLEYGAKAITSGGYHAMPELSGPGFLLTGESAGMLNMQRLKGIHLAIESGVMAAETLFQSLVDNDFSNRALSKYRDRFEGSSARKELFKARHYRNAFNQGLYSGLMNAGIQLKLPGLNLAAATTANEKHLVPGRKEYSAFLNSKASFKPDQSITFSKSSDLFSSGTRHEEDQPCHLIIAKEKIDEICSKRCATEFGNPCQHFCPAGVYEIDLHAIPILKLNPSNCLHCKTCDIADPYGIITWTPPEGGGGPAYTLS

SEQ ID NO: 100729 - DNA, 1686 bp, Ralstonia metallidurans CH34
  CDS (1)..(1686): transl_table=11
atggatcagcaacagctcgtcgagcagttcggcccgcgagaagccatggagtacgacgtcgtcatcgttggcggcggacctgcaggcctcgccacggctattcgcctgaagcaactggcgcaagaaaaaggcggcgacgtcaatgtctgtgtgctggagaagggctcggagcccggcgctcacatcctgtccggcgcgatcatggatccgcgcgcgctcactgaactgatcccgaactggaaggaactcggcgcgccgctgaaccagccggtaacagaagacaagttcctgttcctgaacgaatccggctccaagggcaccccgccggcgctgctgccggagtgcttccacaaccacggcaactacatcgtcagcctgtcgaacttcgtgcgctggatgggccagcaggccgaggccctgggcgtggaaattttcccgggcttcccggccgccgaagtcctgtacaacgaggacggctcggtcaagggcgttgccacgggcaacatgggtatcagcaaggaaggcgagcccaccgagaacttccagctcggcatggagctccacgccaagtacacgatcttcgccgagggcgcgcgtggccacctgggcaagcagatcatcgccaagtacaagctcgacgccggcaaggacccgcaaagctacggcattggcctgaaggaactgtgggaaatcgatccggccaagcataagcccggtctggtggtgcacacggctggctggccgctcgacccggcaacctacggcggctcgttcctctatcacatggaggacaacaaggtcgcagtgggcttcgtggttggcctggactacacgaacccgtggctgtcgccgttcgaggaattccagcgcttcaagacgcacccggaaatccgcgcttactttgaaggcggcaagcgaatcggctatggcgcccgcgcgatcaccgccggcggcctgctgtcgctgccgaagaccgtgttcccgggtggcgcgctggtgggttgcgacgccggctacctgaacgcctcgcgtatcaagggaagccacgctgcgatcaagactggcatgctggccgccgaggccgcctacgacgcgctgcagggcggccgtcagcacgacgaactgaccgcctaccccgccgcgttcgaatcgagctggctccacaaggaactgctgcaagcgaagaacttcaagcagtggttcaagaagggccgcactaccgccacgctgatgaccggtatcgagcaatggctgctgccgaagctgggcatccgcaacccgccctggaccctccaccgcgaaaagccggatcacgtgtacctgaagccggccgccgaatgcgagaagatcgtctatccgaagccggacggcaagctcacgttcgatcgtctctcgtcagtgttcatcagcaacacgaaccacgaagaaaaccagcccgcgcacctgacgctcaaggacgcgaacgtgccggtgaacatcaactgggaaaagtacgccggccccgagtcgcgctactgcccggctggcgtgtacgagttcgtgcagaacgatgacggcaaggagcgcctgcagatcaacgcgcagaactgcgtgcactgcaagacgtgcgacatcaaggacccgacgcagaacatcgtgtgggtcacgccggaaggcggcggcggcccgaactacgtgggcatgtaa

SEQ ID NO: 100730 - protein, 561 aa, Ralstonia metallidurans CH34
MDQQQLVEQFGPREAMEYDVVIVGGGPAGLATAIRLKQLAQEKGGDVNVCVLEKGSEPGAHILSGAIMDPRALTELIPNWKELGAPLNQPVTEDKFLFLNESGSKGTPPALLPECFHNHGNYIVSLSNFVRWMGQQAEALGVEIFPGFPAAEVLYNEDGSVKGVATGNMGISKEGEPTENFQLGMELHAKYTIFAEGARGHLGKQIIAKYKLDAGKDPQSYGIGLKELWEIDPAKHKPGLVVHTAGWPLDPATYGGSFLYHMEDNKVAVGFVVGLDYTNPWLSPFEEFQRFKTHPEIRAYFEGGKRIGYGARAITAGGLLSLPKTVFPGGALVGCDAGYLNASRIKGSHAAIKTGMLAAEAAYDALQGGRQHDELTAYPAAFESSWLHKELLQAKNFKQWFKKGRTTATLMTGIEQWLLPKLGIRNPPWTLHREKPDHVYLKPAAECEKIVYPKPDGKLTFDRLSSVFISNTNHEENQPAHLTLKDANVPVNINWEKYAGPESRYCPAGVYEFVQNDDGKERLQINAQNCVHCKTCDIKDPTQNIVWVTPEGGGGPNYVGM

SEQ ID NO: 100731 - DNA, 1629 bp, Magnetococcus sp. MC-1
  CDS (1)..(1629): transl_table=11
atgacccgcgaaaccctacactatgacgttgccattgtgggtgctggacctgccggtttggcaaccgccatcgcgatattgcaacgggcttcccagccgatctcactctgtattttagaaaaggccgcccgtgtgggtgggcatcagctctctggggctttggttgagcccgatgccctggatctgctgttcggcacctatgccgccccacccacaccgcccccgctgttggccaccgtccagcatgccaccacccagttcttgaccaaaacccaggccattcccctgccccatcccaaaaaatggcaggatcatggtgcccagctctacccgttggggggattatgtcgttggttggctgaccatgcggaatccttgggcgcggagatttttcccggttttaccgccgtggaactgctgcgggacgggcagcacatcagcggtgttgtgactggcgctatgggccttgaccgccacggcgggaaaaagcccacctatcagccaggggtagcgattcacgccaaggtcacggtattggccgagggtgctcggggttttctcacccaacccctgcttaccgagctggggctcaaccatggctgcccccccccaacctacggcttgggtatgaaggagctgtggtctgtgcccaagagtgtgccgggcaccatccgtcataccctgggctggcccctagagcgtgtccatggcggagggtttatttaccatctacccaaccagcgtatcgcgctggggctggtggttggtttggattatcaagatcccacctttgacccctatggggcgctacagcgttggaaacagcatgccaccctagcccccctgctggaggggggcacgctgcttggttatggcgcacgcgctgtgagccaagggggttggctggcactgcccaagctctatttccatggtgggctactggtgggtgatggtgccggttttcttaatcccgcccgcttaaagggggtaaaaggggcgctgcattccggggtcttggcggccaccgccattgtgcaggcactggctgagggggatgggggagccaccgcattacgccggtatcaacaggcatgggaggcttcggaccttgcccaaacccttaaagaagaacgcaatgtgcgggcaggttttcgcatgggtggcaagttggggggcatggcggtggccgcctggaccgggctacgtcagcggggtgaaaacggtttctcattacgctggcagcaagaggaccgggcacgtctgcgtccctggccgagtgggttggattgggcgcaaccaatgcgttatgatacaacccccaccggtcattcggttgagtacgccttagccaccagtggtctaagttatgaggaggatcaacccatccacttacagcttagagatgccaccctacccgcccgccagggggcacgttttggttttcctgagctgcgttattgtccggggcgggtgtttgaagtcaaacgggatgcaagcggggccattatctacctccgccatgggggcaactgtctacagtgcaaaagttgtgatattaaagatccctttaacaacatccattggacccccccagagggtggcaatggtcccgattatcgggatatgtag

SEQ ID NO: 100732 - protein, 542 aa, Magnetococcus sp. MC-1
MTRETLHYDVAIVGAGPAGLATAIAILQRASQPISLCILEKAARVGGHQLSGALVEPDALDLLFGTYAAPPTPPPLLATVQHATTQFLTKTQAIPLPHPKKWQDHGAQLYPLGGLCRWLADHAESLGAEIFPGFTAVELLRDGQHISGVVTGAMGLDRHGGKKPTYQPGVAIHAKVTVLAEGARGFLTQPLLTELGLNHGCPPPTYGLGMKELWSVPKSVPGTIRHTLGWPLERVHGGGFIYHLPNQRIALGLVVGLDYQDPTFDPYGALQRWKQHATLAPLLEGGTLLGYGARAVSQGGWLALPKLYFHGGLLVGDGAGFLNPARLKGVKGALHSGVLAATAIVQALAEGDGGATALRRYQQAWEASDLAQTLKEERNVRAGFRMGGKLGGMAVAAWTGLRQRGENGFSLRWQQEDRARLRPWPSGLDWAQPMRYDTTPTGHSVEYALATSGLSYEEDQPIHLQLRDATLPARQGARFGFPELRYCPGRVFEVKRDASGAIIYLRHGGNCLQCKSCDIKDPFNNIHWTPPEGGNGPDYRDM

SEQ ID NO: 100733 - DNA, 1194 bp, Ferroplasma acidarmanus Fer1
  CDS (1)..(1194): transl_table=11
atgcttgaatatgatattgttatagttggcgcaggtccagccggatcagcagccgctctgaaagcggcatcggaaggaaaaaaggttcttgttattgaaagggggcctgaacccggttcaaagaacgtttcaggtgcagaggtcagaaaggattacataacatctgttttcggggaaggcatgccatatgaaagaactgttgataccatgaagctttcactgtacgaaaaagataagcctgtaaatattgatttccatcctgaagggcttgtcacaacaggaagattaaaactcgataaatggctttcatctgtatccgaacaggcaggtgctactattattccaaaaaccaccgcacttaagctgaactgggagaacgggattgcaaaatcacttacaacagacaggggagatgttgctgcaaaatctttcgttcttgcagagggtgtaaatgcccttgtatccatgaactcaggaataaatgtggactggacaccttcaaactctgtacaggccgttaaaatggtatactctattaaaaaaggagacctgaacaatatattcggttttccagatgacgatacaggcatgtcctggagaatgattatgtcagatccacttgttgctggattcatgtacacctacaaagatagcctggcagttggaattggttctccaataaaggaacttgttgacaggaagatcaggccagaggctctgctggataaattccttgaaacaacgggcatagcggaaaaggtgaagggatactcattgagggaatactcagccaaggttatacctgaaggagggttcccggaaacaaatgtggcaaagggcaatgtatacctgtgtggggatgcaatcggccttgtagacccgctcacatttgatgggataacccctgctatagcatccggaacacttgcaggtgaagcagctgttatgaactacgataaggaagtttacaggtataacctgatgaaacacccggaaatttcaaaaatagctaaagaaagaaaattggaatctgacttcatgaccagcaacaaagcaggagaatacataaacatggtttcttcccttcttgaaggctgggctgctggagatttgattggaattagaaataccatggtaggtaattatagaaatattatacctgacctgatgagttttgttatgaggatgagataa

SEQ ID NO: 100734 - protein, 397 aa, Ferroplasma acidarmanus Fer1
MLEYDIVIVGAGPAGSAAALKAASEGKKVLVIERGPEPGSKNVSGAEVRKDYITSVFGEGMPYERTVDTMKLSLYEKDKPVNIDFHPEGLVTTGRLKLDKWLSSVSEQAGATIIPKTTALKLNWENGIAKSLTTDRGDVAAKSFVLAEGVNALVSMNSGINVDWTPSNSVQAVKMVYSIKKGDLNNIFGFPDDDTGMSWRMIMSDPLVAGFMYTYKDSLAVGIGSPIKELVDRKIRPEALLDKFLETTGIAEKVKGYSLREYSAKVIPEGGFPETNVAKGNVYLCGDAIGLVDPLTFDGITPAIASGTLAGEAAVMNYDKEVYRYNLMKHPEISKIAKERKLESDFMTSNKAGEYINMVSSLLEGWAAGDLIGIRNTMVGNYRNIIPDLMSFVMRMR

SEQ ID NO: 100735 - DNA, 1266 bp, Ferroplasma acidarmanus Fer1
  CDS (1)..(1266): transl_table=11
atggattatgatgttgacgttgcagtggtgggaggcgggctcgccggcatttctgcggcgataagtgctgcaaaaaatggtctctcggttatagttctcgaacgtggggaacactccgggtcaaaaaatgtatcgggtggcaggatgtatatccattccttaaagacactcctgggcgacagatacagggatgccccgctggaactgccgattaagaaggaaacctttgaaatttatacagggaataataaggcaagcttctcatttgaaaataaagatactgaaaatagttactctatactcaggtcaaggtttgatgcatggtttgcttctgaagctgaaaatcttggagttcctgtatcttactccacacttgtgtcaggaattgatagggaagatggtggccttgtcgttaaaagtgacaggggagatataaggacaccacttgtaatagaaagtgatggtgctgcaggttttgcttccagataccttggaataaggaaggaaaaggcatttaaaatgcagccggtgaaaaatctacaggaaaatcctgatttcatgccaaagcaattcatggtcggagtaaaggaaatagtggacaaaaaacctgatgcagattatggtgaagcaaaaactatactcgggctttccaatggtgtaaagggtggcggatttgcatacacaaataaggattctacctcaatagggctgacattaaagctggattccctggaggggcacagtgaaaaggccttcaatataatagaggatttcagggaaaagctcggcattgaggggaagttgcttgaatattctgcccatttaataccattttacaggttcgaaaccctcccggcgagatatgcggataaccttatggttacaggcgacgcagcaggatttttaataaacgatggatttacaataaggggcatggacaatgcaatagaatccgggcgccttgcgggggaagctgctaaaaaaataacagattccggtgatttcaaggacacatatatttatgaacagatgctggagaaaagctttatattgaaagatatgcaggctgcttcaagagtatctacattatttggcaatgaaaggacattcgatgcatatccgaagatgatggcagggattcttgaaaggatgttcacagttacagacaatccccgggaaaatataaaaagtgttttgatggatgaaataaaaaagaacaatatcgggtattatacattgctgcaggatatgttaaaggtgatataa

SEQ ID NO: 100736 - protein, 421 aa, Ferroplasma acidarmanus Fer1
MDYDVDVAVVGGGLAGISAAISAAKNGLSVIVLERGEHSGSKNVSGGRMYIHSLKTLLGDRYRDAPLELPIKKETFEIYTGNNKASFSFENKDTENSYSILRSRFDAWFASEAENLGVPVSYSTLVSGIDREDGGLVVKSDRGDIRTPLVIESDGAAGFASRYLGIRKEKAFKMQPVKNLQENPDFMPKQFMVGVKEIVDKKPDADYGEAKTILGLSNGVKGGGFAYTNKDSTSIGLTLKLDSLEGHSEKAFNIIEDFREKLGIEGKLLEYSAHLIPFYRFETLPARYADNLMVTGDAAGFLINDGFTIRGMDNAIESGRLAGEAAKKITDSGDFKDTYIYEQMLEKSFILKDMQAASRVSTLFGNERTFDAYPKMMAGILERMFTVTDNPRENIKSVLMDEIKKNNIGYYTLLQDMLKVI

SEQ ID NO: 100737 - DNA, 1707 bp, Mesorhizobium sp. BNC1
  CDS (1)..(1707): transl_table=11
atgagcgaacgggaaagtatggagttcgatgttgtgatcgtcggcgcggggccggcgggccttgcagcatcgatcaggctgaagcagctcaatccggagctttccatcgtagtgctcgagaaaggcggggaggtcggcgcgcatattctctccggcgcagtcgtcgatcccatcggcatcgaccggcttctgccaggctggcgggaagaggaggggcacccgttcagtacgcccgtgaccgaggatcattttctggtgctggggccggcgggcgctctgaggctgcccaatattttgatgccgccgcttatgaacaaccacggcaactacatcgtctcgctcggcaatgtctgcaagtggctggccgaaaaggctgaggcgctgggcgtggagatctatcccggcttcgccgccgccgatctcctttataacgatgcgaatgcggtgatcggcgtcgtcaccggcgatatgggcgtggagcgcgacggcacgcacggccctgcctatcagccgggcatggctcttctgggcaaatatgtgctgatcggggagggcgcgcgcggctcgctcgccaagcaattgatcgcccgctaccagcttgccgacgggcgcgagccgcagaaattcggcatcggcctgaaggagctctgggaggtgaagccggagaaccataagccgggccttgtgcagcactcctttggctggcctctcgaccggcagacgggtggcggctcgttcctttatcatttcggcgaaaacctagtggccgtcggcttcgtcgttcatctgaattacaagaacccctatctggcgcctttcgaggagttccagcgttttaagacgcacccagcgatccggcgcacattcgagggcggcaagcgcctctcctatggcgcgcgggctatcacggagggcggctggcagtccgttccgcgcaccagtttccccggcgggctcctcatcggctgctctgccggcctcgtgaacgtgccgcgcatcaagggctcgcacaacgcggttctgtcgggaatgctggccgccgagcatgtggccgaggctataggagccggccgcgctaacgacgagctttcctcctatgaggaggcttggcgcggctctgagatcggcaaggacctgaagcgggtgcgcaatgtgaagccgctctggtcgcgcttcggaacgatcctcggcattggccttggcggcatggacatgtggcttaatacgctattgggcttctcacccttcggcacgctgcgccatgggaagcctgatcatgcaacgctggagccggcggaaaagcatgcgccgatcgattatccaaagcccgatggcgtgcttacattcgaccgcctttcctcggtgttcctgtccaacacgaaccacgaggaagaccagccggtgcatctgcaggtgaaggatatggaactgcagcaggcatccgaatacggcgtctatgccggcccatcgacgcggtattgcccggccggcgtctatgaatgggtggatgcggagggcaattcgctcgccggtggcccgggtgcggcggagaagggaggggctgcggccaggagcgcggacgcccgcttcgttatcaacgcgcaaaactgcgtgcactgcaagacctgcgatatcaaggacccgaaccagaacatcaactgggtgcctccgcagggcggcgaaggaccggtttaccagaacatgtaa

SEQ ID NO: 100738 - protein, 568 aa, Mesorhizobium sp. BNC1
MSERESMEFDVVIVGAGPAGLAASIRLKQLNPELSIVVLEKGGEVGAHILSGAVVDPIGIDRLLPGWREEEGHPFSTPVTEDHFLVLGPAGALRLPNILMPPLMNNHGNYIVSLGNVCKWLAEKAEALGVEIYPGFAAADLLYNDANAVIGVVTGDMGVERDGTHGPAYQPGMALLGKYVLIGEGARGSLAKQLIARYQLADGREPQKFGIGLKELWEVKPENHKPGLVQHSFGWPLDRQTGGGSFLYHFGENLVAVGFVVHLNYKNPYLAPFEEFQRFKTHPAIRRTFEGGKRLSYGARAITEGGWQSVPRTSFPGGLLIGCSAGLVNVPRIKGSHNAVLSGMLAAEHVAEAIGAGRANDELSSYEEAWRGSEIGKDLKRVRNVKPLWSRFGTILGIGLGGMDMWLNTLLGFSPFGTLRHGKPDHATLEPAEKHAPIDYPKPDGVLTFDRLSSVFLSNTNHEEDQPVHLQVKDMELQQASEYGVYAGPSTRYCPAGVYEWVDAEGNSLAGGPGAAEKGGAAARSADARFVINAQNCVHCKTCDIKDPNQNINWVPPQGGEGPVYQNM

SEQ ID NO: 100739 - DNA, 1650 bp, Silicibacter sp. TM1040
  CDS (1)..(1650): transl_table=11
atggccgagattgaacgcgaagcaatggaatacgacgttgtgatcgtcggggccggtcccgccggtctttcggccgcgatccgcctgaagcaactggatgccgaccttcaggttgtggttctggagaagggctccgaagtgggagcgcatatcctgtcgggcgcggtgcttgacccctgcggccttgatgccctgatgcctgactggaaagacaagggcgcgccgctcaacgtgccggtcaaggacgacaatttctacatgcttggcgaagcgggcgaaatccgtattccaaacgcaccaatgccgccactcatgaacaaccacggcaactacatcgtctccatgggcaatgtctgccgctggatggcggaacaggccgaggaactgggcgttgagatcttccccggcatggcctgctccgagctggtctatggcgacaacggcgaggtcaagggcgtcgtcgcgggcgtctttggtcttgaggaagacggctcttacgggcccaacacagagccgggcatggaattgcacggcaaatacgtcttcctctccgagggcgtgcgcggctcgctgtcgaaagaagtcatcgccaaatacggtctctctgacggcaaggagccgcagaaatacggcgtcggtatgaaagaaatctgggagattgatcccgccaagcacaaggaaggctctgtcacccacacaatgggctggccgctgaattccaacgcaggcggtggctctttcatctatcaccttgataacaatcaggtttatgtgggatttgtggttcacctgaactacaagaacccgcatctctatccgtacatggagttccagcgcttcaagcatcacccgatggtggcggagcttttgaaaggcggcaaacgcgtcgcttatggcgcacgcgcaatcaccgagggcggctatcagtcgatgccgaaactgaccttcccggggggcgcgcttctgggctgttccgcgggcatggtcaacgtgccgcgcatcaagggcaaccataacgcgatgctctcgggcaaagcggccgccgaagctgcctttgaggcgatcaaggcaggccgtcagtccgatgagctgaccggctacgaggcagacgtgcgcgacggccccatcggcaaggatttgaagatggtccgcaacgtcaaaccgatgtggtccaaatggggtctcacagcgtcgctcgcgctgggtggtctggacatgtggaccaacaacctctttggactgtcgctgtttggcacgctggggcatggcaagaatgacgcggaggcaaccgagcccgcggagaaccacaaacccatcgactatcccaagcccgatggcgtgctgtcttttgatcgcctgaccaacgtgtcctttgcggcgaccaaccacgaagaaagccagccctgccatctgcgtctggggaacaaggacacgccgatttcggtcaatctgccgaaatatgacgaacctgcgcagcgctactgcccggcaggtgtttatgaggtcgtggaaaaagacggtaagccagagtttgtcgtgaacttccagaactgtgtccattgcaagacctgcgacatcaaggacccaagccagaatatcacttggaccacgccgcagggcggtgacggaccgaattatcccaacatgtaa

SEQ ID NO: 100740 - protein, 549 aa, Silicibacter sp. TM1040
MAEIEREAMEYDVVIVGAGPAGLSAAIRLKQLDADLQVVVLEKGSEVGAHILSGAVLDPCGLDALMPDWKDKGAPLNVPVKDDNFYMLGEAGEIRIPNAPMPPLMNNHGNYIVSMGNVCRWMAEQAEELGVEIFPGMACSELVYGDNGEVKGVVAGVFGLEEDGSYGPNTEPGMELHGKYVFLSEGVRGSLSKEVIAKYGLSDGKEPQKYGVGMKEIWEIDPAKHKEGSVTHTMGWPLNSNAGGGSFIYHLDNNQVYVGFVVHLNYKNPHLYPYMEFQRFKHHPMVAELLKGGKRVAYGARAITEGGYQSMPKLTFPGGALLGCSAGMVNVPRIKGNHNAMLSGKAAAEAAFEAIKAGRQSDELTGYEADVRDGPIGKDLKMVRNVKPMWSKWGLTASLALGGLDMWTNNLFGLSLFGTLGHGKNDAEATEPAENHKPIDYPKPDGVLSFDRLTNVSFAATNHEESQPCHLRLGNKDTPISVNLPKYDEPAQRYCPAGVYEVVEKDGKPEFVVNFQNCVHCKTCDIKDPSQNITWTTPQGGDGPNYPNM

SEQ ID NO: 100741 - DNA, 1743 bp, Nitrobacter hamburgensis X14
  CDS (1)..(1743): transl_table=11
ttgttctcgggcaaaaaatcggaaacaacaagctttggaaaacatgacagacgcaaaggtcgccggttgccgaagcagatcatgagcagcgacgaattgccgccccgtgaatccatggatttcgacgtcgttatcgtcggcgcgggaccgtcgggcctgtcggcggcgatccggctcaagcagctcgatgccgatctcggcatcgttgtcgtcgaaaaggggtcggaagtcggcgcgcatattctgtccggcgcggtgatcgatccggccgggctcgacgccctggtgccggactggcgcgacgacgccgactgcccgctcaagaccaaagtcaaggacgaccggttctactggatgacgccgcgccgcgcgatccggttgcccaacgccctcatgccgccgctgatgaacaatcatcgctgctacatcggctcgctcggcaatgtctgccgctggcttgcgcagaaggcggaagcgctcggcgtcgaaatctatcccggcttcgccgccgccgaagtgctttacgacgacagcggcgcggtccgcggcatcgcgaccggtgacatgggcatcgcgcgcgacggctcgcacaagaactcctacgtgcgcggcatggaactgcgcggcaagtacacgctgttcgccgaaggcgcccgcggcagcctgtccaggcagttgatcgcaaggttcggactcgacaagaccagcgaaccgccgaaattcggcatcggcctcaaggaagtctggcaggtcgatccggccaaacacctgaacgggctgatccagcactccttcggctggccgctgaacaattccacgggaggcggctcgtttctctatcattatgacgacgatcgcgtcgcggtcggcttcgtcgtgcacctgaattatgacgatccgtacctgtcgccgttcgaggaattccagcgcttcaagacccatcccgcgatccgcggcgtgttcgagggcggcaagcggctggcctacggcgcgcgcgccatcaccgagggcggctatcagtcggtgccgcgcctgacgtttccgggcggcgcgctgatcggctgcgcggccgggttcgtcaacgttccgcgcatcaagggcgttcacaacgccatgggcagcgctatgctggccgccgagcacgtcgcggcggcgctcgacgccgggcgcgccaacgacgagatcgccgggtacgagaatgcctggcgcgattccacggtcggcaaggatctgttcaaggtccgcaacgtcaagccgctgtggtcgaagttcggcaccattgccggcgtggcgctgggcggcctcgacatgtggaccaataccctgttcgggttctcgccgttcggcacctggccgcacacgaggccggacggcaagacgctcgatccggccagggcccacacgcctgtcgtctatccgaagccggacggcaagctgaccttcgacaagttgtcctcggtgttcctctccaacaccaatcatgaagaggaccagccggttcatctgaaggtcgccgacatggttctgcaaaagacctcggagcacgacgtctatgccgggccgtcgaatcgctactgccctgccggagtctacgaatgggtcgaggacaccgccggcccgcgttatcagatcaacgcccagaactgtgtccactgcaagacctgcgacgtaaaggaccccaacggcaacatcacctgggttgcgcccgagggcggcggcggacccaactatgaggcgatgtga

SEQ ID NO: 100742 - protein, 580 aa, Nitrobacter hamburgensis X14
MFSGKKSETTSFGKHDRRKGRRLPKQIMSSDELPPRESMDFDVVIVGAGPSGLSAAIRLKQLDADLGIVVVEKGSEVGAHILSGAVIDPAGLDALVPDWRDDADCPLKTKVKDDRFYWMTPRRAIRLPNALMPPLMNNHRCYIGSLGNVCRWLAQKAEALGVEIYPGFAAAEVLYDDSGAVRGIATGDMGIARDGSHKNSYVRGMELRGKYTLFAEGARGSLSRQLIARFGLDKTSEPPKFGIGLKEVWQVDPAKHLNGLIQHSFGWPLNNSTGGGSFLYHYDDDRVAVGFVVHLNYDDPYLSPFEEFQRFKTHPAIRGVFEGGKRLAYGARAITEGGYQSVPRLTFPGGALIGCAAGFVNVPRIKGVHNAMGSAMLAAEHVAAALDAGRANDEIAGYENAWRDSTVGKDLFKVRNVKPLWSKFGTIAGVALGGLDMWTNTLFGFSPFGTWPHTRPDGKTLDPARAHTPVVYPKPDGKLTFDKLSSVFLSNTNHEEDQPVHLKVADMVLQKTSEHDVYAGPSNRYCPAGVYEWVEDTAGPRYQINAQNCVHCKTCDVKDPNGNITWVAPEGGGGPNYEAM

SEQ ID NO: 100743 - DNA, 1647 bp, Paracoccus denitrificans PD1222
  CDS (1)..(1647): transl_table=11
atgtccgaaattgaacgcgagtcgatggattacgacgtggtgatcgtcggcggcgggcctgcgggcctgtcggcggcgatccggctgaagcaggtgaaccccgagctttccgtggtgctgctggagaagggctccgagatcggcgcgcatatcctctcgggcgcggtgctcgacacttcgggcctcgaccggctgatcccggactggaaggacaggggcgccccggtcaccaccgaggtcacccaggacaacttctacatcctcggcccgcatggccaggtccgggtgccgaactggcccatgccgcccctgatgaacaatcacggcaaatacatcgtctcgatgggcaatgtctgccgctggctcgccgagcaggccgaggcgctggaagtcgagatcttccccggcatggcctgctcgcaactggtctacgagggcgaccgcgtcgtcggcgtcgtggccggcgagatggggctgaatgccgacggctcccccggcccggcctacgagcccggcatggagctgcgcggcaaatacgtgctgatcgccgagggcgtgaggggcagcctcgccaaggagctgatcggcaaatacgacctctcggccggccatgagccgcagaaattcggcctcggcatgaaggagatctgggagatcgacccggccaaggcccgccccggcaccgtcacccacaccatgggctggcccttgggcaagaacgccggcggcggcagcttcatctatcacctcgagggcaaccaggtgctggtcggcttcgtcgtgcacctgaactacgccaatccctatctctatccctacatggagttccagcgcttcaagcaccacccgctggtcgcggacctgctggaaggcggcaagcgcgtggcttacggcgcccgcgccatctccgagggcggctggcagtcgatccccaagctgaccgtgccgggggcggcgctgctcggttgctcggccgggctggtgaacgtgccgcgcatcaagggcaaccacaatgccatgctgtcggggatcgccgcggccgaggcggcagccaaggccatcgccgcgggccgcgagggcgacgagctcacggactacgaggccgacctgcgttccggccccatcgcccgcgacctgaagccggtcaggaacgtcaagccgctgtggtcgaagctggggctgtggtcttcgctggtgctcggcggcttcgacatgtgggtggcgaacctgaccggctggaaccccttgggcacctggaagcacggcaagacggatgcgcaggccaccggcaaggcggcggatttccagcccatcgactatccgcgcccggacggcaagctcagcttcgaccggctgaccaacgtggcgttttccttcaccaatcacgaggaaagccagccctgccacctgaagctgaaggaccccgcggtgccgatcgcggtgaacctgccgctttatgccgagccggcgacccgctattgcccggccggggtctacgaggtgctggagggcgagggcggcccgcgcttccagatcaacttccagaactgcgtgcattgcaagacctgcgacatcaaggaccccagccagaacatcaactggacaacaccccagggcggagacggacccaactacccgaatatgtga

SEQ ID NO: 100744 - protein, 548 aa, Paracoccus denitrificans PD1222
MSEIERESMDYDVVIVGGGPAGLSAAIRLKQVNPELSVVLLEKGSEIGAHILSGAVLDTSGLDRLIPDWKDRGAPVTTEVTQDNFYILGPHGQVRVPNWPMPPLMNNHGKYIVSMGNVCRWLAEQAEALEVEIFPGMACSQLVYEGDRVVGVVAGEMGLNADGSPGPAYEPGMELRGKYVLIAEGVRGSLAKELIGKYDLSAGHEPQKFGLGMKEIWEIDPAKARPGTVTHTMGWPLGKNAGGGSFIYHLEGNQVLVGFVVHLNYANPYLYPYMEFQRFKHHPLVADLLEGGKRVAYGARAISEGGWQSIPKLTVPGAALLGCSAGLVNVPRIKGNHNAMLSGIAAAEAAAKAIAAGREGDELTDYEADLRSGPIARDLKPVRNVKPLWSKLGLWSSLVLGGFDMWVANLTGWNPLGTWKHGKTDAQATGKAADFQPIDYPRPDGKLSFDRLTNVAFSFTNHEESQPCHLKLKDPAVPIAVNLPLYAEPATRYCPAGVYEVLEGEGGPRFQINFQNCVHCKTCDIKDPSQNINWTTPQGGDGPNYPNM

SEQ ID NO: 100745 - DNA, 1647 bp, Shewanella denitrificans OS-217
  CDS (1)..(1647): transl_table=11
atggaacgcgaatcaatggaattcgacgtcgttatcgtcggtgcaggtcctgctggtttagccacggcctgccgtttaatgcagatatccaaagatgctaacaaagagatcactgtctgcgtcgttgagaaaggctctgaagtcggtgcccacatactttctggtgcggtttttgagccccatgtgctcgatgaactcttcagcgactggcgtaacgatgcccccctgaagaccaaggtcacagatgatgaaatctatttactcaattctgacgcccactctctgcacatacccaatgcctttgtgcctaaaactatgcacaaccatggcaactatattatcagtgtcggcaatctggctcgctggatggccgaacgcgccgaagccttaggggttgaaattttcccaggttttgccgccagtgaaatgctatttaacgaagataatagcgtcaaaggcatcttgattggcgacatgggtgttggcgccgatggcaagcctaaagacagctatatgccaggcatggagctgcacgcaaaatataccgtactgtctgaaggttgccgtggccacttagggaagcagttgattgaaaaataccaactggatgccggtaaaacccctcagcattatggtttaggctttaaagaaatttggaaaatccccgccgaacaacatacagaaggcaaagtggttcacaccggaggctggcccttaaatgagggttcatcgggtggtggcttcctttatcatatggaagacaatcaagtggcggtcggattgattatcgaccttaactataagaacccacatttaagtccattcgatgaattccaacgctataagacccacccgcttattgcccgtatcttaactggtggtgagcgcttgagctatggtgctcgtgctatcgctaaaggcggactgaacgccttgcccaaaatgagcttccctgggggcttgttgataggttgtgatgctggcacattgaatttcgctaaaatcaaaggcactcacacggcaatcaagagtggcttagtggctgccagcaccttaggcgaagccttaattgcaggggttgaagggggcaaagacttagattgcttcggccaacgtattagtgagagctggttgcatgaagaactgtaccagtcacgtaatttcggaccagcgctgcataaatttggcacttggatgggcggcgctttcaactacatcgaccaaaattggtttggcggcaacatgcccattaccttaaaagatgaaacggccgatcacgctcaaatggggcttgccaaagattttaaggtcattaactaccctaaagccgacggtaagctgagcttcgataagctgtcctctgtgtatttgtccaataccttccatgaagaagatcagctgtgtcatttgcgcttgaaagatgccggcatacctatttctgtcaatttggccaagtttgatgaaccggcgcagcgttattgccctgctggcgtgtatgaagtcgtcgaggaagccggtgaaaagaaatttgttatcaatggtcagaactgcattcactgcaagacttgcgatattaaagaccctagccaaaacatcacttgggtgacccccgagggcggcggtggtccaaactaccccaatatgtaa

SEQ ID NO: 100746 - protein, 548 aa, Shewanella denitrificans OS-217
MERESMEFDVVIVGAGPAGLATACRLMQISKDANKEITVCVVEKGSEVGAHILSGAVFEPHVLDELFSDWRNDAPLKTKVTDDEIYLLNSDAHSLHIPNAFVPKTMHNHGNYIISVGNLARWMAERAEALGVEIFPGFAASEMLFNEDNSVKGILIGDMGVGADGKPKDSYMPGMELHAKYTVLSEGCRGHLGKQLIEKYQLDAGKTPQHYGLGFKEIWKIPAEQHTEGKVVHTGGWPLNEGSSGGGFLYHMEDNQVAVGLIIDLNYKNPHLSPFDEFQRYKTHPLIARILTGGERLSYGARAIAKGGLNALPKMSFPGGLLIGCDAGTLNFAKIKGTHTAIKSGLVAASTLGEALIAGVEGGKDLDCFGQRISESWLHEELYQSRNFGPALHKFGTWMGGAFNYIDQNWFGGNMPITLKDETADHAQMGLAKDFKVINYPKADGKLSFDKLSSVYLSNTFHEEDQLCHLRLKDAGIPISVNLAKFDEPAQRYCPAGVYEVVEEAGEKKFVINGQNCIHCKTCDIKDPSQNITWVTPEGGGGPNYPNM

SEQ ID NO: 100747 - DNA, 1650 bp, Shewanella frigidimarina NCIMB 400
  CDS (1)..(1650): transl_table=11
atggaacgcgagtcaatggagttcgacgtagtaattgtcggtgctggccctgcaggtttagcgaccgcttgtcgtttaatgcaaatatctaaagatgctgataaagaaatcaccgtttgtgtggtagaaaaaggctctgaagtgggtgctcatattttgtcgggtgctgtattcgaacctgatgtactggacgaattatttaatgattggcgagattcagacatcccgctaaccactaaagtcactcatgacgaaatctacctgcttaactcagaaacacaatctcgcttaatgcccaacagcttagtgcctaaaaccatgcacaatgatggtaactacatcattagtgtgggtaacttagcccgctggttagccaacagagccgaagccatgggcgtagagattttccctggttttgcagccagtgaattactgtttaatgaagacaacagtgttaaaggtattttaatcggtgatatgggtgttggtgaaaatggtcaacataaagacagctatatgccgggtatggaattacatgccaaatacaccgtattttcagaaggctgtcgtggccatctaggtaaacaactgatccaaaaataccatttagacaatggtaaaacaccacaacattatggcttaggctttaaagaaatttggaaaatccctgctgaacaacatcagcaaggtaaagtggttcacactggtggttggccactcgtgaatggctcatctggtggtggcttcctatatcatatggaagacaaccaagttgctgtagggttaattatcgacttaaattataaaaaccctcacctcagcccatttgatgaatttcagcgctataaaactcaccctgtaattgccgcaactttaacgggcggagagcgattatcttatggtgcacgagccattgccaaaggtggtttaaactcactaccgaaaatgagcttccctggcggtttaattattggttgtaatgcgggcacacttaactttgctaaaatcaaaggcacgcatacagctattaagagcggtattattgcggcaaaaaccttaggtgaaggcttaattgccggactagaaggtggcaaagatcttgactgtttccaagaccgtttcgaaaaaagctggcttcatgaagagctttatagctcacgcaactttggcccggccatgcataagtttggtacgctactcggtggcgcctttaactatatcgaccaaaattggtttggtggtaagtttccggtgacctttagagacaccactccagattatgccacgatggggctagcgagcgattacaataaaattgactatcctaaacctgacggcaagttgagttttgataagttatcgtcggtatatctgtcgaatacttttcatgaagaagatcagctgtgtcatttacatctaaaagaccaaagcatcccaatatcggtaaacttagttaaatttgatgaacccgcgcaacgttactgtcctgccggtgtttatgaagtggttgaagaagccggtgacaaaaaatttgtgattaatggtcaaaattgcattcattgtaagacctgtgacattaaagacccaagccaaaacattacctgggtcacaccagaaggcggcggcgggccaaactatccaaatatgtaa

SEQ ID NO: 100748 - protein, 549 aa, Shewanella frigidimarina NCIMB 400
MERESMEFDVVIVGAGPAGLATACRLMQISKDADKEITVCVVEKGSEVGAHILSGAVFEPDVLDELFNDWRDSDIPLTTKVTHDEIYLLNSETQSRLMPNSLVPKTMHNDGNYIISVGNLARWLANRAEAMGVEIFPGFAASELLFNEDNSVKGILIGDMGVGENGQHKDSYMPGMELHAKYTVFSEGCRGHLGKQLIQKYHLDNGKTPQHYGLGFKEIWKIPAEQHQQGKVVHTGGWPLVNGSSGGGFLYHMEDNQVAVGLIIDLNYKNPHLSPFDEFQRYKTHPVIAATLTGGERLSYGARAIAKGGLNSLPKMSFPGGLIIGCNAGTLNFAKIKGTHTAIKSGIIAAKTLGEGLIAGLEGGKDLDCFQDRFEKSWLHEELYSSRNFGPAMHKFGTLLGGAFNYIDQNWFGGKFPVTFRDTTPDYATMGLASDYNKIDYPKPDGKLSFDKLSSVYLSNTFHEEDQLCHLHLKDQSIPISVNLVKFDEPAQRYCPAGVYEVVEEAGDKKFVINGQNCIHCKTCDIKDPSQNITWVTPEGGGGPNYPNM

SEQ ID NO: 100749 - DNA, 1110 bp, Burkholderia mallei FMH
  CDS (1)..(1110)
atggaatacgacgtcgtgatcgtcggcggcggccccgcaggcctgtcggcggccatccggctcaagcagctcgccgccgagaaaggtgcggaaatcggcgtgtgcgtgctcgaaaagggctcggagatcggcgcgcacatcctgtcgggcgccgtgatggacccgcgcgcgatcaccgaactgttccccgactggaaggaaaagggggcgccgctcaacgtcgacgtcaccgaggaccgcttcctgttcctgaccgagaaaagctcgttccaggtacccaactgggcactgccggacaatttcaagaaccacggcaattacgtgatcagcctcggcaacgtcacgcgctggctcggccagcaggcggaagccctgggcgtcgagatcttcccgggcttcccggccgccgagatcctctataacgacgacggctcggtcaagggcgtcgcgacgggcaacatgggcgtcggcaaggacggcgagccgaccgagaacttccagctcggcatggagctgcacgcgaagtacacgctcttttgcgaaggcgcgcgcggccacctcggccgccagttgatggacaagttcaagctgaacgcgaacagcgacccgcaggcgtacgggatcggcatcaaggagctgtgggagatcgatccggtcaagcacaagccgggcctcgtgatccacacggccggctggccgctgtcgtcggacacgtacggcggctcgttcctgtatcacatggacaacaatcaggtcgtcgtcggcttcgtcgtcggcctcgcgtactcgaacccgtacctgtcgccgttcgaggagttccagcgctacaagacgcatccggcgatccggccgttcctcgaaggcggcaagcgcgtgtcgtacggcgcgcgcgcgatcaccgcgggcggcctgctgtcgctgccgaagacggtgttcccgggcggcgcgctcgtcggcgacgacgcgggcttcctgaacgcgtcgcggatcaagggcagccatgcggcgatcaagaccggcatgctcgccgccgaagccgcgttcgacgcggtgcaggcgggccgccaggccgacgaactgaccgcttacccggacgcgttcaagacgtag

SEQ ID NO: 100750 - protein, 369 aa, Burkholderia mallei FMH
MEYDVVIVGGGPAGLSAAIRLKQLAAEKGAEIGVCVLEKGSEIGAHILSGAVMDPRAITELFPDWKEKGAPLNVDVTEDRFLFLTEKSSFQVPNWALPDNFKNHGNYVISLGNVTRWLGQQAEALGVEIFPGFPAAEILYNDDGSVKGVATGNMGVGKDGEPTENFQLGMELHAKYTLFCEGARGHLGRQLMDKFKLNANSDPQAYGIGIKELWEIDPVKHKPGLVIHTAGWPLSSDTYGGSFLYHMDNNQVVVGFVVGLAYSNPYLSPFEEFQRYKTHPAIRPFLEGGKRVSYGARAITAGGLLSLPKTVFPGGALVGDDAGFLNASRIKGSHAAIKTGMLAAEAAFDAVQAGRQADELTAYPDAFKT

SEQ ID NO: 100751 - DNA, 1647 bp, Xylella fastidiosa Dixon
  CDS (1)..(1647): transl_table=11
atgttggcagcgaaacaggagacagaaacaaacaccattgagcgtgacgtcatggaatacgacgttgtcaccgtcggcgctggcccggcaggcttagcttttgcaatccgcctgaaacaactcaaccctgccttgtcggtatgcgtgatcgaaaaatccagcacaatcggcgcacatattctctctggcgcagtgatcgaacctgcccccctggatagcctactccctggctggcgcaacgccccacctccaatctgcgtccctgcaaccgaggacgaattctggctcctgagcaaaaatggcgcacacaaatttccgatcatgccgccgagcttgcgcaaccacggtaacgtgatcgtcagccttggcgcactatgcgcctggttagcacctcaagccgagacactgggcgtagacatttacccaggcttctccgccactgaaaccctgcacgacgcggctggccaagtcattggagtgcgcattggcgacatgggtatcgccaaaaacggaacacacaaacctaacttcaccccaggcattgcaatcaacgcaaaggtcacagtacttgccgaaggcgcacgcggccacctgaccaaacacctgattaaacatttctcactagatcaaaatagtgatccgcaaacctactccatcggaatcaaagaactatggcacgtcccagaaaaacgtagctctccaggcaaaatcttacataccctcggctggccagccaatacacatacctacggaggcggctttctctatcacctgaatgacaatcgcatcgcactaggttatgtcagcggcctggactatcacgacccaatgtacgaaccctgggaagcattccagcaatggaaaaaccacccactcatcaaaccgcttctagaaagtggtgacctcctatcaggcggcgcacgtgcaatcgtcactggcggctggcaatccctccccaaagtggacatgccaggtgcactgttgatcggtgacactgccggcttactcaacgtccccaagatcaaaggaacacaccaagcaatccgcagcggcatgctcgccgccgaacatctcgtcgccacccaactcaccccctatggatttgatgccaaactgcgtgcttcaaaggcaatgaccgaattaaaacaagtacgcaacatcaagccaggtttcaaaaaaggcttatggttgggcctactgaacgccgcctgggagaccgctacccgcggcgcttctccatggacattgaaaaacacaccagactgggccgcactgcaacggctcgacaaaaaccaacaaacaaaacacgactacgtacaacgcaccttaccgccacgcgaccgcctgcatagcgtctacttcgcggccactgtgcacaatgaagatcaacccatccatctaaaagtcaccgaccccgaacgatgcgtcacacgctgcgtagaggaatacggcaatccatgcacccgcttctgtccggccaacgtctaccaaatcattgaggaccccaactcagcaaccaacaaacgcttacacatcaatgcagccaactgcgtgcactgtaaaacctgtgacatcaaagatccgtaccagattatcgactggatcaccccagaaggcggatcaggcccaaattatcaaaacctataa

SEQ ID NO: 100752 - protein, 548 aa, Xylella fastidiosa Dixon
MLAAKQETETNTIERDVMEYDVVTVGAGPAGLAFAIRLKQLNPALSVCVIEKSSTIGAHILSGAVIEPAPLDSLLPGWRNAPPPICVPATEDEFWLLSKNGAHKFPIMPPSLRNHGNVIVSLGALCAWLAPQAETLGVDIYPGFSATETLHDAAGQVIGVRIGDMGIAKNGTHKPNFTPGIAINAKVTVLAEGARGHLTKHLIKHFSLDQNSDPQTYSIGIKELWHVPEKRSSPGKILHTLGWPANTHTYGGGFLYHLNDNRIALGYVSGLDYHDPMYEPWEAFQQWKNHPLIKPLLESGDLLSGGARAIVTGGWQSLPKVDMPGALLIGDTAGLLNVPKIKGTHQAIRSGMLAAEHLVATQLTPYGFDAKLRASKAMTELKQVRNIKPGFKKGLWLGLLNAAWETATRGASPWTLKNTPDWAALQRLDKNQQTKHDYVQRTLPPRDRLHSVYFAATVHNEDQPIHLKVTDPERCVTRCVEEYGNPCTRFCPANVYQIIEDPNSATNKRLHINAANCVHCKTCDIKDPYQIIDWITPEGGSGPNYQNL

SEQ ID NO: 100753 - DNA, 1872 bp, Psychrobacter cryohalolentis K5
  CDS (1)..(1872): transl_table=11
atgcaagagcaagacaatcaatcgccagttattgatggtgatactgtaaatatcgacacgccaatcgtgacagacacagcaaattcagagccagcagtggtaacaccagaagtgctcgctgaagaaacgcccgttattgtagatacgcaagccgttgagccagttgctgaaacggtcgttgtcgacaaagcgccagaacctgttgcagcagagcctgaagtagaacgtgagtcaatggaatttgatgtcattatcgttggtggtggacctgccggactttcagctgccatccgtctacgccagcttgccatcgcagcaggtaacgatgagttcatggtttgtgtggtcgaaaaaggctcggagtttggcgctcatactctctctggtgcggtcatggaaacacgcgctttggatgagttgattccagattggaaagaaaaaggcgcaccgctaaacgttcctgcaattgaagatcgcgtctatatgctgggttcagcgaccaaatctatcaaattaatggattcggtcattcctgccagcatgcataaccaaggcaactatattgtctcattaggcaacgtcgttcgttggttggctcaacaagctgaagagctagaagtcatgatgttcccaggcttccccgctgatgaaatcttatataatgatgatggttcagttaaaggcgtattgacaggcgacatgggtgtggctgccagtggcgaagcgaaacatagctttgagccaggttatgagctgcttgctaaatatactatatttaccgaaggtagccgtggtcacttaggcaagcgcttgatcagtcgttttaatcttgacaaagactgtgacccccaacactatggtattggtctaaaagagctatgggatattgatcctgctaagcatgaagaaggtgtggtcatgcatggttcaggttggcctttgactgatacgggttcaactggaggctggtggttgtatttcgctgaaaacaatcaagtaagctttggtcttgttattgatctctcctattctaatccatatatgtcgccatttgatgagatgcagcgtctaaaactacatccgcttattcgtaatgttctagaaggcggtaaacgtatctcttacggcgcacgctcgttaactaaaggcggtttgaactccttgccaaaattcaccttcccaggtggtgtattagctggtgatgacgcaggtttcttaaatcctgccaaaatcaaaggtacccatacttcaatgaagtcaggaatgctagcggctgaggcgattttcgaagccttgcaagaagatcgtcaacatgatgaagtgctggcttatactacgatgtttgaagagtcttggttgtataaagacaactatgaagcacgtaactttgctcctgctatgcaccgtatgggtcaatggatgggcggcgcgtttacctttttagagcaaaatctgatgggcggcaaaatgcctttgaccattcatgacaataaaaaagattatgatcagcttgagcgtgcggctcatgcctatcagccaacctatgcaaaaccggacggcaaattggtatttgataaattatcgtcagtatttatctcaaataccaaccatactgaagatcaaccagtacatttaaaattaactgatccaacagtgcctgtcactatcaacttaccactctatgctgagccagcgcgtttatactgcccagctggtgtttatgagattgtaaaagacgcggaaggcgctaaatttgtcatcaatgcgcaaaactgtgtccattgcaaaacttgtgatatcaaagacccttcacagaacatcacgtgggtaacgccagaaggcggcggcggtcctaactatccaaacatgtaa

SEQ ID NO: 100754 - protein, 623 aa, Psychrobacter cryohalolentis K5
MQEQDNQSPVIDGDTVNIDTPIVTDTANSEPAVVTPEVLAEETPVIVDTQAVEPVAETVVVDKAPEPVAAEPEVERESMEFDVIIVGGGPAGLSAAIRLRQLAIAAGNDEFMVCVVEKGSEFGAHTLSGAVMETRALDELIPDWKEKGAPLNVPAIEDRVYMLGSATKSIKLMDSVIPASMHNQGNYIVSLGNVVRWLAQQAEELEVMMFPGFPADEILYNDDGSVKGVLTGDMGVAASGEAKHSFEPGYELLAKYTIFTEGSRGHLGKRLISRFNLDKDCDPQHYGIGLKELWDIDPAKHEEGVVMHGSGWPLTDTGSTGGWWLYFAENNQVSFGLVIDLSYSNPYMSPFDEMQRLKLHPLIRNVLEGGKRISYGARSLTKGGLNSLPKFTFPGGVLAGDDAGFLNPAKIKGTHTSMKSGMLAAEAIFEALQEDRQHDEVLAYTTMFEESWLYKDNYEARNFAPAMHRMGQWMGGAFTFLEQNLMGGKMPLTIHDNKKDYDQLERAAHAYQPTYAKPDGKLVFDKLSSVFISNTNHTEDQPVHLKLTDPTVPVTINLPLYAEPARLYCPAGVYEIVKDAEGAKFVINAQNCVHCKTCDIKDPSQNITWVTPEGGGGPNYPNM

SEQ ID NO: 100755 - DNA, 1674 bp, Prosthecochloris vibrioformis DSM 265
  CDS (1)..(1674): transl_table=11
gtggaacaggaacgcgaatcacttgaattcgacactctctttgtcggagcaggccccgcaaacctcgcctcggccatccatctcagccggctgctgaaaaagcacaatgagagttccccgaaccggttgaatccatccatcgccatcatcgacaaggggcgccacgctggcgcacaccttctctcaggcgccctgctcgacacacaggcacttcctgaattcctccccgaatgggaaaaggaagggttccccgcaggaatacctgtccagaaagagcagctctggtatctcaccaaaacccgtcatctcgcatttccctcagtaccggaagccttcggcagcagcggcagcacaatctgcagcctcagcgtcatcggggaatggatggcaaaaaaagcagaaggagagggaatcgaattcttcccggaaaccgcagcaacaggcattgtggctgaaaacggacggcttgaaggcattctgaccgatgaaaagggggttgaccggaacggccagccaaaacctgactaccagccgggcatgcttctgaaaacccgtattgccatcattggcgaaggtgcgggtggatcactcggcccccagctccagaaagagttcgggctgctccctgagggaatgcggcgcaggtatgaaaccggtgtcaaagaggtctggcgaatccctgaaggaagagtacctgcgggccagacgcaccacgcattcggctaccctctctcctccacccgctatggcggcggctggctctacgctctctcagacactgaaatctccctgggcttcgtcaccaccgttgaacccgaagcccctgttaccgacccgcacctcaacctccagctcttcaaacagcaccccttcattgccacaatcctcaaagggggccgcatggtggaagccggagcaaaaaccatcacttcgaacggctttgaagcaatgggacgcatcagcggtcccggcttcctcctgaccggtgaatcagccggaatgctcgacatgcagcgactcaaggggatacacctcgccatgaaatcaggcattctggcagcagaaaccattctggaagccctcattcatgacaattgttccgccgcccggctggactcctacgaggaacggttcagaaactcatgggcacatgaagagctccacgcgtcgcgtaactaccgaaatgcctttgccaaagggctctaccacggactcctccagaccggcctcacgcttgccctcccgggaatttcaaccttagccacatcgggcagcagcgttcagctcccgcccaaaagagcccgaaacgacctcaaagcgctcctgaaagcaaaagaaaaacaccgccccgacggagaaacaaccttcagtaaatccgactcgctctaccgctccggcaccatgcatgaggaaaatcagccctgccatctccgcatcagcgcggaggacattgctttgatatgccttgagcgatgccgcacggagtatgggaacccctgccagcacttctgcccggcgggagtctatgaactgacactggagccagtcccggctctcaagatcaacgcctcgaactgcctgcactgcaaaacctgtgaaagcgcagatccctacggggttattacatggacacctcccgaagggggtggcggtcccggatacaagctcagctga

SEQ ID NO: 100756 - protein, 557 aa, Prosthecochloris vibrioformis DSM 265
MEQERESLEFDTLFVGAGPANLASAIHLSRLLKKHNESSPNRLNPSIAIIDKGRHAGAHLLSGALLDTQALPEFLPEWEKEGFPAGIPVQKEQLWYLTKTRHLAFPSVPEAFGSSGSTICSLSVIGEWMAKKAEGEGIEFFPETAATGIVAENGRLEGILTDEKGVDRNGQPKPDYQPGMLLKTRIAIIGEGAGGSLGPQLQKEFGLLPEGMRRRYETGVKEVWRIPEGRVPAGQTHHAFGYPLSSTRYGGGWLYALSDTEISLGFVTTVEPEAPVTDPHLNLQLFKQHPFIATILKGGRMVEAGAKTITSNGFEAMGRISGPGFLLTGESAGMLDMQRLKGIHLAMKSGILAAETILEALIHDNCSAARLDSYEERFRNSWAHEELHASRNYRNAFAKGLYHGLLQTGLTLALPGISTLATSGSSVQLPPKRARNDLKALLKAKEKHRPDGETTFSKSDSLYRSGTMHEENQPCHLRISAEDIALICLERCRTEYGNPCQHFCPAGVYELTLEPVPALKINASNCLHCKTCESADPYGVITWTPPEGGGGPGYKLS

SEQ ID NO: 100757 - DNA, 1287 bp, Syntrophomonas wolfei str. Goettingen
  CDS (1)..(1287): transl_table=11
atggagaaattcgatgtaattatagtaggagctggcctggcgggcctggcagccgcctataccctggccggggaaggcctggaggtgctggtactggaaaggggtgactaccccggagctaagaatgtgaccggcgggcgtctctatattaacccggtgcgcgagttatttcctgatttgtggaaaaaagcacccctggagcgatttatcagccatgaaggagtaactataatgagccgggagcgctcggtgaccataaattatgaaggagacgagctgcgtcaggagccctaccagagctacagcatccttagagccaggtttgaccgctggttggccaaacaggcggaaagaaaaggagccatgctggtggacaagacccgggtggatgatttgataaaagtggatggccgggtaagcggggtagtagccggaggggatgagctctatgctgatgtggtaatcgcctgtgatggtgtactgtccctggtagcggaaaaagccggtctgcgccagccgggtaagccggaagatcatgccgtgggcttcaaggaaatcattgagttggaccagacggtcattaatgagcgctttggcctggagggcaatgaaggcctggcccgtatgtttatgggagaggtaacccggggcaagttcggtggcggattcctttataccaataaggatagtatcagcctgggtatagtggtgggcatcaaggatttgatgcagggccagccggctgtacaggctcccttgctcttggatgaatttaaacaacgcccggaaatagcggttttgataaaaggcggggagacagtggagtattctgcccatgccattccggaaggaggctaccaggccatgagcaaactttttggggatggtattctgctggccggtgatgctgctggtttttccatgaacatcggggttacggttcgaggcatggaatatgccctggcctccggttattatgcggctcaggctgtgattgcagccaaaaaggcggaggattttagtgcccggggactggcggtataccaggaactcctggggcaaagttttgttatggaagacttcaagaatttccaggaagcacctcacgctctggaaaatccccgcttattccaacattacccggaaatgctgggaaatatgatgcgggatatatatgctgttcctgctggccccaagaatcgactttacccaactataaagcaataccttggctttagcgagttgtggtccatgttgggggatgcgaggaaggtgatgaaaatatga

SEQ ID NO: 100758 - protein, 428 aa, Syntrophomonas wolfei str. Goettingen
MEKFDVIIVGAGLAGLAAAYTLAGEGLEVLVLERGDYPGAKNVTGGRLYINPVRELFPDLWKKAPLERFISHEGVTIMSRERSVTINYEGDELRQEPYQSYSILRARFDRWLAKQAERKGAMLVDKTRVDDLIKVDGRVSGVVAGGDELYADVVIACDGVLSLVAEKAGLRQPGKPEDHAVGFKEIIELDQTVINERFGLEGNEGLARMFMGEVTRGKFGGGFLYTNKDSISLGIVVGIKDLMQGQPAVQAPLLLDEFKQRPEIAVLIKGGETVEYSAHAIPEGGYQAMSKLFGDGILLAGDAAGFSMNIGVTVRGMEYALASGYYAAQAVIAAKKAEDFSARGLAVYQELLGQSFVMEDFKNFQEAPHALENPRLFQHYPEMLGNMMRDIYAVPAGPKNRLYPTIKQYLGFSELWSMLGDARKVMKI

SEQ ID NO: 100759 - DNA, 1296 bp, Syntrophobacter fumaroxidans MPOB
  CDS (1)..(1296): transl_table=11
atggcagaagacaaaaccaccgcaatagtggtcggggccggtcccgccggcagtacggccgcataccttttggcccgtgaggggcacgaggtgatcctggtggagcggggaaccgctccgggctgcaagaacatgtacggcgggcgcatgtacagtcacgcgttgaaccggatcattccggaattctggacagaggctccggtggagcgctgcgttgagcgcgagctcatcacgttcctcgacggcgagcgttcggtatcggtcgcctgtcgggattcggagtgggccggtcccggctgtcattccttcacgctgctgcgggccgaattcgacgcatggctcgccgcgaaggcggaggaggcgggagcgcttctggcgtgcggaatccgggtcgacgacctggtgtttgaaaacggccgggtcgtgggcatccgggccggggaagatgaaatgatggccgacgtggtgatcgcggcagacggggtcaattcggtcctggcccggaaggcgggccttgccgggcctttttcggcgcgccaggtggccacgggggtcaagcagatcatcgagctgcccgcgcagaccatcaacgagcgcttccaggtcgacgacttccacggcgcggcgcaactgttcgtgggggactgttccgggggagtccagggaggcggttttctctacaccaacaagaacagcatttccctggggctggtcttcaacgtcgcggagcttagtcgctgccggatgaagccggcggaggccctcgaggacttcaagagcagcccgcacatcgcccctttgatcgaaggggggcgggaagccgagtattcggcgcacctggtgcccgaggcggggctggggatgatgcccgagttgttcggcgacgggatattggttgccggggatgccgcgggcttcgtgctcaaccttggttatacagtgcggggcatggactttgccgtcgcctcgggggaggcggccgcgcgggcggtgatggaggcgaaggcgcataacgatttttcccgcaacggtctttgccgctaccgggagttgctgcgggaaagcttcgtcctcagggacctggaagcctaccggagtgcgccggagattttggaaaacaaacgtatgttcaaccaatacccgaaacttgtcacgggccttgcgagcgagttgttcacggtggacggcaagccgccggcacggcttgcccggaaaatttacgaccggatccgggcgagcggaatcggcctggggcaactggccctcgacggctggaaaggagcgagaggcctgtga

SEQ ID NO: 100760 - protein, 431 aa, Syntrophobacter fumaroxidans MPOB
MAEDKTTAIVVGAGPAGSTAAYLLAREGHEVILVERGTAPGCKNMYGGRMYSHALNRIIPEFWTEAPVERCVERELITFLDGERSVSVACRDSEWAGPGCHSFTLLRAEFDAWLAAKAEEAGALLACGIRVDDLVFENGRVVGIRAGEDEMMADVVIAADGVNSVLARKAGLAGPFSARQVATGVKQIIELPAQTINERFQVDDFHGAAQLFVGDCSGGVQGGGFLYTNKNSISLGLVFNVAELSRCRMKPAEALEDFKSSPHIAPLIEGGREAEYSAHLVPEAGLGMMPELFGDGILVAGDAAGFVLNLGYTVRGMDFAVASGEAAARAVMEAKAHNDFSRNGLCRYRELLRESFVLRDLEAYRSAPEILENKRMFNQYPKLVTGLASELFTVDGKPPARLARKIYDRIRASGIGLGQLALDGWKGARGL

SEQ ID NO: 100761 - DNA, 1647 bp, Xylella fastidiosa Ann-1
  CDS (1)..(1647): transl_table=11
atgttggcagcgaaacaggagacagaaacaaacaccattgagcgtgacgtcatggaatacgacgttgtcaccgtcggcgctggcccagcaggcttagcttttgcaatccgcctgaaacaactcaaccctgccttgtcggtatgcgtgatcgaaaaatccagcacaatcggcggacatattctctctggcgcagtgatcgaacctgcccccctggatagcctactccctggctggcgcaacgccccacctccaatctgcgtccctgcaaccgaggacgaattctggctcctgagcaaaaatggcgcacacaaatttccgatcatgccgccgagcttgcgcaaccacggtaacgtgatcgtcagccttggcgcactatgcgcctggttagcacctcaagccgagacactgggcgtagacatttacccaggcttctccgccactgaaaccctgcacgacgcggctggccaagtcattggagtgcgcattggcgacatgggtatcgctaaaaacggaacacacaaacctagcttcaccccaggcattgcaatcaacgcaaaggtcacagtacttgccgaaggcgcacgcggccacctgaccaaacacctgattaaacatttctcactagatcaaaacagtgatccgcaaacgtactccatcggaatcaaagaactatggcacgtcccagaaaaacgtagctctccaggcaaaatcttacataccctcggctggccagccgatacacatacctacggaggcggctttctctatcacctgaatgacaatcgcatcgcactaggttatgtcagcggcctggactatcacgacccaaggtacgaaccctgggaagcattccagcaatggaaaaaccacccattcatcaaaccgcttctggaaagtggtgacctcctatcgggcggcgcacgtgcaatcgtcaccggcggctggcaatccctccccaaagtggacatgccaggggcactgttgatcggtgacactgccggcttactcaacgtccccaagatcaagggaacacaccaagcaatccgcagcggcatgctcgcggccgaacatctcgtcgtcacacaactcaccccctatggatttgatgccaaactgcgtgcttcaaaggcaatgaccgaattaaaacaagtacgcaacatcaagccaggtttcaaaaaaggcttatggttgggcctactgaacgccgcctgggagaccgctacccgtggcgcttctccatggacattgaaaaacacaccagactgggccgcactgcaacggctcgacaaaaacccacaaacaaaacacgactacgtacaacgcaccttaccgccacgcgaccgcctgcatagcgtctacttcgcggccactgtgcacaatgaagatcaacccatccatctaaaagtcaccgaccccgaacgatgcgtcacacgctgcgtagaggaatacggcaatccatgcacccgcttctgtccggccaacgtctaccaaatcattgaggaccccaactcagcaaccaacaaacgcttacacatcaatgcagccaactgcgtgcactgtaaaacctgtgacatcaaagatccgtaccagattatcgactggatcaccccagaaggcggatcaggcccaaattatcaaaacctataa

SEQ ID NO: 100762 - protein, 548 aa, Xylella fastidiosa Ann-1
MLAAKQETETNTIERDVMEYDVVTVGAGPAGLAFAIRLKQLNPALSVCVIEKSSTIGGHILSGAVIEPAPLDSLLPGWRNAPPPICVPATEDEFWLLSKNGAHKFPIMPPSLRNHGNVIVSLGALCAWLAPQAETLGVDIYPGFSATETLHDAAGQVIGVRIGDMGIAKNGTHKPSFTPGIAINAKVTVLAEGARGHLTKHLIKHFSLDQNSDPQTYSIGIKELWHVPEKRSSPGKILHTLGWPADTHTYGGGFLYHLNDNRIALGYVSGLDYHDPRYEPWEAFQQWKNHPFIKPLLESGDLLSGGARAIVTGGWQSLPKVDMPGALLIGDTAGLLNVPKIKGTHQAIRSGMLAAEHLVVTQLTPYGFDAKLRASKAMTELKQVRNIKPGFKKGLWLGLLNAAWETATRGASPWTLKNTPDWAALQRLDKNPQTKHDYVQRTLPPRDRLHSVYFAATVHNEDQPIHLKVTDPERCVTRCVEEYGNPCTRFCPANVYQIIEDPNSATNKRLHINAANCVHCKTCDIKDPYQIIDWITPEGGSGPNYQNL

SEQ ID NO: 100763 - DNA, 1674 bp, Burkholderia ambifaria AMMD
  CDS (1)..(1674): transl_table=11
atgacccccgcaagcctcatcgagcagtacggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaagggttccgagatcggcgcgcacatcctgtcgggtgcggtgatggacccgcgcgcgatcaccgaactgttccccgactggaaggaacgcggcgcgccgctcgacgtcgcggtgacggaagaccgcttcctgttcctgtccgagacgggcgcggtcaccacgcccaactgggcgctgcccgccaacttccagaaccacggcaactacgtgatctcgctgggcaacgtcacgcgctggctcggggcacaggccgaagcgcagggcgtcgagatcttcccgggcttcccggccgccgagattctctacaacgacgacggctcggtgaagggcgtcgccaccggcaacatgggcgtgggcaaggacggcgagccgaccgagaacttccagctcggcatggagctgcacgcgaagtacacgctgttcgccgaaggctgccgcggccacctcggccgtcaactgatctcgaagttcaagctcgacgcgaacgcggatccgcaggcatacgggatcggcatcaaggagctgtgggaaatcgatccggcaaagcacaagccgggcctcgtgatccacacggccggatggccgctgaagtccgatacgtacggcggctcgttcctgtatcacatggacaacaaccaggtggtggtcggcttcgtggtgggcctgggctatacgaacccgtacctgtcgccgttcgaggaattccagcgctacaagacgcatccgtcgatccgcgcgttcctggaaggcggcaagcgcgtgtcgtacggcgcgcgcgcgatcacggcgggcgggctgctgtcgctgccgaagacggtgttcccaggcggcgcgctgatcggcgacgacgcgggcttcctgaacgcgtcgcggatcaagggcagtcatgcggcgatcaagaccggcatgctggcggccgatgctgcattcgacgcggtgcaggccggccgccagtcggacgagctcaacgcgtatccggacgctttcaagcaatcgtggctgtacacggagctgtaccgcgcgcgcaacttcaagcagtggatggccaaggggctgtatctcggcacgctgatggtcgggctcgagcagaaggtgatgggcggcaacgtgccgtggacgctgcatcacaagcatgcggatcacgagatgctgaagccggcgtcgcaatgcacgccgatcgagtatccgaagccggacggcaagctgacgttcgatcgtctgtcgtcggtgttcatctcgaacacgaaccacgaggagaaccagccggcgcatctgacgctgaaggatgcgaacgtgccggtgaacgtgaacctgcgtacgtacggggggccggaggcgcgcttctgcccggcggcggtgtacgagttcgtgaagaacgacgacggcggcgatcggctggtgatcaacgcgcagaactgcgtgcactgcaagacctgcgacatcaaggacccgacgcagaacatcgtgtgggtcacgccggaaggtggcggcgggccgaattacccgaacatgtaa

SEQ ID NO: 100764 - protein, 557 aa, Burkholderia ambifaria AMMD
MTPASLIEQYGPRESMEYDVVIVGGGPAGLSAAIRLKQLAAEKGTEIGVCVLEKGSEIGAHILSGAVMDPRAITELFPDWKERGAPLDVAVTEDRFLFLSETGAVTTPNWALPANFQNHGNYVISLGNVTRWLGAQAEAQGVEIFPGFPAAEILYNDDGSVKGVATGNMGVGKDGEPTENFQLGMELHAKYTLFAEGCRGHLGRQLISKFKLDANADPQAYGIGIKELWEIDPAKHKPGLVIHTAGWPLKSDTYGGSFLYHMDNNQVVVGFVVGLGYTNPYLSPFEEFQRYKTHPSIRAFLEGGKRVSYGARAITAGGLLSLPKTVFPGGALIGDDAGFLNASRIKGSHAAIKTGMLAADAAFDAVQAGRQSDELNAYPDAFKQSWLYTELYRARNFKQWMAKGLYLGTLMVGLEQKVMGGNVPWTLHHKHADHEMLKPASQCTPIEYPKPDGKLTFDRLSSVFISNTNHEENQPAHLTLKDANVPVNVNLRTYGGPEARFCPAAVYEFVKNDDGGDRLVINAQNCVHCKTCDIKDPTQNIVWVTPEGGGGPNYPNM

SEQ ID NO: 100765 - DNA, 1764 bp, Rhodoferax ferrireducens DSM 15236
  CDS (1)..(1764): transl_table=11
atggggcacccaaaaccttggtcctgttcagttagaccggatcttgatgaaatttacggcccgagaaatagtatgacaaaccaggaaatcttggcccagtttggcccccgtgaagcgatggaatacgacgtcgttgttgttggaggcggcgttgccggcctgtccaccgccatccgcctcaagcagctggctactgaaaaaggccaggagctgtcggtggtggtgctggaaaaaggcgccgagcccggcgcccacatcctctcgggcgccatcatggatcccatcgccatgaatgaactgttccccgactggaaggccatgggcgcgcccctgaaccagccggtgaccgatgacgccatgatgttcctcagtgaaacgtcaggctatcgcacccccaattttctgctgcccaaatgcagccataaccacggcaactacatcatcagtctgggcgagctgacgcgctggctggcgacccaggccgaaaacatgggtgtggaaatattccccggctttgccgccgctgaagtgctttacaccgaacaaggtgctgtcaggggggtcgccaccggcaacatgggcgtgaacaaggagggcgagccgggcgagaatttccagatcggcatggagctgttggcgaaatacaccatttttgccgaaggctcgcgcggtcatctggggcgccagctgattgccaagtacaagcttgacgagggctgtgatccgcaaagttatggtttgggcatcaaggaggtttgggaggtggacccctcgcgccaccagcctgggtttgccatgcacaccgcaggctggccgctggacaacagcacctacggcggctccttcatgtaccacatgggggacaacaagatcgccttgggcttcatcaccgggctgaactaccaaaacccattcttaagcccgttcgaggagttccagcgctggaaaacccatcccaatgtgcgctggtattttgagaacgacaagggcgaagtcaccgccaagcggctggcctatggtgcgcgcaccatcaccgccggcggtttgctggcactgcccaagaccgtgttcccgggcggcgccctggtgggttgcgaagcgggcttcctgaacgtgagccgcatcaagggcagccacacggccatcaagaccggcatgctggcagccgaggcggcgtttgaggccgtcacggccggacgccagcatgacgaactgagcgcctatcccgaggcgtttgagaacagttgggtctataccgagctcaacaaatcgcgcaacttcaaggcctggttcaagtatggcttgcgcatcagcaccctgatgaatggtttcgagcagttcggactggggggcaacatgccctggaccattcaccgtgacaagcccgaccatgcctacctcaagcccgccgccgagtgccagcccattgtttaccccaagcccgacggcaagctcacctttgaccgcttgagcagtgtcttcatcggcaacgtcaaccatgaagaaaatcagcccgcgcacttgacactcaaagacgcgtcggtgccggttgccatcaacctggccaagtttgccggccccgaggcgcgctactgcccggccggggtttatgagtttgtcaagaacgatgacggcaccgaccgactgcagatcaacgcctccaactgcgtgcactgcaagacctgcgacatcaaggacccgacgcagaacatcgtctgggtcacgcccgaagggggcggtggacccaactacgcggggatgtag

SEQ ID NO: 100766 - protein, 587 aa, Rhodoferax ferrireducens DSM 15236
MGHPKPWSCSVRPDLDEIYGPRNSMTNQEILAQFGPREAMEYDVVVVGGGVAGLSTAIRLKQLATEKGQELSVVVLEKGAEPGAHILSGAIMDPIAMNELFPDWKAMGAPLNQPVTDDAMMFLSETSGYRTPNFLLPKCSHNHGNYIISLGELTRWLATQAENMGVEIFPGFAAAEVLYTEQGAVRGVATGNMGVNKEGEPGENFQIGMELLAKYTIFAEGSRGHLGRQLIAKYKLDEGCDPQSYGLGIKEVWEVDPSRHQPGFAMHTAGWPLDNSTYGGSFMYHMGDNKIALGFITGLNYQNPFLSPFEEFQRWKTHPNVRWYFENDKGEVTAKRLAYGARTITAGGLLALPKTVFPGGALVGCEAGFLNVSRIKGSHTAIKTGMLAAEAAFEAVTAGRQHDELSAYPEAFENSWVYTELNKSRNFKAWFKYGLRISTLMNGFEQFGLGGNMPWTIHRDKPDHAYLKPAAECQPIVYPKPDGKLTFDRLSSVFIGNVNHEENQPAHLTLKDASVPVAINLAKFAGPEARYCPAGVYEFVKNDDGTDRLQINASNCVHCKTCDIKDPTQNIVWVTPEGGGGPNYAGM

SEQ ID NO: 100767 - DNA, 1719 bp, Rhodoferax ferrireducens DSM 15236
  CDS (1)..(1719): transl_table=11
atgccccattatcagatgagttcaaccatgacaaaccaggaaatcttggcccagtttggcccccgcgaagcgatggaatacgacgtcgttgttgttggaggcggcgttgccggcctgtccaccgccatccgcctcaagcaactggccactgaaaaaggccaggagctgtcggtggtggtgctggaaaaaggcgccgagcccggcgcccacatcctctcgggcgccatcatggatcccgttgccatgaatgaactgttccccgactggaaggccatgggcgcgcccctgaaccagccggtgaccgatgacgccatgatgttcctgagtgaaacctcgggctatcgcacgcccaattttctgctgcccaaatgcagccataaccacggcaactacatcatcagcctgggcgagctgacgcgctggctggcgacccaggccgaaaacatgggcgtggaaatattccccggctttgccgccgctgaagtgctttacagcgagcaaggcgccgtcagaggggtcgccaccggcaatatgggtgtgaacaaggaaggcgaaccgggcgagaatttccagatcggcatggagctgttggccaaatacaccatttttgccgaaggctcacgcggtcatctggggcgccagctgattgccaagtacaagcttgacgagggctgtgatccgcaaagttatggtttgggcatcaaggaggtttgggaggtggacccctcgcgccaccagcctggctttgccatgcacaccgcaggctggccgctggacaacagcacctacggcggctccttcatgtaccacatgggggacaacaagatcgcgctgggcttcatcaccgggctgaactaccagaacccattcttaagcccgttcgaggagttccagcgctggaaaacccatcccaatgtgcgctggtattttgagaacgacaagggcgaagtcaccgccaagcggctggcctatggtgcgcgcaccatcaccgccggcggtttgctggcgctgcccaagaccgtgttcccgggcggcgccctggtgggttgcgaagcgggcttcctgaacgtgagccgcatcaagggcagccacacggccatcaagaccggcatgctggcagccgaggcggcgtttgaggccgtcacggccggacgccagcatgacgaactgagcgcctaccccgaggcgtttgagaagagctgggtctataccgaactcaataaatcgcgcaacttcaaggcctggttcaagtacggcttgcgcatcagcaccctgatgaacggtttcgagcagttcggactggggggcaacatgccctggaccattcaccgtgacaagcccgaccatgcctacctgaaaccagccgccgagtgccaacccattgtttaccccaagcccgacggcaagctcacctttgaccgcttgagcagcgtcttcatcggcaacgtcaaccatgaagaaaatcagcccgcgcacttgacactcaaagacgcgtcggtgccggttgccatcaacctggccaagtttgccggccccgaggcgcgctactgcccggccggggtttatgagtttgtcaagaacgatgacggcaccgaccgactgcagatcaacgcttccaactgcgtgcactgcaagacctgcgacatcaaggacccgacgcagaacatcgtctgggtcacgcccgaagggggcggtgggccgaactacgcggggatgtag

SEQ ID NO: 100768 - protein, 572 aa, Rhodoferax ferrireducens DSM 15236
MPHYQMSSTMTNQEILAQFGPREAMEYDVVVVGGGVAGLSTAIRLKQLATEKGQELSVVVLEKGAEPGAHILSGAIMDPVAMNELFPDWKAMGAPLNQPVTDDAMMFLSETSGYRTPNFLLPKCSHNHGNYIISLGELTRWLATQAENMGVEIFPGFAAAEVLYSEQGAVRGVATGNMGVNKEGEPGENFQIGMELLAKYTIFAEGSRGHLGRQLIAKYKLDEGCDPQSYGLGIKEVWEVDPSRHQPGFAMHTAGWPLDNSTYGGSFMYHMGDNKIALGFITGLNYQNPFLSPFEEFQRWKTHPNVRWYFENDKGEVTAKRLAYGARTITAGGLLALPKTVFPGGALVGCEAGFLNVSRIKGSHTAIKTGMLAAEAAFEAVTAGRQHDELSAYPEAFEKSWVYTELNKSRNFKAWFKYGLRISTLMNGFEQFGLGGNMPWTIHRDKPDHAYLKPAAECQPIVYPKPDGKLTFDRLSSVFIGNVNHEENQPAHLTLKDASVPVAINLAKFAGPEARYCPAGVYEFVKNDDGTDRLQINASNCVHCKTCDIKDPTQNIVWVTPEGGGGPNYAGM

SEQ ID NO: 100769 - DNA, 1719 bp, Rhodoferax ferrireducens DSM 15236
  CDS (1)..(1719): transl_table=11
atgccccattatcagatgagttcaaccatgacaaaccaggaaatcttggcccagtttggcccccgcgaagcgatggaatacgacgtcgttgttgttggaggcggcgttgccggcctgtccaccgccatccgcctcaagcaactggccactgaaaaaggccaggagctgtcggtggtggtgctggaaaaaggcgccgagcccggcgcccacatcctctcgggcgccatcatggatcccgttgccatgaatgaactgttccccgactggaaggccatgggcgcgcccctgaaccagccggtgaccgatgacgccatgatgttcctgagtgaaacctcgggctatcgcacgcccaattttctgctgcccaaatgcagccataaccacggcaactacatcatcagcctgggcgagctgacgcgctggctggcgacccaggccgaaaacatgggcgtggaaatattccccggctttgccgccgctgaagtgctttacagcgagcaaggcgccgtcagaggggtcgccaccggcaatatgggtgtgaacaaggaaggcgaaccgggcgagaatttccagatcggcatggagctgttggccaaatacaccatttttgccgaaggctcacgcggtcatctggggcgccagctgattgccaagtacaagcttgacgagggctgtgatccgcaaagttatggtttgggcatcaaggaggtttgggaggtggacccctcgcgccaccagcctgggtttgccatgcacaccgcaggctggccgctggacaacagcacctacggcggctccttcatgtaccacatgggggacaacaagatcgccttgggcttcatcaccgggctgaactaccaaaacccattcttaagcccgttcgaggagttccagcgctggaaaacccatcccaatgtgcgctggtattttgagaacgacaagggcgaagtcaccgccaagcggctggcctatggtgcgcgcaccatcaccgccggcggtttgctggcactgcccaagaccgtgttcccgggcggcgccctggtgggttgcgaagcgggcttcctgaacgtgagccgcatcaagggcagccacacggccatcaagaccggcatgctggcagccgaggcggcgtttgaggccgtcacggccggacgccagcatgacgaactgagcgcctatcccgaggcgtttgagaacagttgggtctataccgagctcaacaaatcgcgcaacttcaaggcctggttcaagtatggcttgcgcatcagcaccctgatgaatggtttcgagcagttcggactggggggcaacatgccctggaccattcaccgtgacaagcccgaccatgcctacctcaagcccgccgccgagtgccagcccattgtttaccccaagcccgacggcaagctcacctttgaccgcttgagcagtgtcttcatcggcaacgtcaaccatgaagaaaatcagcccgcgcacttgacactcaaagacgcgtcggtgccggttgccatcaacctggccaagtttgccggccccgaggcgcgctactgcccggccggggtttatgagtttgtcaagaacgatgacggcaccgaccgactgcagatcaacgcctccaactgcgtgcactgcaagacctgcgacatcaaggatccgacgcagaacatcgtctgggtcacgcccgaagggggcggtggacccaattacgcggggatgtga

SEQ ID NO: 100770 - protein, 572 aa, Rhodoferax ferrireducens DSM 15236
MPHYQMSSTMTNQEILAQFGPREAMEYDVVVVGGGVAGLSTAIRLKQLATEKGQELSVVVLEKGAEPGAHILSGAIMDPVAMNELFPDWKAMGAPLNQPVTDDAMMFLSETSGYRTPNFLLPKCSHNHGNYIISLGELTRWLATQAENMGVEIFPGFAAAEVLYSEQGAVRGVATGNMGVNKEGEPGENFQIGMELLAKYTIFAEGSRGHLGRQLIAKYKLDEGCDPQSYGLGIKEVWEVDPSRHQPGFAMHTAGWPLDNSTYGGSFMYHMGDNKIALGFITGLNYQNPFLSPFEEFQRWKTHPNVRWYFENDKGEVTAKRLAYGARTITAGGLLALPKTVFPGGALVGCEAGFLNVSRIKGSHTAIKTGMLAAEAAFEAVTAGRQHDELSAYPEAFENSWVYTELNKSRNFKAWFKYGLRISTLMNGFEQFGLGGNMPWTIHRDKPDHAYLKPAAECQPIVYPKPDGKLTFDRLSSVFIGNVNHEENQPAHLTLKDASVPVAINLAKFAGPEARYCPAGVYEFVKNDDGTDRLQINASNCVHCKTCDIKDPTQNIVWVTPEGGGGPNYAGM

SEQ ID NO: 100771 - DNA, 1728 bp, Leishmania major
  CDS (1)..(1728)
atgctgcgctggacttcgcgctacttgtgtgcctccgctgcggctgctgcggggcctgaggtgcaccgtgacgtcgaggagttcgctgttgtcattgtcggcggtggcccttcgggactctcggctgctattcggctgaagcagctcgccggggaccagagggactctttccgcgtcggcctcgttgaaaagggcagcgagattggcgcccacacgctctccggcgcctgcgtggaacctcacgggttggatgagttgctgcccggatggcgtgagcaggagggatccgttctttccagcatgacgcccgtcacgtccgacgccttccatgtgctgatagggccgtcacgaagcgtgaaggtgccgtggctgccctcgacgctgcacaatcgcggtaactacatcacgtctctcggtggcatatgcaagtggcttggcgagcaggccgaggcgctcggggtggagatctaccccggctttgcggcggcagacgtcgtcgttgacgaggcgaccggcgccgtgacaggggtgcagctgaatgacaggggcgtcgacaagagtggcaggaggacggcgcagtacgagcccggcatgatcttccgcgcgaagcagaccatcttcgccgagggctgccgcggatcctgcaccaagcagttggagaagcgctttgggctgcgcaccgccgacaacccgcagacgttcgggctcggtatcaaggaggtgtgggaggtgcccaaagagcggcaccacccaggcaccgtcatgcacacggtggggtggccgacgacggacaaggggcacgacaatacctacggcggtgccttcctctaccactacggcgacgggctcatttcgtgcggctacgtggtgggcctcgactactcgaacccgtactgccggccgtacatggagatgcagaagtggaagacgcatgatctcattcgagggcagctggagggtggccgaccgatcctgtacggtgcgcgcacgttggtcgagggcggcttcagcgcgttgccgaagctgcacttccccggcggcgtgctggcgggggactgcgctggtttcttgaaccttccaaagatcaagggcacgcacacggccatgaagtctggcatgctggctgccgaggccgtctacgaggacgccttcaagggcggcaaggaggaggcggccagcggcgtggaatgcaagagctacgacgactgcttccgtagcagctggctgtacaaggagctctacacggtgcgcaacgtgcggcagagcttctacaagagcttcaagtggggcatgctgtacaccggcatcacctcactcctgctgcacggccgcgaaccgtggacgctgaagcacaccacaccagacaacttgtcgctgaaaccggcgaaggaatgcgtggagattaagtacccgaagcctgacggcacactcaccttcgacctactcaccaaccacagccgtagcgggacggcccacaatgctgaccagccctgccatctgcgcttgaaggactccaaggttgcggaggaggtgaatctgaaggcgtatgctgggccggaggcgcgcttctgcccagctggcgtgtacgagttcgtcaacgacaagcttgtgattaacgcgcagaattgcctccactgcaaggcgtgcgacatcaaggacccgacgcagaatattaactggacggtgcccgagggcggcggtggccccaactaccagggccagatgtaa

SEQ ID NO: 100772 - protein, 575 aa, Leishmania major
MLRWTSRYLCASAAAAAGPEVHRDVEEFAVVIVGGGPSGLSAAIRLKQLAGDQRDSFRVGLVEKGSEIGAHTLSGACVEPHGLDELLPGWREQEGSVLSSMTPVTSDAFHVLIGPSRSVKVPWLPSTLHNRGNYITSLGGICKWLGEQAEALGVEIYPGFAAADVVVDEATGAVTGVQLNDRGVDKSGRRTAQYEPGMIFRAKQTIFAEGCRGSCTKQLEKRFGLRTADNPQTFGLGIKEVWEVPKERHHPGTVMHTVGWPTTDKGHDNTYGGAFLYHYGDGLISCGYVVGLDYSNPYCRPYMEMQKWKTHDLIRGQLEGGRPILYGARTLVEGGFSALPKLHFPGGVLAGDCAGFLNLPKIKGTHTAMKSGMLAAEAVYEDAFKGGKEEAASGVECKSYDDCFRSSWLYKELYTVRNVRQSFYKSFKWGMLYTGITSLLLHGREPWTLKHTTPDNLSLKPAKECVEIKYPKPDGTLTFDLLTNHSRSGTAHNADQPCHLRLKDSKVAEEVNLKAYAGPEARFCPAGVYEFVNDKLVINAQNCLHCKACDIKDPTQNINWTVPEGGGGPNYQGQM

SEQ ID NO: 100773 - DNA, 1806 bp, Tetraodon nigroviridis
  CDS (1)..(1806)
atgcggacctgttcgtcagtggcaacacctcgcatcacaacacactacagcatccatcccagagatcaagattcgagatgggaagcagccatccgcttaaagcagcttgccaaccaacatgagaaggagctgcgagtgtgccttgtggagaaggcctcgcagattggtgcacatactctgtcgggggcctgcttggagcccagcgccctcaccgagctcttccctgattggaaggaacggggggcacccttgaacactccagtgactgaagacgtgttcagtattttaacggcgaaacacagaattcctgttcccctgttgccaggtctgcctatggtaaatcatggtaattacatcgtgaggttggggaactttgtccgctggctgggggagcaggctgaggagctgggagtggagatctatcctctgacgccgcagctgaatattaatcttttcacctcactgttttttgacaaggttttatttcatgaagatgggagtgtgaagggaatcgctaccaacgatgttggcattgctaaggacggctcaccgaaggatgtttttgagagaggaatggagctccacgccaaagtcaccttatttggtgagggctgccacggccacttggctaagcagctctataagcgcttcaatctgcgtgaaaattgtgaaccgcagacctacgctatcggcctgaaggagctgtggtccattgatgcaaagaagtggaggccaggcagagtggaacattccgtgggctggcctctcaacaggaacacctacggaggatcttttctttatcatctaaatgaaggcgaaccactcgtggccttgggctttgtggttggacttgactacaacaatccttatttaagccccttcagggagttccagcgctggaagcatcacccgttcgttgctccgactctagaggggggccagagaatcgcatatggagccagagcactgaatgaaggaggaatccagtccatcccgaaactgacgttccctggaggaatactgattggctgcagccccggttttatgaatgtcccaaagatcaaaggcacccacacagctatgaagagtggcatgttggctgccgaggccattttccccagagtcacggcagagaacccagactcagagacagcaggtacaacgactacatgtcgcaaaaagaattttacttgtcgaatgttgggtattaacactggttcttttttcatggctgcagggctccacatacctgagtatgctgataacctgaagcagtcgtgggtgtggaaggagctgcattcagtcagaaacataaggccgtctttccataactactttggcctgtatggtggcatgatctacactgggatcttctactggatcctgaggggaaaagagccatggactctcaaacactgtggtcctgatgcagaccagctgaagccggctaaagattgtacgcctattgaataccccaaacctgacggcaagataagcttcgacctgctctcctccgtggccttgagcggcaccaaccatgaaggggaccagcccccccacctgactctaaaggatgacggcgtcccagttggccggaacctggccatatacgacgggccggagcagcgtttctgccctgcaggtgtgtatgagtatgttcccatggaaactggagacgggatgagattgcagataaacgcgcaaaactgtgtccattgcaagacctgtgacatcaaggacccgagccaaaacattaactgggtggtgccagaaggcggaggcggaccagcctacaacgggatgtag

SEQ ID NO: 100774 - protein, 601 aa, Tetraodon nigroviridis
MRTCSSVATPRITTHYSIHPRDQDSRWEAAIRLKQLANQHEKELRVCLVEKASQIGAHTLSGACLEPSALTELFPDWKERGAPLNTPVTEDVFSILTAKHRIPVPLLPGLPMVNHGNYIVRLGNFVRWLGEQAEELGVEIYPLTPQLNINLFTSLFFDKVLFHEDGSVKGIATNDVGIAKDGSPKDVFERGMELHAKVTLFGEGCHGHLAKQLYKRFNLRENCEPQTYAIGLKELWSIDAKKWRPGRVEHSVGWPLNRNTYGGSFLYHLNEGEPLVALGFVVGLDYNNPYLSPFREFQRWKHHPFVAPTLEGGQRIAYGARALNEGGIQSIPKLTFPGGILIGCSPGFMNVPKIKGTHTAMKSGMLAAEAIFPRVTAENPDSETAGTTTTCRKKNFTCRMLGINTGSFFMAAGLHIPEYADNLKQSWVWKELHSVRNIRPSFHNYFGLYGGMIYTGIFYWILRGKEPWTLKHCGPDADQLKPAKDCTPIEYPKPDGKISFDLLSSVALSGTNHEGDQPPHLTLKDDGVPVGRNLAIYDGPEQRFCPAGVYEYVPMETGDGMRLQINAQNCVHCKTCDIKDPSQNINWVVPEGGGGPAYNGM

SEQ ID NO: 100775 - DNA, 1794 bp, Caenorhabditis briggsae
  CDS (1)..(1794)
atgcggataagcggtgtcacactgtttcgcgtctcctcacagcttcgcaacgtcgtcaacggacaatggacgactactcactacacaatcaaggatcgtgccactgatcctcgctggaaagatgtggatatgtcgagagaaagcgatgtttatgatgttgtcatcgttggaggaggtccatctggtctatcagctgcgattcggttgagacagctggcggagaaggcccagaaagaactccgagtctgtgtcgtcgagaaagcgtcggtgatcggaggacacacactgtccggagctgtaattgagacgcgtgcactcgacgagctcattccaaattggaaggaactcggagctcctgtccatcagaaggtctcttctgaatctatcgctattctaactgaaactggacgtatcccggtcccagtgttccctggagtgccactagccaaccatggtaattacattgttcgtcttggaaaagtggttcaatggcttggagagcaagcagaggctgctggagtcgaagtttggccagaaatcgctgcctctgaagttctttacaacgaggatggaagtgtgaagggaattgctacaaatgacgttggaatcgggaaggatggagcgccgaaggatggattcgcacgtggaatggaattccatgcaaaatgtacgatcttcgctgaaggatgtagagggcatttgagtaagcaggttttggacaaatttgatttgcgatctcatgcgatgacctatggaatcgggttgaaggagttgtgggaaatcgatccagctaagcatagaccaggatatgtggagcatactatgggatggccattgaacgttgatcaatacggaggatccttcctgtaccacatcgaagacgctggacaaccgctcgtctctgttggattcgttgtcgccctagactacgccaatcccaacatgaatccatacaaagaattccaaaagtacaaaactcatccatcgatttcaaaacaactagagggaggcaaaataatcggttatggagcacgtgctctgaatgaaggaggcttccaaagtatcccgaaattgcacttccctggaggatgtcttgtcggatgctctgctggattcttgaacgtcgccaaactgaagggaactcatagtgcgatgaagagtggaatggttgcagctgaagcgatatttgaagagcttcaagcgaaaggagaggatgttcaaactattgatcctgcgaattatgataagaatgtgagggatacttatgttgtgaaagagctcaaagccactagaaacattcgaccatcattcaacacttctcttggatacatcggaggattgatctattctggactcttctatgtatttggtcgtggaatggagccatggactcttggacacggaaagaaggataatgagaaattgatttctgttaaggatgccaaggagattgactatccaaaaccagatggaaaattgactttcgatcttctcacgtctgtttccttgactggaaccaatcatactgaagatcaaccagctcatttgacgctgaaaaatgatcaagtgccagttgatgtgaatttggctgtgtttggaggaccagaagctagattctgtccagctggagtctacgaattcgtcccttctgaagccgacgaaacgaagaagcgtctccaaatcaacgctcaaaactgcattcactgcaaaacctgcgacatcaaggatccccagcagaacatcaactgggtgacaccagaaggaggcggcggaccgaaatacgagggaatgtag

SEQ ID NO: 100776 - protein, 597 aa, Caenorhabditis briggsae
MRISGVTLFRVSSQLRNVVNGQWTTTHYTIKDRATDPRWKDVDMSRESDVYDVVIVGGGPSGLSAAIRLRQLAEKAQKELRVCVVEKASVIGGHTLSGAVIETRALDELIPNWKELGAPVHQKVSSESIAILTETGRIPVPVFPGVPLANHGNYIVRLGKVVQWLGEQAEAAGVEVWPEIAASEVLYNEDGSVKGIATNDVGIGKDGAPKDGFARGMEFHAKCTIFAEGCRGHLSKQVLDKFDLRSHAMTYGIGLKELWEIDPAKHRPGYVEHTMGWPLNVDQYGGSFLYHIEDAGQPLVSVGFVVALDYANPNMNPYKEFQKYKTHPSISKQLEGGKIIGYGARALNEGGFQSIPKLHFPGGCLVGCSAGFLNVAKLKGTHSAMKSGMVAAEAIFEELQAKGEDVQTIDPANYDKNVRDTYVVKELKATRNIRPSFNTSLGYIGGLIYSGLFYVFGRGMEPWTLGHGKKDNEKLISVKDAKEIDYPKPDGKLTFDLLTSVSLTGTNHTEDQPAHLTLKNDQVPVDVNLAVFGGPEARFCPAGVYEFVPSEADETKKRLQINAQNCIHCKTCDIKDPQQNINWVTPEGGGGPKYEGM

SEQ ID NO: 100777 - DNA, 1851 bp, Xenopus laevis
  CDS (1)..(1851)
atgttaccactgtgtaaacatacactacacgcacatcgctgctttgcttacttcacaacactaaagaattgccttccttcttactgtctgaagagatgggcttcttcctctgtgcctcgcatcacaacacactataccatctacccacggggccaggaccaaagatgggaaggggtgaacatggaaagatttgcagaggaagcagatgttgttatagtaggaggtggtcctgcaggactctctgcagcaatacgtctcaagcaactagcagctgagtgtgacaaagagctacgtgtgtgcctagtggagaaaggagcacagattggggcacacattttgtcaggtgcttgccttgaacctcgagccttggaagagcttttccctgactggaaggaacgaggggctcctctaaatactcctgtgactgaagacaagtttggaatattaacaaaaaaacacagaatccctgtccctatccttccaggactgccaatgaataaccatggaaattacattgtacgccttggccattttgttagctggcttggggaacaggcagaagctcttggagttgagatatatcctggctatgctgctgcagaggtactttttcatgaagatggcagtgttaagggcatagcaactaatgatgttggcatccataaggatggctctcccaagtctacttttgaacgtggcttggaactgcatgccaaagtaaccatctttggggaaggttgccacgggcatcttgccaagcagttatacaacaaatttaatctgcgacagagctgtgagccacagacctatgcaattgggcttaaagagctgtgggttattgatgagaagaaatggaagccaggctgtgttgaacatacagtgggttggcctttggatagacacacgtatggaggttcattcctttaccaccttaatgaaggagagccccttgttgcgattgggcttgtggttggattagattatcaaaatccatatgtgaacccctttagagaattccagaggtggaaacaccaccccagtatagtgccaacacttgaaggtggaaccaggattgcctatggagctagagcattaaatgaaggaggctttcagtctttgccgaaactcaccttccctggcggtatacttgttgggtgcagtcctggattcatgaatgtgcccaaaattaaagggacacacacagctatgaagagtggtatgttggctgcggaaaccatctttaaacaactgacagatgagaacatccagtcaaaaacgcaagggcttgatgtaccagagtatgaagaacaactgaagaagtcatgggtttggaaggagctatactctgtacgcaatattagaccttcttgccatgggcctttgggtttgtatggtggtatgatctatactggaatcttctactggttactaagaggaaaggagccatggacattaaagcacaaaggtttggatagtcagcagttaaaacctgcgaaggactgcataccaattgagtatccaaaaccagatgggaagctgagctttgacctcctatcatctgttgctctcagtggtactaatcatgaacacgaccagcctgcgcatcttactttaaaggatgacagcacaccggtgaatagaaatctggcaatatttgatggaccagagcagagattctgcccagctggagtatatgaatatgttcctctggaatcaggagagggatcccggttacaaatcaatgcacagaactgtgttcactgcaaaacatgtgatattaaagatccaagtcagaatataaattgggttgtaccagaaggtgggggaggacccgcatacaatggcatgtaa

SEQ ID NO: 100778 - protein, 616 aa, Xenopus laevis
MLPLCKHTLHAHRCFAYFTTLKNCLPSYCLKRWASSSVPRITTHYTIYPRGQDQRWEGVNMERFAEEADVVIVGGGPAGLSAAIRLKQLAAECDKELRVCLVEKGAQIGAHILSGACLEPRALEELFPDWKERGAPLNTPVTEDKFGILTKKHRIPVPILPGLPMNNHGNYIVRLGHFVSWLGEQAEALGVEIYPGYAAAEVLFHEDGSVKGIATNDVGIHKDGSPKSTFERGLELHAKVTIFGEGCHGHLAKQLYNKFNLRQSCEPQTYAIGLKELWVIDEKKWKPGCVEHTVGWPLDRHTYGGSFLYHLNEGEPLVAIGLVVGLDYQNPYVNPFREFQRWKHHPSIVPTLEGGTRIAYGARALNEGGFQSLPKLTFPGGILVGCSPGFMNVPKIKGTHTAMKSGMLAAETIFKQLTDENIQSKTQGLDVPEYEEQLKKSWVWKELYSVRNIRPSCHGPLGLYGGMIYTGIFYWLLRGKEPWTLKHKGLDSQQLKPAKDCIPIEYPKPDGKLSFDLLSSVALSGTNHEHDQPAHLTLKDDSTPVNRNLAIFDGPEQRFCPAGVYEYVPLESGEGSRLQINAQNCVHCKTCDIKDPSQNINWVVPEGGGGPAYNGM

SEQ ID NO: 100779 - DNA, 1671 bp, Mus musculus
  CDS (1)..(1671)
atggagaggtttgcagaagaagcagatgtggtcatagttggtgccggcccagcaggactctctgcagctattcggctaaagcagctggctgctgaacaggggaaggacatccgtgtgtgtctggtggagaaagctgctcagatcggagcacacacgctctcaggggcttgtcttgatccagctgccttcaaagagctcttcccagactggaaggagaaaggggctccacttaatactcctgtaacagaagacaggtttgccattttaacagagaaacacagaattcctgtgccaattcttccaggtcttccgatgaacaatcatggcaattacatcgtacgcctaggacatctggtgagctggatgggagaacaggcagaggctcttggagtcgaagtgtatcctgggtatgctgctgctgaggtcctttatcatgaagatggtagtgtaaaaggaatcgccactaatgatgtaggcatacaaaaggatggtgcaccaaagacaacatttgagagaggactggaactgcatgccaaagtcacagtctttgcagagggttgccatggacacctagccaagcagctttataagaaatttgatctgagggccagctgtgatgcacagacttacggaattggtttgaaggagttatggattattgatgaaaagaagtggaaacctggaagagtagatcacactgttggttggcccttggacagacatacttatggaggctctttcctttaccacttaaatgaaggtgaacctctagtagctgttggctttgtggttggcctcgactatcagaatccgtacctgagtccattccgagagttccagaggtggaagcatcatcccagcatccagccaaccctggaaggcgggaagaggatagcctacggagcccgagcgctcaatgaaggcggcttgcagtccataccaaaactcacttttcctggtggcttactaattggttgtagtcctggtttcatgaatgtccccaagatcaaaggtacccacacggcaatgaaaagtggaagtttggcagcagaatcaatttttaagcaactaactagtgaaaatctccagtcaaagacaacaggactccatgtaactgaatatgaggacaatttgaagcaatcctgggtatggaaagagctacacgctgttcgaaatataaggccatcttgccacgggatactgggagtatatggagggatgatttacactgggatattttactggatattgagaggaatggagccatggactctaaaacataaaggctcagactctgatcagctcaaaccagccaaggattgtacacccattgagtatccgaaacctgatggacagatcagttttgacctcttatcctctgtggctttgagtggtactaatcatgaacatgaccagccagcacatttaaccttaaaggatgacagcatacctgttaatagaaacctgtcaatatacgatgggcctgagcagcgattctgccctgcaggagtttatgaatttgttcctttggaacaaggtgatggatttcgattacagataaatgctcagaactgtgtgcactgtaaaacatgtgatatcaaagacccaagtcaaaatattaactgggtggtcccagaaggaggaggagggcctgcttacaatggcatgtaa

SEQ ID NO: 100780 - protein, 556 aa, Mus musculus
MERFAEEADVVIVGAGPAGLSAAIRLKQLAAEQGKDIRVCLVEKAAQIGAHTLSGACLDPAAFKELFPDWKEKGAPLNTPVTEDRFAILTEKHRIPVPILPGLPMNNHGNYIVRLGHLVSWMGEQAEALGVEVYPGYAAAEVLYHEDGSVKGIATNDVGIQKDGAPKTTFERGLELHAKVTVFAEGCHGHLAKQLYKKFDLRASCDAQTYGIGLKELWIIDEKKWKPGRVDHTVGWPLDRHTYGGSFLYHLNEGEPLVAVGFVVGLDYQNPYLSPFREFQRWKHHPSIQPTLEGGKRIAYGARALNEGGLQSIPKLTFPGGLLIGCSPGFMNVPKIKGTHTAMKSGSLAAESIFKQLTSENLQSKTTGLHVTEYEDNLKQSWVWKELHAVRNIRPSCHGILGVYGGMIYTGIFYWILRGMEPWTLKHKGSDSDQLKPAKDCTPIEYPKPDGQISFDLLSSVALSGTNHEHDQPAHLTLKDDSIPVNRNLSIYDGPEQRFCPAGVYEFVPLEQGDGFRLQINAQNCVHCKTCDIKDPSQNINWVVPEGGGGPAYNGM

SEQ ID NO: 100781 - DNA, 1302 bp, Rhodospirillum rubrum
  CDS (1)..(1302): transl_table=11
atggcagagcatttcgatgtaatcatcgtcggtgcgggcatggcgggcaacgccgcctcctacaccctggccaaggccggcctcaacgtcttgcagatcgagcgcggcgaatatcccgggtcgaagaacgttcagggcgccattctgtacgccaatgcggtcgagcagatcattcccggcttccgcgatgacgcgccgctggaacgccacgtcatcgaacagcgcatgtggatgctcgatgaccgctcctatgtgggcagccatttccgcagcgagaacttcaacgaggaaaagcccaaccgctacaccatcatccgcgcccagttcgacaagtggttcaaccgtcaggcccgcgacgccggggcgatggtgatctgcgagaccaccgtgctcgatctgatccgcaacgatgccggcaaggtggtgggcgtgcgctgcgaccgcgagggcggcgaggtctatgccgaggtggtcatcctctgcgacggcgtcaacgccctggtcggccagcgctcgggcatccgctccgagatcagccccgagcacgccgccctggcggtcaaggagatgcacttcctgccgcgcgaggtcatcaacgagcgcttcaacgtgcgcgatgacgaaggcgtggtcatcgaggccctgggcaccgtgacctcgggcatgttgggcaccggcttcctctataccaatggcgagagcatctcgctgggcatcggctgcatcgtgtccgatttcgtcgagaccaagatcggtccggccaagctgcttgaacgcttcaaggcccatccctcgatcgctccgctgatcaggggctccgaggtcaaggaatacgccgcccatctgatccccgaaggcggctataacgcggtgccccagctttacggcgccggctggctgatctgcggcgatgccgcccacttcctcaacgccgcccaccgcgagggctccaatctggcgctcacctccgggcggctggcggcggaaacgatcatcgcgctgaagtccgaaggcaaggcgatgaccgaggccaatctggcgctctatcgccagaagcttgaggaaagcttcgtgctgaaggacctgaagaagtataaggaccttccccacaccctgtggcgcaacaagcagttcgtgacgacctatcccgaattgatggccaaggcggcggagaatttcttccgcgtcgatggtgtcgataagctgaccaaggaaaaagacatcgtgcggagcttccgcaaggcccggggtgttctcggtctggtgggcgacgccgtcaaggtggcgagggcatggcgatga

SEQ ID NO: 100782 - protein, 433 aa, Rhodospirillum rubrum
MAEHFDVIIVGAGMAGNAASYTLAKAGLNVLQIERGEYPGSKNVQGAILYANAVEQIIPGFRDDAPLERHVIEQRMWMLDDRSYVGSHFRSENFNEEKPNRYTIIRAQFDKWFNRQARDAGAMVICETTVLDLIRNDAGKVVGVRCDREGGEVYAEVVILCDGVNALVGQRSGIRSEISPEHAALAVKEMHFLPREVINERFNVRDDEGVVIEALGTVTSGMLGTGFLYTNGESISLGIGCIVSDFVETKIGPAKLLERFKAHPSIAPLIRGSEVKEYAAHLIPEGGYNAVPQLYGAGWLICGDAAHFLNAAHREGSNLALTSGRLAAETIIALKSEGKAMTEANLALYRQKLEESFVLKDLKKYKDLPHTLWRNKQFVTTYPELMAKAAENFFRVDGVDKLTKEKDIVRSFRKARGVLGLVGDAVKVARAWR

SEQ ID NO: 100783 - DNA, 1662 bp, Rhizobium sp
  CDS (1)..(1662): transl_table=11
atgagcgaccaacgcctccccgagcgcgagagcatggaattcgacgtggtgatcgtcggcgccggtccggcgggcttggccgcagcgatccggctgaagcaggtcaatccggagctctcggtcgtcgtgctcgagaagggcgccgaggtcggcgcccatatcctctccggcgccgtcgtcgatccaatcggtatcgaccggctgctgccggactggcgcaacgacgccgaccatccgttcaagaccgaggttaccgacgaccacttcctgttcctcggcccggccggctcgatccgcctgccgaatttcctgatgccgccgctgatgaacaatcacggcaactacatcgtctcgctcggcaatgtctgtcgctggctggcgacgaaggcggaggaactcggcgtcgagatctatccgggctttgccgcgaccgaagtgctccacaacgacgagggcgcggtgatcggcgttgccaccggcgacttggggctggagcgttccggcgaaccggggccgaacttcgcccgcggcatggcgctcttgggcaaatacacgctgatcggcgagggggtgcgcggctcgctcgccaagcagctgatcgcgaaattcgatctttcgaaggatcgcgacgtccagaaattcggcatcggcctcaaggaactctgggaggtcaagccggagaaccacaggccgggcctggtgcagcactcgttcggctggccgctcggcatgaagaccggcggcggctcgttcctctaccatctcgaggacaacctcgtcgccgtcggcttcgtcgtgcatctgaactacaagaacccctggctctacccgttcgaggagttccagcgcttcaagacgcatccggcgatccgcggcaccttcgagggcggcaagcggctttcttacggcgcccgggcgatcaccgagggcggctaccagtcggtgccgaagctgtccttcccgggtggggcgctgatcggctgctcggccggcttcgtcaacgtgccgcgcatcaagggcagccacaatgccgtcttgtcgggcattctcgccgccgagaagctggcggcggcgatcgcttccggccgcgccaatgacgagccgatcgagatcgagcgcggctggcgcgacagcgccatcggccaggacctgaagaaggtgaggaacgtcaagccgctgtggtcgaagttcggcgcggcgatcggcgtggcgctcggcggcctcgacatgtggaccaacacgctgttcggcctctccctgttcggcacgctgaagcacggcaagaccgatgcccagtcgctggagccggccgccaagcaccagaagatcgactatccgaagccggacggggtgctgaccttcgaccggctgtcgtcggtgttcctgtcgaacaccaaccatgaggaagaccagccgatccacctcaaggtcaaggatccggagctgcagaagcgctcggaattggaggtctatgccggtccgtcgacgcgctactgtccggccggcgtctacgaatgggtcgagaaggacggtcagccggtcttcgtcatcaacgcccagaactgcgtgcactgcaagacctgcgacatcaaggaccccaaccagaacatcaactgggtgccgccgcagggcggcgaaggcccggtctatccgaacatgtga

SEQ ID NO: 100784 - protein, 553 aa, Rhizobium sp
MSDQRLPERESMEFDVVIVGAGPAGLAAAIRLKQVNPELSVVVLEKGAEVGAHILSGAVVDPIGIDRLLPDWRNDADHPFKTEVTDDHFLFLGPAGSIRLPNFLMPPLMNNHGNYIVSLGNVCRWLATKAEELGVEIYPGFAATEVLHNDEGAVIGVATGDLGLERSGEPGPNFARGMALLGKYTLIGEGVRGSLAKQLIAKFDLSKDRDVQKFGIGLKELWEVKPENHRPGLVQHSFGWPLGMKTGGGSFLYHLEDNLVAVGFVVHLNYKNPWLYPFEEFQRFKTHPAIRGTFEGGKRLSYGARAITEGGYQSVPKLSFPGGALIGCSAGFVNVPRIKGSHNAVLSGILAAEKLAAAIASGRANDEPIEIERGWRDSAIGQDLKKVRNVKPLWSKFGAAIGVALGGLDMWTNTLFGLSLFGTLKHGKTDAQSLEPAAKHQKIDYPKPDGVLTFDRLSSVFLSNTNHEEDQPIHLKVKDPELQKRSELEVYAGPSTRYCPAGVYEWVEKDGQPVFVINAQNCVHCKTCDIKDPNQNINWVPPQGGEGPVYPNM

SEQ ID NO: 100785 - DNA, 1308 bp, Rhizobium loti
  CDS (1)..(1308): transl_table=11
atgatcgagcaagaattcgacgccatcgtcgtcggggccggtatgtccggaaacgcggccgcctacaccatggcaagccagggcctgacggtgctgcagttggagcgcggcgagtatccgggctccaagaatgtccagggcgccatcatgtacgccgacatgttggagcaaatcattccggatttccgggatgatgcgcctctcgagcggcatctggtcgagcagcgattctgggtgatggacgacacctcccacaccgggatgcagtatcgatcggacgatttcaacgaggcgaagcccaatcgctacacgatcatccgcgcccaattcgacaagtggttttcgcgcaaggtgcgccaagccggcgcgacggtgctgtgcgagacgacggtgaccgaacttgtccgcagtgccagcggcaaggtgatcggcgtgcgcaccgaccgggctggcgggccgatctacgcggacgtcgtcgtgctcgcagaaggtgtcaacgggctgctcggtacacgggccggcctgcgcaagatgccgaagccagaaagcgtggcgctcgctgtcaaggaaatgcattttctacccgatgaggtcattgagcagcggttcggcctccagggcgacgaaggctgcgtgatcgaagcggcgggcacgatttcccgcagcatggccggactggccttcctctacaccaacaaggagtcgatctctctcggcatcggctgcctcgtctccgatttcgcccagacaatggagagcccttacgtcctcctcgacaacttcaaaaaccatccttcgatccggccgctgatcgcgggctcggaagtcaaggagtattccgcgcatctcattcccgaaggtggctacaaggcaattccgcagctcttcggcgacggctgggtggcggtcggtgatgccgcccaactgaacaacgctatccaccgcgagggttcgaacctcgccatgacttccggccgcatcgcgggcgaggcaatcattgagatcaagggccgcaaccagccgatgatcaggaggaacctcgccctctacaagaccatgctggacaagtccttcgtagtcaaagacctgatgaaatataaggacatgccggccctgatacacaccaattcccgcaatttcttcatgacatacccgcagttgatgtcgcaggccgcgcagaacttcatgcgggtcgacggcaccccgaaaatcgagaaggaaaaggcgaccactgctgccttcatcaaggcgcgttcgcgctgggggctgatcagcgatgtggtccgcctggcactcgcgtggcgctga

SEQ ID NO: 100786 - protein, 435 aa, Rhizobium loti
MIEQEFDAIVVGAGMSGNAAAYTMASQGLTVLQLERGEYPGSKNVQGAIMYADMLEQIIPDFRDDAPLERHLVEQRFWVMDDTSHTGMQYRSDDFNEAKPNRYTIIRAQFDKWFSRKVRQAGATVLCETTVTELVRSASGKVIGVRTDRAGGPIYADVVVLAEGVNGLLGTRAGLRKMPKPESVALAVKEMHFLPDEVIEQRFGLQGDEGCVIEAAGTISRSMAGLAFLYTNKESISLGIGCLVSDFAQTMESPYVLLDNFKNHPSIRPLIAGSEVKEYSAHLIPEGGYKAIPQLFGDGWVAVGDAAQLNNAIHREGSNLAMTSGRIAGEAIIEIKGRNQPMIRRNLALYKTMLDKSFVVKDLMKYKDMPALIHTNSRNFFMTYPQLMSQAAQNFMRVDGTPKIEKEKATTAAFIKARSRWGLISDVVRLALAWR

SEQ ID NO: 100787 - DNA, 1206 bp, Arabidopsis thaliana
  CDS (1)..(1206)
atgcatagattccttgtaaagctatcttcttcttcttcaccattctctaatcaattgagaagcttgaagaaccagcgtctgattctccctctattaccttcttcaaaaccttttacctcctcctctgtgtcaccacctccaagtcccttgaacgcttctaatcgatttgggtatccttattccgccgatttgtttcgaaatttgtcacctttaaacccaaattcgaggattttaggagtcaatgggattactagtagtagatgtatcagcagtgaagcggtcagagaatcgattgagtacgatgttctgattgtcggagctggaccggccggtttatctgctgctatacgattgaaacaactgtctcaggagaagaacattgatctatctgtttgtgtcgttgagaaaggagcagaagttggaggacacattatatctggaaatgtttttgaacccctggcacttgatgagcttcttccacattggagacaagaacatgcacccattgagatccctgcttcttctgataaattctggtttttgacgaaagatcgtgcattttcacttccttctccgtttgataacaagggaaactacgttattagtttgagccaactggtgcgttggctaggaggaaaagctgaggagcttggaacagagatatatcctggcttttctgctagtgaggtgttatttgatgcaagtgataaagttgttgggattgcaaccaaagatatgggaatatccaaagatggttccaagaaagagaatttccagccaggtgttgacataaaagggcgagttacactgtttgcagagggatgtagaggatcattgtcagagagaataatcaaaaagtataaattaagagaagaggttaatgcacaacatcaaacatatgctttgggaatcaaggaggtctgggagatagatgaaagcaaacataaccctggagaagttattcacacattgggttggcccttggatcccaagacatatggaggttctttcttgtaccacatgaacgatagacaggttgcacttggcttggttgttgccttgaactaccacaaccctttcttgaatccgtatgaggaatttcagaaactcaaacaccatcctgctattaaaggcatcttggaaggtggtaccgtgcttcagtatggagctcgtactttaaatgaaggtggttttcaggtgagttga

SEQ ID NO: 100788 - protein, 401 aa, Arabidopsis thaliana
MHRFLVKLSSSSSPFSNQLRSLKNQRLILPLLPSSKPFTSSSVSPPPSPLNASNRFGYPYSADLFRNLSPLNPNSRILGVNGITSSRCISSEAVRESIEYDVLIVGAGPAGLSAAIRLKQLSQEKNIDLSVCVVEKGAEVGGHIISGNVFEPLALDELLPHWRQEHAPIEIPASSDKFWFLTKDRAFSLPSPFDNKGNYVISLSQLVRWLGGKAEELGTEIYPGFSASEVLFDASDKVVGIATKDMGISKDGSKKENFQPGVDIKGRVTLFAEGCRGSLSERIIKKYKLREEVNAQHQTYALGIKEVWEIDESKHNPGEVIHTLGWPLDPKTYGGSFLYHMNDRQVALGLVVALNYHNPFLNPYEEFQKLKHHPAIKGILEGGTVLQYGARTLNEGGFQVS

SEQ ID NO: 100789 - DNA, 1878 bp, uncultured crenarchaeote
  CDS (1)..(1878)
atgacaatggaaagttttgatgtggcgataattggtggagggtctgctggacttgcggcacttgagcacctctccaatttgggaaaacaggcaatcctcatagaggcaggaaaaaaaataggaaccaaaaacgtgtctgggggcatattgtattccaaaaaaacagcaactggaaaggtccacaatgtagaagatgtgtttgataattttctggcagacgctccgctggaaaggaagataataaaatacatgcttcacgccgtctcaagggaaaaagcgttctctctggacctgactttggcacacgactatcaaacgaattttgggtacaccgtcctgctcaacaaactactttcatggtttgcaagggaagcatctcaaagtgcagaaaaactgggtggagggataataacaggtgtccatttaaggtcgataatctggaaagatgacagtaccataattatagagacagatgaacttgagccgttccaggtaaaggcagtcattgcagctgacggggttaactcagaggttgcgcaaataacaggtgccagaagcaagttcacaccgtctgacctctaccagggcgtaaaggtggtggcaaaattaccagaggggttgcttgaagagagattcggggtctcggaaaacgagggagcggctcaccttttttcaggcgacataacgctaaaccacattggaggagggttcctttacacaaacagggacaccatctcaattggcgcagtataccattatgactctctaattgaaaagcctacagagcccaatgcgctggtcaatgcgttactgtcaaatccgtttgtgatggaattgataaaggacgaggttccaaggatcaaggaggactacagggatctttcaaaggatgaagaactaaggattaggttcaaatccaataaattgataaaaagctggaatgacctacaccacacatattattcaccatctgccgttgcagagcttgtggcgcagggaaaatacaaatcaagggaggagatcaaggacaaaattgattcattgtacaatgagcttgtaacaaaatacaacacagaatttgaaacaaattacgtggagttagagtacagcgccaaactggttccagatggaaaaaggtgcagaatgaaaaaaccctactttaaaaacatcttatttgtcggtgatgctgcgggcaggggcattttccttgggccacgcatagagggcctcaacgtaggcattgatgacgcggttagggccgcagaagctgtctcaaagtcaatagatcaaaataactttcagtttgacaacattggtgaacgctacactaaatcagtggatgaaagtccatataccgcagacatgagcaggatcgacgcaaactatctcaaagccgttcttgattgcacaaaaaaggttcccaaaaacactcttgggtttaagtatgggtctattgtcaaattgatgtcaaatagcacctttaggaatgtatccataggaattgcaaactctatagggtacaaaaggcttttacctgtgattgagtcagacaaaacctacaatcaaattcccatcgagattgcggagagaaatggcaaagatttgcggaaaagctattccatagagattcccaccattgccgagcgtattgctaatctgaactataatgacgattcactgtcacacatcaaggttttgaactcgcaaagtgactttatgaaaaaaatggtccaactgtgccctaccaaatgctacagtattgagaatgagcggataatgctacagcacgaaggatgcatagagtgtgggacatgcgcaagagaaacagaatggaggcatcctcgtggggaaaaaggaataatctataattacgggtaa

SEQ ID NO: 100790 - protein, 625 aa, uncultured crenarchaeote
MTMESFDVAIIGGGSAGLAALEHLSNLGKQAILIEAGKKIGTKNVSGGILYSKKTATGKVHNVEDVFDNFLADAPLERKIIKYMLHAVSREKAFSLDLTLAHDYQTNFGYTVLLNKLLSWFAREASQSAEKLGGGIITGVHLRSIIWKDDSTIIIETDELEPFQVKAVIAADGVNSEVAQITGARSKFTPSDLYQGVKVVAKLPEGLLEERFGVSENEGAAHLFSGDITLNHIGGGFLYTNRDTISIGAVYHYDSLIEKPTEPNALVNALLSNPFVMELIKDEVPRIKEDYRDLSKDEELRIRFKSNKLIKSWNDLHHTYYSPSAVAELVAQGKYKSREEIKDKIDSLYNELVTKYNTEFETNYVELEYSAKLVPDGKRCRMKKPYFKNILFVGDAAGRGIFLGPRIEGLNVGIDDAVRAAEAVSKSIDQNNFQFDNIGERYTKSVDESPYTADMSRIDANYLKAVLDCTKKVPKNTLGFKYGSIVKLMSNSTFRNVSIGIANSIGYKRLLPVIESDKTYNQIPIEIAERNGKDLRKSYSIEIPTIAERIANLNYNDDSLSHIKVLNSQSDFMKKMVQLCPTKCYSIENERIMLQHEGCIECGTCARETEWRHPRGEKGIIYNYG

SEQ ID NO: 100791 - DNA, 1299 bp, Azospirillum brasilense
  CDS (1)..(1299): transl_table=11
atggtcgaaaagttcgacgccatcgtcatcggtgccggcccgtccggcaacgcggcggcctacactctggccaagcagggcctcaacgttcttcagctcgagcgcggggagtatcccggcgccaagaacgtccagggcggcatcatgtacgccgccgagctggagaagatcatcccggacttccgcgaggattgcccgaccgagcgccacatcatcgaacagcgcgtctggctgctcggcgatgacaactacatcggcaccaactaccggtcggacgccttcaacagcgacaagccgaaccgatacacgatcatccgcgccaacatcgacaagtggttctccgagaagatccgcgaggccggcggcctgcagatctgcgagaccacggtgacggagctgatccgcgacgcctccggcaaggtcatcggcgtgcgcaccgaccgcgagggcggcgagatccacgccgacgtggtcatcatggccgacggcgtgaacgccctgctcgcccgccgcaccggcttccagcaggagctggcgccgcagaacgtcgcgctggcggtcaaggaaatcctgttcatcgatcccgagctgatccagcagcgcttcggcctgaaggacgaagagggcgtggtcatcgagatcatgggcaaggtgaccaagggcatggtcggcacggcgttcctctacaccaacaaggaatcgctgacgatcggcatcggctgcctcatctccgacttcaagcagggtgccattccgccctacaagatgctggaggacctgaagaaccaccccgtcatcaagccactgatcgaaggggcggagatgaaggaatacgccgcccacatgatccccgagggcggctacaaggcggttccgcagctctacggcgacggctggatggtggtcggcgacgccacccacttcaacaacgcgcaccgcgagggctccaacctcgccatggcgtcgggccgcatggcggcggagacggtgatcgagctgaagcaggccggcaagcccttcaacgctgccaacctcgccgcctacaagaagaagctggacgacagcttcatcatgaaggacctgaagaagtaccggaacctgccgggcatcatgcacgagaacaagcagttcttcggcgcctaccccgacacgctgaccgccgccgcccacagctggttcaccgtggacagcgtggacaagaagacgaaggagaaggagatcatgaagtccttcgtcaagaagcgctcgatcatgggtctggtcggcgacgcaatcaagctggtgagggccgtgcgatga

SEQ ID NO: 100792 - protein, 432 aa, Azospirillum brasilense
MVEKFDAIVIGAGPSGNAAAYTLAKQGLNVLQLERGEYPGAKNVQGGIMYAAELEKIIPDFREDCPTERHIIEQRVWLLGDDNYIGTNYRSDAFNSDKPNRYTIIRANIDKWFSEKIREAGGLQICETTVTELIRDASGKVIGVRTDREGGEIHADVVIMADGVNALLARRTGFQQELAPQNVALAVKEILFIDPELIQQRFGLKDEEGVVIEIMGKVTKGMVGTAFLYTNKESLTIGIGCLISDFKQGAIPPYKMLEDLKNHPVIKPLIEGAEMKEYAAHMIPEGGYKAVPQLYGDGWMVVGDATHFNNAHREGSNLAMASGRMAAETVIELKQAGKPFNAANLAAYKKKLDDSFIMKDLKKYRNLPGIMHENKQFFGAYPDTLTAAAHSWFTVDSVDKKTKEKEIMKSFVKKRSIMGLVGDAIKLVRAVR

SEQ ID NO: 100793 - DNA, 1725 bp, Acinetobacter sp
  CDS (1)..(1725): transl_table=11
atgaatatgcaagaacaagaaatcgaacgcgaatcaatggagtttgacgtcgtgattgtcggcgcaggaccggccggtctttctgcagcgatcaagatccgtcaacttgcaattgaaaacaacctgaacgatctgtcggtttgtgtggtggaaaaaggctctgaagtcggtgcgcacatcttgtccggtgcggtactggaaccacgtgccatgaatgagctgttcccgaactggaaggaagaaggtgcacctttaaatgttccagtgaccgaagacaagacctatttcctgctctcggatgaaaaatcacaagaagcgccacactggatggtgcctaaaaccatgcataacgatggcaactatgttatctcgctcggcaacgtagtgcgctggttgggtcaaaaagcggaagagctggaagtatctattttcccgggctttgccgctgctgaaattctgtaccatgcagatggttcggtgaaaggcattcaaaccggtgacatgggcattggcaaggatggcgaaccgacccataactttactccgggctatgaactgcatgccaaatacaccctgtttgctgaaggctgccgtggccacctcggcaagcgtttaattgccaaatacaacctcgataaagattcagatccacaacattacggtatcggtatcaaagagctgtgggaaatcgacccggcgaaacacaagccaggtctggtgatgcacggtgccggctggccattgtctgaaaccggttcttcaggcggctggtggttgtatcatgcggaaaacaatcaggtgactttgggcatgatcgtcgatctgtcttacaccaacccgcatatgtatccgtttatggaaatgcagcgctggaaaacccatccgctgatcaagcagtatctggaaggtggcaaacgtatttcttatggcgcgcgtgcggtaaccaaaggcggctttaactcgctaccgaaatttaccttcccgggcggatcgctgattggtgacgatgccggcttcctgaactttgccaaaatcaagggctcacataccgcgatgaaatccggcatgctctgcggtgaagcagtgtttgaagccattgctgccggtgtggaaaaaggtggtgaccttgcggttgcgcgtgtgacggaaggcgaagacttgtttgccaaaaaactgacttcttacaccgacaagttcaataatagctggctgaaagaagagctgtacaactcgcgtaactttggcccggccatgcacaagtttggtcagtggctcggtggtgcgtttaactttatcgaccagaacgtgtttaaggtgccgtttaccctgcatgacctggtgacggatttcggtgcgctgaaaaccgtcgatgcggtgaacttcaagccgaattatccaaaaccggatggcaaactgacctttgaccgtctgtcttcggtgtttgtatccaacacggtgcatgaagaaaaccagccagcgcatttaaaactgactgacacttcgattccggtgaatgtcaacctgccaaaatgggatgaaccggcgcagcgctactgccccgcgggtgtatacgaaatcatggaaaatgatgacggttcgaaacgcttccagatcaatgcagccaactgtgtgcactgcaagacctgtgacatcaaggatccttcacagaacatcacctgggtaacaccggaaggtggtggtggtccaaactatccgaatatgtaa

SEQ ID NO: 100794 - protein, 574 aa, Acinetobacter sp
MNMQEQEIERESMEFDVVIVGAGPAGLSAAIKIRQLAIENNLNDLSVCVVEKGSEVGAHILSGAVLEPRAMNELFPNWKEEGAPLNVPVTEDKTYFLLSDEKSQEAPHWMVPKTMHNDGNYVISLGNVVRWLGQKAEELEVSIFPGFAAAEILYHADGSVKGIQTGDMGIGKDGEPTHNFTPGYELHAKYTLFAEGCRGHLGKRLIAKYNLDKDSDPQHYGIGIKELWEIDPAKHKPGLVMHGAGWPLSETGSSGGWWLYHAENNQVTLGMIVDLSYTNPHMYPFMEMQRWKTHPLIKQYLEGGKRISYGARAVTKGGFNSLPKFTFPGGSLIGDDAGFLNFAKIKGSHTAMKSGMLCGEAVFEAIAAGVEKGGDLAVARVTEGEDLFAKKLTSYTDKFNNSWLKEELYNSRNFGPAMHKFGQWLGGAFNFIDQNVFKVPFTLHDLVTDFGALKTVDAVNFKPNYPKPDGKLTFDRLSSVFVSNTVHEENQPAHLKLTDTSIPVNVNLPKWDEPAQRYCPAGVYEIMENDDGSKRFQINAANCVHCKTCDIKDPSQNITWVTPEGGGGPNYPNM

SEQ ID NO: 100795 - DNA, 1719 bp, Acinetobacter sp
  CDS (1)..(1719): transl_table=11
atgcaagaacaagaaatcgaacgcgaatcaatggagtttgacgtcgtgattgtcggcgcaggaccggccggtctttctgcagcgatcaagatccgtcaacttgcaattgaaaacaacctgaacgatctgtcggtttgtgtggtggaaaaaggctctgaagtcggtgcgcacatcttgtccggtgcggtactggaaccacgtgccatgaatgagctgttcccgaactggaaggaagaaggtgcacctttaaatgttccagtgaccgaagacaagacctatttcctgctctcggatgaaaaatcacaagaagcgccacactggatggtgcctaaaaccatgcataacgatggcaactatgttatctcgctcggcaacgtagtgcgctggttgggtcaaaaagcggaagagctggaagtatctattttcccgggctttgccgctgctgaaattctgtaccatgcagatggttcggtgaaaggcattcaaaccggtgacatgggcattggcaaggatggcgaaccgacccataactttactccgggctatgaactgcatgccaaatacaccctgtttgctgaaggctgccgtggccacctcggcaagcgtttaattgccaaatacaacctcgataaagattcagatccacaacattacggtatcggtatcaaagagctgtgggaaatcgacccggcgaaacacaagccaggtctggtgatgcacggtgccggctggccattgtctgaaaccggttcttcaggcggctggtggttgtatcatgcggaaaacaatcaggtgactttgggcatgatcgtcgatctgtcttacaccaacccgcatatgtatccgtttatggaaatgcagcgctggaaaacccatccgctgatcaagcagtatctggaaggtggcaaacgtatttcttatggcgcgcgtgcggtaaccaaaggcggctttaactcgctaccgaaatttaccttcccgggcggatcgctgattggtgacgatgccggcttcctgaactttgccaaaatcaagggctcacataccgcgatgaaatccggcatgctctgcggtgaagcagtgtttgaagccattgctgccggtgtggaaaaaggtggtgaccttgcggttgcgcgtgtgacggaaggcgaagacttgtttgccaaaaaactgacttcttacaccgacaagttcaataatagctggctgaaagaagagctgtacaactcgcgtaactttggcccggccatgcacaagtttggtcagtggctcggtggtgcgtttaactttatcgaccagaacgtgtttaaggtgccgtttaccctgcatgacctggtgacggatttcggtgcgctgaaaaccgtcgatgcggtgaacttcaagccgaattatccaaaaccggatggcaaactgacctttgaccgtctgtcttcggtgtttgtatccaacacggtgcatgaagaaaaccagccagcgcatttaaaactgactgacacttcgattccggtgaatgtcaacctgccaaaatgggatgaaccggcgcagcgctactgccccgcgggtgtatacgaaatcatggaaaatgatgacggttcgaaacgcttccagatcaatgcagccaactgtgtgcactgcaagacctgtgacatcaaggatccttcacagaacatcacctgggtaacaccggaaggtggtggtggtccaaactatccgaatatgtaa

SEQ ID NO: 100796 - protein, 572 aa, Acinetobacter sp
MQEQEIERESMEFDVVIVGAGPAGLSAAIKIRQLAIENNLNDLSVCVVEKGSEVGAHILSGAVLEPRAMNELFPNWKEEGAPLNVPVTEDKTYFLLSDEKSQEAPHWMVPKTMHNDGNYVISLGNVVRWLGQKAEELEVSIFPGFAAAEILYHADGSVKGIQTGDMGIGKDGEPTHNFTPGYELHAKYTLFAEGCRGHLGKRLIAKYNLDKDSDPQHYGIGIKELWEIDPAKHKPGLVMHGAGWPLSETGSSGGWWLYHAENNQVTLGMIVDLSYTNPHMYPFMEMQRWKTHPLIKQYLEGGKRISYGARAVTKGGFNSLPKFTFPGGSLIGDDAGFLNFAKIKGSHTAMKSGMLCGEAVFEAIAAGVEKGGDLAVARVTEGEDLFAKKLTSYTDKFNNSWLKEELYNSRNFGPAMHKFGQWLGGAFNFIDQNVFKVPFTLHDLVTDFGALKTVDAVNFKPNYPKPDGKLTFDRLSSVFVSNTVHEENQPAHLKLTDTSIPVNVNLPKWDEPAQRYCPAGVYEIMENDDGSKRFQINAANCVHCKTCDIKDPSQNITWVTPEGGGGPNYPNM

SEQ ID NO: 100797 - DNA, 1311 bp, Acetobacter diazotrophicus
  CDS (1)..(1311): transl_table=11
atgacacagcaccaattcgacgccatcgtcgtgggggccggcccgtcggggaacgcggcggcctatacgatggcgcagcgcggcctgcgcgtcctgcagatcgagcgcggggaatatgcgggatcgaagaacgtccagggggcgatcctgtattccgacgcgctggaacgcatcattcccgatttccgggaagacgcgccgctggaacgtcacgtgatcgaacagcggatctggatgatggacgatgccgggcataccggcatgcatcatcgcagcgacgattataacgaggaaagccccaaccgttatacgatcatccgcgcccagttcgacaaatggttcaaccgccgcgtgcgggatgccggggtgacggtgctgtatgaaaccaccgtgacccggctgatcaccgatgcgcgcaagcgcgtcgtcggcgtgcagaccgatcgcgacggcaacggcatcttcgccgatgtggtcgtcctggccgaaggcgtgaacggcctggtcggcctgcggtccgggctgcgtgacgaattgcggcccgagaacgtggccctggcggtcaaggaaatgcatttcctgccgcaggaggtgatcgacgcgcgtttcaacctcaagggcgaggaaggcgtggtgatcgaggccatgggcaccgtgaccgacggcatggtgggcacggcgttcctgtataccaaccgcgaatccatctcggtcgggatcggctgcctggtcagcgaattcgccaggagcggcgccgcgacgccgcatggcctgctggaccgcttcaaggcgcaccccagcatccgtcccctgctggaaggatcggaaatcaaggaatacgccgcccacctgatccccgagggcggatatcgcgccgtccccgaactggtgggtgacgggtggatcgtcgcgggcgatgccgggcatttcgtgaatgccgtgcaccgggaaggatcgaatctcgcgatgacgaccggtcgcatggccggcgaggtcgttgccaatatcctgacgagcggcctttcgtgctccgcgacgaacctgggggcctacaagacgctcctgaaggaatccttcgtgatgaaggacctgaagaaataccggaacgtgccgaaaatgctggaagaaggcgggtacaacatcatgaatctgtatccgcgcctggtgaaccgcgcggcacagacgtggttccgcgtggacggcgtggacaagaaggccaaggaatctgaaattctgaagaatgcatggcgcgcgcgcggtgtcgcgggcctgctgggtgacgcattcaaactggcgagggcatggcgatga

SEQ ID NO: 100798 - protein, 436 aa, Acetobacter diazotrophicus
MTQHQFDAIVVGAGPSGNAAAYTMAQRGLRVLQIERGEYAGSKNVQGAILYSDALERIIPDFREDAPLERHVIEQRIWMMDDAGHTGMHHRSDDYNEESPNRYTIIRAQFDKWFNRRVRDAGVTVLYETTVTRLITDARKRVVGVQTDRDGNGIFADVVVLAEGVNGLVGLRSGLRDELRPENVALAVKEMHFLPQEVIDARFNLKGEEGVVIEAMGTVTDGMVGTAFLYTNRESISVGIGCLVSEFARSGAATPHGLLDRFKAHPSIRPLLEGSEIKEYAAHLIPEGGYRAVPELVGDGWIVAGDAGHFVNAVHREGSNLAMTTGRMAGEVVANILTSGLSCSATNLGAYKTLLKESFVMKDLKKYRNVPKMLEEGGYNIMNLYPRLVNRAAQTWFRVDGVDKKAKESEILKNAWRARGVAGLLGDAFKLARAWR

SEQ ID NO: 100799 - DNA, 1845 bp, Psychrobacter sp
  CDS (1)..(1845): transl_table=11
atgcaagagcaagacaatcaaaagccagtcattgatagtgacactgtgaatactgacccatcagtagcgacagagacggcaaatttagataaagcagagtcagccgttgtgacccaagaagcgccagctgaaacagtcgctatcgacaaagcgccagagccagtagtagaagctgtcgcggcagagcctgagattgaacgtgaatccatggaatttgacgttatcatcgttggtggtggacctgctgggctatctgctgctatccgcctgcgtcagctcgctatcgctgctggtaatgatgagtttatggtttgtgtggtcgaaaaaggttctgagtttggtgcgcataccttatcaggtgctgtcatcgaaccacgcgctttgaacgagctgataccagactggaaagaaaaaggcgcgccgcttaatgtgccagcgaccgaagatcgcttttattatttaaactcagccacgcgctctactaaagtacctgactcgttgattccaggaccgatgcacaacaatggcaactatattgtctcattgggcaatgtggtgcgctggttggcggtgcaagctgaagagcttgaagtcatgatgttcccaggcttccctgcagatgatattttatataacgacgacggttctgtacgtggtgtcttaacgggcgatatgggtgtggctgccaatggcgaagccaagcctagctttgagccaggttatgagctacttgctaaatacattatttttgccgaaggcagccgtggtcatttaggtaagcgcttaatcagccgttttgatcttgataaagactcagatcctcagcattatggtatcggtctaaaagagctgtgggacgtagcccctgagaaacacgaacaaggcgtggtcatgcacggtcttggctggccattgaccgaaacaggatctactggtggctggtggttatacttcgatgaaaacaaccaagtaagttttggtcttgtcgctgacttgtcttaccataacccatatatgtcgccattcgatgagatgcagcgcctaaaaacccatcccgtcatcaaaaacgtattggaaggcggcaagcgtatctcttatggcgcacgtgctttaaccaaaggtggcttaaactctctaccgaaatttactttcccaggtggtgtattggtcggtgatgatgctggattcttgaacccagcaaaaatcaaaggcacacacacatcgatgaaatcaggcatgctagccgccgaagccatttttgaggcactacaagccgagcgtcagcatgatgaagtggttgcctataccaccatgtataaagagtcgtggttgtatcaagacaactatgagtcacgcaacttctcgcctgcaatacatcgcatgggtctgtttatgggcggtgcttttacctttatcgagcacaacttattaaaaggtaaaatgccgcttaccttacatgacagcctgccagattatgatcagttagagcgtgccaatcacgcttttcagccaacctacctcaagcctgatggcaaactggtatttgacaagctgtcatcggtatttatctctaatactaaccatgcagaagaccagccggtacatttgaaactgactgatccaacggtacctgtttcaattaacttaccgctatatgctgagcctgctcgtttatactgcccagctggtgtatatgaaatagtaaaagatgcggaaggagctaagtttgtgatcaatgcgcaaaactgtgtgcattgtaaaacttgtgatatcaaagatccttcacagaatatcacttgggtaacgccagaaggtggcggtggccctaactaccctaatatgtaa

SEQ ID NO: 100800 - protein, 614 aa, Psychrobacter sp
MQEQDNQKPVIDSDTVNTDPSVATETANLDKAESAVVTQEAPAETVAIDKAPEPVVEAVAAEPEIERESMEFDVIIVGGGPAGLSAAIRLRQLAIAAGNDEFMVCVVEKGSEFGAHTLSGAVIEPRALNELIPDWKEKGAPLNVPATEDRFYYLNSATRSTKVPDSLIPGPMHNNGNYIVSLGNVVRWLAVQAEELEVMMFPGFPADDILYNDDGSVRGVLTGDMGVAANGEAKPSFEPGYELLAKYIIFAEGSRGHLGKRLISRFDLDKDSDPQHYGIGLKELWDVAPEKHEQGVVMHGLGWPLTETGSTGGWWLYFDENNQVSFGLVADLSYHNPYMSPFDEMQRLKTHPVIKNVLEGGKRISYGARALTKGGLNSLPKFTFPGGVLVGDDAGFLNPAKIKGTHTSMKSGMLAAEAIFEALQAERQHDEVVAYTTMYKESWLYQDNYESRNFSPAIHRMGLFMGGAFTFIEHNLLKGKMPLTLHDSLPDYDQLERANHAFQPTYLKPDGKLVFDKLSSVFISNTNHAEDQPVHLKLTDPTVPVSINLPLYAEPARLYCPAGVYEIVKDAEGAKFVINAQNCVHCKTCDIKDPSQNITWVTPEGGGGPNYPNM

SEQ ID NO: 100801 - DNA, 1656 bp, Zymomonas mobilis
  CDS (1)..(1656): transl_table=11
atgggggaaatgtcagaacgcgaatccatggaatatgatgttgtcatcgtaggggctggacctgcaggtctttctgcagcaatccggttaaagcagctggcggaaaaaaacgatcaggatattactgtttgcgttttagaaaagggggctgaagtcggtgcccatattctttctggggctataattgaccccatcgctctcaatgaacttatcccagattggcgtgaacgaggcgccccattgactgttaaggtaacagaatccccgcattgggttttaacgcctaaaaaacatttaaccctgccatcgatatttcttccatccttcatgcataataaagggttttatacgggatcgcttggttctttatgccgttggcttgccacagaagctgaatccttaggtgtcgatatttttcccggatttgtcgcagcagatattttgtatgacgaaaatgaccaagtaaaaggtgtcattactggagatatgggcgtcggcaaagatggaaaagcaagacctgatttccagcccggtatggagctacgtggccgttataccttctttgcagaaggtgcacgtggacatcttacaaaaagagtcattcgcaaattcgagctcgacgcagaaagtcagccgcaggtttatggcttagggattaaagaactttgggaagtcttgcctgaaaagcatgtcgctggacgcgttatccatacacaaggatggccattaaaaagtgaagtcggcggcggctttatttatcaccaagaaaataatcaagtgtcattgggcttcgttgtcggcctaggttatagcaatccttctctttctcctttccaagagttccaacgctggaaagaacacccgtccattcgacccttgctggagggggggcgcaggattgcttatggtgcacgcgtcattaacgagggtggttaccaagcaattccaaaacttatttttcctggtggtgctcttattgggtgttctgctggttttgttaatgttcctcgtatcaaaggtacacatggggcaatgaaatctgctatgttagcagctgaagcggctttcgcggctatacagaaagagactccatctgatctactgcaagactatcctgataattttgaaaaaagttggcttgctgctgagctcaaaaatgccaggaatgcagaacctgctattgctcattttggtcctttaataggttctgctattgcaggaacagatctttggatgagaagtctagggatcaaattaccgtttacattagggcatcgtcctgacaattctacacttgtctccaaagataaggctaaaaagctaaattatcctaaagctgatgggacaatcagttttgatcgtttgtcatctgtttatctctcaaatacgcagcatgatgaaaatgaaccttgtcatctaaagctgaaagacccttctgtcgcgataaaggtaaattgggaagaatatgattctcccgaaagtcgttattgtccagctggggtctatgaaatcatagaagaagacagtaagccacgacttcaaataaatgcgcaaaattgcctgcactgcaaaacttgcgatatcaaagatccgactgggaatatcgaatgggtagcgcctcaaggtggcgaaggcccaaactatcccaatatgtaa

SEQ ID NO: 100802 - protein, 551 aa, Zymomonas mobilis
MGEMSERESMEYDVVIVGAGPAGLSAAIRLKQLAEKNDQDITVCVLEKGAEVGAHILSGAIIDPIALNELIPDWRERGAPLTVKVTESPHWVLTPKKHLTLPSIFLPSFMHNKGFYTGSLGSLCRWLATEAESLGVDIFPGFVAADILYDENDQVKGVITGDMGVGKDGKARPDFQPGMELRGRYTFFAEGARGHLTKRVIRKFELDAESQPQVYGLGIKELWEVLPEKHVAGRVIHTQGWPLKSEVGGGFIYHQENNQVSLGFVVGLGYSNPSLSPFQEFQRWKEHPSIRPLLEGGRRIAYGARVINEGGYQAIPKLIFPGGALIGCSAGFVNVPRIKGTHGAMKSAMLAAEAAFAAIQKETPSDLLQDYPDNFEKSWLAAELKNARNAEPAIAHFGPLIGSAIAGTDLWMRSLGIKLPFTLGHRPDNSTLVSKDKAKKLNYPKADGTISFDRLSSVYLSNTQHDENEPCHLKLKDPSVAIKVNWEEYDSPESRYCPAGVYEIIEEDSKPRLQINAQNCLHCKTCDIKDPTGNIEWVAPQGGEGPNYPNM

SEQ ID NO: 100803 - DNA, 1713 bp, Acinetobacter sp
  CDS (1)..(1713): transl_table=11
atgataacgattgaacgcgaagcgatggagtttgacgtagtgatcgttggtgctggacctgccggtctatctgctgcgattaaaattcgccaactcgcgattgaaaacaatttacctgatctgtccgtctgcgtcgtcgaaaaaggttccgaagtaggtgctcacatcctctctggtgcagtgcttgaacctcgtgccatcaatgaacttttccccaactggaaagaagaaggtgcaccgctcaatgtcccagtgactgaggataaaacctatttcctgatgtcggatgagaagtctcaggaagcaccgcactggatggtgcctaaaaccatgcacaatgatggcaattatgtcatctcgctgggcaatgtggtgcgctggttaggccagaaggcggaagagcttgaagtctctatttttccaggctttgctgctgccgagattctgtatcatgctgatggtacggttaagggtattcagacgggtgatatgggtattggcaaggatggcgaaccaacgcataactttgcgccgggttatgaactgcatgccaaatatacgctatttgccgaaggttgccgtggtcatttaggcaagcgcctgatcaataagtttaatctggatcaggatgctgacccgcagcattacggtatcgggattaaagagctttgggaaatcgatcctgccaagcataaaccaggtctggtgatgcatggttctggctggccattgtctgaaacgggttcttctggtggctggtggttatatcatgccgagaataatcaggtgactctgggcatgatcgtggatttatcgtatgaaaatccgcatatgttcccgtttatggaaatgcagcgctggaaaacccacccactgatcaaacagtatctggaaggtggtaagcgtatttcttacggtgcacgtgctgtggtcaaaggtggcttaaactcactgcccaagttgactttcccaggtggttgtctgattggtgatgatgcaggctttttgaactttgcgaaaatcaaaggctcacatacggccatgaaatctggcatgctttgcggtgaagccgtatttgaagcgattgcacgtggtgtcgacaaaggcggtgatctagccattgcccgtgtcgttgaaggtgaagatttgtttgataaggagctcaccacctacacgcagaaatttgataagagctggcttaaagaagagttacaccgcagtcgtaattttggtccagccatgcacaagtttggtttatggattggtggtgcatttaactttgtggatcagaacatttttaaagttccattcactctgcacgatcttcagcctgactacagcgcactgaaaactcaggatcaagccacctttaaaccaaactatccaaagccagatggcaagctgacgtttgaccgtttgtcttcggtatttgtatccaatacggtacatgaagaaaatcagccatcacacttgaaactgaccgatgccagtattcctgtggcggtgaatctaccaagatgggatgagccagctcagcgctactgccctgcgggtgtgtacgaaattgtggatgaaggtgaaggcaacaagcgtttccagatcaatgcagccaactgtgtacactgcaaaacctgtgatatcaaggatccatctcagaatatcacatgggtgacgcctgaaggcggcggcgggccgaattaccctaacatgtaa

SEQ ID NO: 100804 - protein, 570 aa, Acinetobacter sp
MITIEREAMEFDVVIVGAGPAGLSAAIKIRQLAIENNLPDLSVCVVEKGSEVGAHILSGAVLEPRAINELFPNWKEEGAPLNVPVTEDKTYFLMSDEKSQEAPHWMVPKTMHNDGNYVISLGNVVRWLGQKAEELEVSIFPGFAAAEILYHADGTVKGIQTGDMGIGKDGEPTHNFAPGYELHAKYTLFAEGCRGHLGKRLINKFNLDQDADPQHYGIGIKELWEIDPAKHKPGLVMHGSGWPLSETGSSGGWWLYHAENNQVTLGMIVDLSYENPHMFPFMEMQRWKTHPLIKQYLEGGKRISYGARAVVKGGLNSLPKLTFPGGCLIGDDAGFLNFAKIKGSHTAMKSGMLCGEAVFEAIARGVDKGGDLAIARVVEGEDLFDKELTTYTQKFDKSWLKEELHRSRNFGPAMHKFGLWIGGAFNFVDQNIFKVPFTLHDLQPDYSALKTQDQATFKPNYPKPDGKLTFDRLSSVFVSNTVHEENQPSHLKLTDASIPVAVNLPRWDEPAQRYCPAGVYEIVDEGEGNKRFQINAANCVHCKTCDIKDPSQNITWVTPEGGGGPNYPNM

SEQ ID NO: 100805 - DNA, 1794 bp, Caenorhabditis elegans
  CDS (1)..(1794)
atgcggataagtggagtcacattattccgcgtctcatcacaacttcgcaacgtcgtcaacggacaatggacgactactcactatactgtaaaggatcgatccactgatccacggtggaaggatgttgatttggcacgagaaagtgatgtttatgatgttgtcattgttggaggaggtccatctggtttatcagcagccattcgattgagacaattggctgaaaaagctcagaaagaacttcgtgtctgtgttgtcgaaaaggcatctgttattggagggcacactctctcaggagctgtaattgaaactcgagctcttgatgaacttattccaaattggaaagagctgggagctccagtttaccaacaagttacctctgaatctatcgctattctcactgaatctggtcgaattccagttccagtgctacctggagttccacttgcaaatcacggaaactatattgttcgtcttggaaaggtcgttcaatggctcggcgagcaggctgaagcagctggagtcgaagtttggccagaaatcgctgcatctgaagtgctctacaatgaagatggaagtgtgaagggaattgccacaagtgacgttggaattggaaaggatggagcaccgaaagatggatttgctcgtggtatggaattccacgcgaaatgcacaattttcgctgaaggatgtagaggacatttgagcaagcaagttctcgataaatttgatttgagaacacatgcaatgacttatggaattggactcaaagaactttgggaaattgatccagcaaagcatagacctggttatgttgagcatactatgggatggccattgaatgttgatcaatacggaggatccttcttgtaccatatcgaggatcaaggacaaccacttgtttccgttggtttcgttgttgctcttgattacgcgaatccaaatctcaatccatacaaagaattccaaaaatacaaaactcatccatcgatttctaaacaattggaaggaggaaaacgaattgggtacggagcacgagctctcaatgaaggaggattccaaagtatcccgaagcttcatttccccggaggatgtcttgttggatgctcagctggtttcttgaatgtcgctaaactgaagggaactcataatgcaatgaaaagtggaatggtggctgctgaatcaattttcgaggatattcaacaaaagggagaggatgtgcaaacgattgatccagctacatatgacaagaatattcgtgatacttatgttgttaaagagctcaaagcaaccagaaatattcgtccatcattcaatacttcattgggatacattggaggactgatctattctggaatattctatgttttcggtcgaggaattgaaccatggactcttggacacggaaagaaggataatgagaagctcattccagtgaaggatgcaaaagaaatcgattacccaaaaccagatggaaagctaacttttgatcttcttacatctgtatctcttactggaaccaaccatacagaagatcaacctgctcatttgacattgaaaaatgatcaagttccacttgatgtgaatttggcagtatatggtggcccggaggctagattctgtccagctggagtctatgaattcgtcccatccgaagctgatgaatcaaagaagcgtctccaaatcaatgctcaaaattgcattcactgcaagacatgcgacatcaaggatcctcaacaaaacattaactgggttacaccagaaggaggtggtggcccaaaatacgagggaatgtga

SEQ ID NO: 100806 - protein, 597 aa, Caenorhabditis elegans
MRISGVTLFRVSSQLRNVVNGQWTTTHYTVKDRSTDPRWKDVDLARESDVYDVVIVGGGPSGLSAAIRLRQLAEKAQKELRVCVVEKASVIGGHTLSGAVIETRALDELIPNWKELGAPVYQQVTSESIAILTESGRIPVPVLPGVPLANHGNYIVRLGKVVQWLGEQAEAAGVEVWPEIAASEVLYNEDGSVKGIATSDVGIGKDGAPKDGFARGMEFHAKCTIFAEGCRGHLSKQVLDKFDLRTHAMTYGIGLKELWEIDPAKHRPGYVEHTMGWPLNVDQYGGSFLYHIEDQGQPLVSVGFVVALDYANPNLNPYKEFQKYKTHPSISKQLEGGKRIGYGARALNEGGFQSIPKLHFPGGCLVGCSAGFLNVAKLKGTHNAMKSGMVAAESIFEDIQQKGEDVQTIDPATYDKNIRDTYVVKELKATRNIRPSFNTSLGYIGGLIYSGIFYVFGRGIEPWTLGHGKKDNEKLIPVKDAKEIDYPKPDGKLTFDLLTSVSLTGTNHTEDQPAHLTLKNDQVPLDVNLAVYGGPEARFCPAGVYEFVPSEADESKKRLQINAQNCIHCKTCDIKDPQQNINWVTPEGGGGPKYEGM

SEQ ID NO: 100807 - DNA, 1854 bp, Homo sapiens
  CDS (1)..(1854)
atgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaa

SEQ ID NO: 100808 - protein, 617 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 100809 - DNA, 1851 bp, Mus musculus
  CDS (1)..(1851)
atgttggtgcgactaaccaagctgtcctgccctgcgtatcactggtttcatgccttaaaaattaagaagtgcctacctctgtgtgctccaagatgttcttcaacctctgctgtacctcagattaccactcactacactgttcatccccgggagaaagacaaaagatgggaaggagtgaatatggagaggtttgcagaagaagcagatgtggtcatagttggtgccggcccagcaggactctctgcagctattcggctaaagcagctggctgctgaacaggggaaggacatccgtgtgtgtctggtggagaaagctgctcagatcggagcacacacgctctcaggggcttgtcttgatccagctgccttcaaagagctcttcccagactggaaggagaaaggggctccacttaatactcctgtaacagaagacaggtttgccattttaacagagaaacacagaattcctgtgccaattcttccaggtcttccgatgaacaatcatggcaattacatcgtacgcctaggacatctggtgagctggatgggagaacaggcagaggctcttggagtcgaagtgtatcctgggtatgctgctgctgaggtcctttatcatgaagatggtagtgtaaaaggaatcgccactaatgatgtaggcatacaaaaggatggtgcaccaaagacaacatttgagagaggactggaactgcatgccaaagtcacagtctttgcagagggttgccatggacacctagccaagcagctttataagaaatttgatctgagggccagctgtgatgcacagacttacggaattggtttgaaggagttatggattattgatgaaaagaagtggaaacctggaagagtagatcacactgttggttggcccttggacagacatacttatggaggctctttcctttaccacttaaatgaaggtgaacctctagtagctgttggctttgtggttggcctcgactatcagaatccgtacctgagtccattccgagagttccagaggtggaagcatcatcccagcatccagccaaccctggaaggcgggaagaggatagcctacggagcccgagcgctcaatgaaggcggcttgcagtccataccaaaactcacttttcctggtggcttactaattggttgtagtcctggtttcatgaatgtccccaagatcaaaggtacccacacggcaatgaaaagtggaagtttggcagcagaatcaatttttaagcaactaactagtgaaaatctccagtcaaagacaacaggactccatgtaactgaatatgaggacaatttgaagcaatcctgggtatggaaagagctacacgctgttcgaaatataaggccatcttgccacgggatactgggagtatatggagggatgatttacactgggatattttactggatattgagaggaatggagccatggactctaaaacataaaggctcagactctgatcagctcaaaccagccaaggattgtacacccattgagtatccgaaacctgatggacagatcagttttgacctcttatcctctgtggctttgagtggtactaatcatgaacatgaccagccagcacatttaaccttaaaggatgacagcatacctgttaatagaaacctgtcaatatacgatgggcctgagcagcgattctgccctgcaggagtttatgaatttgttcctttggaacaaggtgatggatttcgattacagataaatgctcagaactgtgtgcactgtaaaacatgtgatatcaaagacccaagtcaaaatattaactgggtggtcccagaaggaggaggagggcctgcttacaatggcatgtaa

SEQ ID NO: 100810 - protein, 616 aa, Mus musculus
MLVRLTKLSCPAYHWFHALKIKKCLPLCAPRCSSTSAVPQITTHYTVHPREKDKRWEGVNMERFAEEADVVIVGAGPAGLSAAIRLKQLAAEQGKDIRVCLVEKAAQIGAHTLSGACLDPAAFKELFPDWKEKGAPLNTPVTEDRFAILTEKHRIPVPILPGLPMNNHGNYIVRLGHLVSWMGEQAEALGVEVYPGYAAAEVLYHEDGSVKGIATNDVGIQKDGAPKTTFERGLELHAKVTVFAEGCHGHLAKQLYKKFDLRASCDAQTYGIGLKELWIIDEKKWKPGRVDHTVGWPLDRHTYGGSFLYHLNEGEPLVAVGFVVGLDYQNPYLSPFREFQRWKHHPSIQPTLEGGKRIAYGARALNEGGLQSIPKLTFPGGLLIGCSPGFMNVPKIKGTHTAMKSGSLAAESIFKQLTSENLQSKTTGLHVTEYEDNLKQSWVWKELHAVRNIRPSCHGILGVYGGMIYTGIFYWILRGMEPWTLKHKGSDSDQLKPAKDCTPIEYPKPDGQISFDLLSSVALSGTNHEHDQPAHLTLKDDSIPVNRNLSIYDGPEQRFCPAGVYEFVPLEQGDGFRLQINAQNCVHCKTCDIKDPSQNINWVVPEGGGGPAYNGM

SEQ ID NO: 100811 - DNA, 1851 bp, Rattus norvegicus
  CDS (1)..(1851)
atgttggtgcgactaaccaagctgtcctgccctgcatatcagtggtttcatgccttaaaaattaaaaagtgcctacctctgtgtgctccaagatgctcttcaacctctgctgtacctcagattaccactcactacactattcatccccgggaaaaagacaaaagatgggaaggagtgaatatggagagatttgcagaagaagcagatgtggtaatagttggtgccggcccagcagggctctctgcagctattcggctaaagcagctggctgctgaacaggaaaaggacatccgtgtgtgtctggtggagaaagctgctcagataggagctcatacgctctcaggggcttgccttgatccagctgcttttaaagagctcttcccagactggaaggagaagggggctccacttaacactcctgtaacagaagacaggtttgcgattttaacagagaaacacagaattcctgtgccaattcttccaggtcttccgatgaacaatcatggcaattacatcgtacgcctcggacaccttgtgagctggatgggagaacaggcagaggctctgggagttgaagtgtaccctggatatgctgctgctgaggtcctttatcatgaagatggtagtgtgaaaggaatcgccactaacgatgtgggaatacagaaggatggcgcaccaaagacaacatttgagagaggcctggagttgcatgccaaagtcacaatctttgcagaaggctgccatggacacctagccaagcagttttataaaaagtttgatttgagggccagctgtgatgcccagacttacggaattggtttgaaggagttatgggttattgatgagaagaagtggaaacctgggagagtagatcacactgttggctggcccttggacagacatacttatggaggctctttcctctatcacttaaatgaaggtgaacctctagtagctgttggttttgtggttggcctggactatcagaatccatacctgagtccattcagagagttccagaggtggaagcatcaccccagcatccgaccaaccctggaaggtgggaaaaggatagcctatggagcccgagctctcaatgaaggtggcttgcagtccataccaaaactcacttttcctggtggcttactaattggttgcagtcctggattcatgaatgttcccaagatcaaaggtacccacacagcaatgaaaagtggaagcttggcagcagaagcaatttttaagcaactaactagtgaaaatctccaatcaaagacagcaggactccacgtaactgagtatgaggacaatttgaagcaatcctgggtgtggaaagagctacatgctgtcagaaatataaggccatcctgccacgggatcctgggggtatatggagggatgatttacactggaatattttactggatattgagaggaatggagccatggactctaaaacataaaggctcagactctgaacagctcaaaccagccaaggactgtacacccattgagtatccaaaacctgacggacagatcagttttgacctcttatcctctgtggctctgagtggtactaatcatgaacatgaccagccagcacatttaaccttgaaggatgacagcatacctgttaatagaaatctgtcaatatatgatgggcctgagcagcgattctgccctgcaggagtttatgaatttgttcctctggaacaaggtgatggatttcggttacagataaatgctcagaactgtgtgcattgtaaaacatgtgatatcaaagacccaagtcaaaatattaactgggtggtcccagaaggtggaggaggacctgcttacaatggcatgtaa

SEQ ID NO: 100812 - protein, 616 aa, Rattus norvegicus
MLVRLTKLSCPAYQWFHALKIKKCLPLCAPRCSSTSAVPQITTHYTIHPREKDKRWEGVNMERFAEEADVVIVGAGPAGLSAAIRLKQLAAEQEKDIRVCLVEKAAQIGAHTLSGACLDPAAFKELFPDWKEKGAPLNTPVTEDRFAILTEKHRIPVPILPGLPMNNHGNYIVRLGHLVSWMGEQAEALGVEVYPGYAAAEVLYHEDGSVKGIATNDVGIQKDGAPKTTFERGLELHAKVTIFAEGCHGHLAKQFYKKFDLRASCDAQTYGIGLKELWVIDEKKWKPGRVDHTVGWPLDRHTYGGSFLYHLNEGEPLVAVGFVVGLDYQNPYLSPFREFQRWKHHPSIRPTLEGGKRIAYGARALNEGGLQSIPKLTFPGGLLIGCSPGFMNVPKIKGTHTAMKSGSLAAEAIFKQLTSENLQSKTAGLHVTEYEDNLKQSWVWKELHAVRNIRPSCHGILGVYGGMIYTGIFYWILRGMEPWTLKHKGSDSEQLKPAKDCTPIEYPKPDGQISFDLLSSVALSGTNHEHDQPAHLTLKDDSIPVNRNLSIYDGPEQRFCPAGVYEFVPLEQGDGFRLQINAQNCVHCKTCDIKDPSQNINWVVPEGGGGPAYNGM

SEQ ID NO: 100813 - DNA, 1899 bp, Schizosaccharomyces pombe
  CDS (1)..(1899)
atgtcttatttatcgagatctgcactcgctcggtcagtcggggctaaacaccttactggggtattgagaaaaatcgggagaaggggaggaagatcgatgcacgttctccctctcgcttctcctagtactcttttaaaaatctcttctcaaactttacgtcaagatttcaccgttctgggcgctcgtaattttcattcaagttccgttcgacttaatgaattgacggataatttgcgtaaactagatactattgagcgagaggtcgaggatgtggatgtgtgtattgttggtgctggccctgcgggacttagtgctgccattcgtatcaagcaacaagctgccaaagccaacagagacattcgtgtcgtggtacttgaaaaggctgctgagcccggtaaccacagcgtatctggggctgtaattcaacctactgccttagatgaactacttcctaattggcgtgatgacccacctgaaaactgtactgctgttactcacgataaaatgaagttcctgatcccaaaattgcatttccctattcctgtccctccagccatgaagaaccacggaaattatgttatgagtttagcagaatttaccagatggctagctgcaaaggccgaagaatatggagttgaaatatatccttcttttgctgcttcagaggtcctctacaacaaagatggttctgttattggcgttgccactaatgattttggtgtcgatagtaagggtttgcccaaagataatttcgaacgcggcatggcttttcacgcacctgtcaccttatttgctgaaggtgctcacggttccctatcaaaatctattattaagcgttttaatcttcgaggaaattgtgaacctcaaacctatggtttgggtgtaaaggaggtttggcgtgtacctgacgagaactttcgcaaaggtgaggtagcccatacattaggatggccaatgaggaatgatacatatggtggtggttttatgtatcaatttggcgataactacgttactgttggtttagttgttggactggattatcctaatccttatgtttctcccgccttagaatttcaacgtatgaagcaaaaccccttttttgctaaggtgctaaagggcggaaaatgcctggaatatgccgcacgtgctcttaatgaaggtggttatcaagctattcccaaacttgtgtttcctggtggtgcactgatcggttgcagcgctggatttgtgaacgttgccaagattaaaggcactcatactgcgatgaaatcaggtattgttgccgctgatgccattgtagatgcgtttggacgggacgctgccagtaagcctcttcttctaaacgattatgaagaaaatctaaagaacacgtacgtcttcaaagaactttattctgttagaaacattcgaccatcttttcactcatttcttggtaattatggtggtatggcttattctgccgtggaagcatatgtactgaagggtcgtgtcccatggacattaaagcataaaggaggagatgcaaaggctacaaagtctgcatcaaaatataaacctatcaattatcccaaaccggataacgttctttctttcgatattccaacttcggtatcccgttccgcaacaatgcatgctgaaaaccaaccctgtcacctattcgatcaccgtcctaaagaccgtaaatcatgttttgaaacatataagggcgttgaaaacaaattctgccctgctggggtgtatgaatatgttaatgatgaagcttcttcatacggtaagcgttttgtcataaactctcaaaattgtgtccattgtaagacatgtgacattaaggaccctttacaaggtattcagtggaaaacccctcaaggaggagatggccctaaatataccttgacctag

SEQ ID NO: 100814 - protein, 632 aa, Schizosaccharomyces pombe
MSYLSRSALARSVGAKHLTGVLRKIGRRGGRSMHVLPLASPSTLLKISSQTLRQDFTVLGARNFHSSSVRLNELTDNLRKLDTIEREVEDVDVCIVGAGPAGLSAAIRIKQQAAKANRDIRVVVLEKAAEPGNHSVSGAVIQPTALDELLPNWRDDPPENCTAVTHDKMKFLIPKLHFPIPVPPAMKNHGNYVMSLAEFTRWLAAKAEEYGVEIYPSFAASEVLYNKDGSVIGVATNDFGVDSKGLPKDNFERGMAFHAPVTLFAEGAHGSLSKSIIKRFNLRGNCEPQTYGLGVKEVWRVPDENFRKGEVAHTLGWPMRNDTYGGGFMYQFGDNYVTVGLVVGLDYPNPYVSPALEFQRMKQNPFFAKVLKGGKCLEYAARALNEGGYQAIPKLVFPGGALIGCSAGFVNVAKIKGTHTAMKSGIVAADAIVDAFGRDAASKPLLLNDYEENLKNTYVFKELYSVRNIRPSFHSFLGNYGGMAYSAVEAYVLKGRVPWTLKHKGGDAKATKSASKYKPINYPKPDNVLSFDIPTSVSRSATMHAENQPCHLFDHRPKDRKSCFETYKGVENKFCPAGVYEYVNDEASSYGKRFVINSQNCVHCKTCDIKDPLQGIQWKTPQGGDGPKYTLT

SEQ ID NO: 100815 - DNA, 1896 bp, Saccharomyces cerevisiae
  CDS (1)..(1896)
atgattaagttcactaacgagaacttaattagagggatccgaatgacgatttccgcaaaatctcgtcatttggctctagggacagatatgacgagaaagtttagcttgtcgtgtaggtttttgaacaaagcaaatcttactgaagaagagaaagagttgttaaatgaaccaagggcgcgcgactatgtggatgtttgtatagttggaggagggcctgcgggattagcaacagcaatcaaattaaaacagttagacaattcgtcaggaacaggccaattgcgtgtcgttgttcttgaaaaatccagtgtattgggtggacaaactgtttccggcgctatattggaaccgggagtgtggaaagaactattccctgatgaaaagtctgacattggcattccgttaccaaaggagttagctacgttggtaactaaagaacatttgaaatttttaaaggggaaatgggcgatcagcgttccagaaccatctcaaatgatcaataaaggacgtaattatattgtctctttgaaccaagtcgtcggatatttaggagaaaaggcagaagaagtaggagttgaagtttaccccggaatagctgtctcggatctcatatatgatgaaaacaacgccgttaagggtgtaattactaaagatgctggtatttcgaagtccggtaagcctaaggaaaccttcgaacgtgggatggaattttgggctagacaaactgtattagcagagggctgtcatggttccttaacaaaacaagccttggcaaaatatgatttaagaaaaggcagacagcaccaaacttatggattaggtattaaagaagtttgggaagtcaagccggagaattttaacaagggatttgcagctcataccatggggtacccgttgacaaatgatgtttatggcggtggtttccagtaccattttggtgatgggctggtcactgtgggccttgtcgtggggttagattataagaatccctatgtttcaccttacaaagagtttcaaaagatgaaacatcatccatactattcaaaagttttagaaggaggtaagtgtatcgcttatgctgcaagagcattgaatgaaggtggactgcaatctgtacccaagttgaatttccctggtggtgttttggtaggggctagcgcgggtttcatgaacgttccaaagatcaagggtactcatactgcgatgaagagtggattacttgccgctgaaagtatctttgagtccataaaagggttacctgtcttagaagaggttgaagacgaagacgccaaaatggctatgtttgataaggaggcaactattaacttggaatcatatgaaagtgcattcaaagaatcatcgatatataaggaactatacgaagtgcgtaatattagaccgtccttcagcgggaaacttggtggatatggtggtatgatctactctggaatcgattctttgatattgaagggaaaagttccgtggacactgaaatttgatgaaaaaaatgacggtgaaattttggaacctgcttccaagtacaaaccgatagaataccccaagcctgatggtgtgatatcctttgatatattgacctccgtgtctagaaccggaacctaccatgatgatgatgaaccatgtcacttgagggttcctggacaagatatggtaaagtacgccgagagaagctttcccgtttggaaaggtgttgaatcgaggttctgcccagcaggtgtctacgaattcgtcaaagatgaaaaatcgcctgtgggtacgagactgcaaatcaattcacaaaattgtatccattgcaagacctgtgatattaaggcgcccagacaagatattacttggaaagtacccgaaggtggagatggaccaaagtacacgctaacttaa

SEQ ID NO: 100816 - protein, 631 aa, Saccharomyces cerevisiae
MIKFTNENLIRGIRMTISAKSRHLALGTDMTRKFSLSCRFLNKANLTEEEKELLNEPRARDYVDVCIVGGGPAGLATAIKLKQLDNSSGTGQLRVVVLEKSSVLGGQTVSGAILEPGVWKELFPDEKSDIGIPLPKELATLVTKEHLKFLKGKWAISVPEPSQMINKGRNYIVSLNQVVGYLGEKAEEVGVEVYPGIAVSDLIYDENNAVKGVITKDAGISKSGKPKETFERGMEFWARQTVLAEGCHGSLTKQALAKYDLRKGRQHQTYGLGIKEVWEVKPENFNKGFAAHTMGYPLTNDVYGGGFQYHFGDGLVTVGLVVGLDYKNPYVSPYKEFQKMKHHPYYSKVLEGGKCIAYAARALNEGGLQSVPKLNFPGGVLVGASAGFMNVPKIKGTHTAMKSGLLAAESIFESIKGLPVLEEVEDEDAKMAMFDKEATINLESYESAFKESSIYKELYEVRNIRPSFSGKLGGYGGMIYSGIDSLILKGKVPWTLKFDEKNDGEILEPASKYKPIEYPKPDGVISFDILTSVSRTGTYHDDDEPCHLRVPGQDMVKYAERSFPVWKGVESRFCPAGVYEFVKDEKSPVGTRLQINSQNCIHCKTCDIKAPRQDITWKVPEGGDGPKYTLT

SEQ ID NO: 100817 - DNA, 1308 bp, Azorhizobium caulinodans
  CDS (1)..(1308): transl_table=11
atgattgatgagaagttcgacgccatcgtcgtcggcgcgggcatggcgggcaacgccgccacgctcaccctcgcccggcgcggcctgaaggtgctgcaactggagcggggcgaatattccggctccaagaatgtgcagggcgccattctctatgcggacatgctggagaagctggtccccgatttccgcgagacgcgccgctggagcgcccatctcgtggaacagcgcttctggatgctggacgaccgctcccatgtgggcctccactatcgctcggaggacttcaacgaggagaagccgaaccgctacaccatcatccgcgcccagttcgacaagtggttctcctccaaggtgaaggaggccggcgccacggtgctgtgcgagaccacggtgacggaactggtgcaggatgcctatggcaaggtgatcggggtcaagaccgatcgctccggtggccagatccatgcggatgtggtggtgctggcggaaggcgtgaacggcctgctcggcaccaaggcgcacctgcgcgaacggccgaagcccgagcatgtggcgctggcggtgaaggagatgcatttcctgccccgcgagaccatcgaagcccgcttcaacctccagggcgacgagggggtggtcatcgaggccgccggcaccatctcccgcggcatgacgggcatgggcttcatctatgccaacaaggaatgcatctcgctgggcatcggctgcctcgtctccgatttccagaagaccggcgagacgccctatggcctgctggagcgcttcaagagccacccctccgtcgcgccgctcatcgaggggtcggaagtgaaggaatatgccgcgcacctcattcccgagggtggattcaaggccattccccagctcttcggcgacggctgggtggtggtgggcgatgccgcccagctcaacaatgccgtccatcgcgaggggtcgaacctcgccatgacctcgggccggatcgcggcggaagccatcttccaggtgaaatcccgccgcgagcccatgagcgcgaagaacctctcgctctacaagaccatgctggaagagagcttcgtcctgaaggacatgaagaagtacaaggaccttccggccctgcttcacatcaattcgcagaacttcttcctcacctatccgcagctggtctccaaggccatgcagaacttcgtgcgggtggatggcacgcccaaggtcgagaaggagaagcggagcgtgcgtgccttcgtggaggcccgctcctggttcggcctgttcggcgatgccttccgcttcgcccgcgcgtggcggtga

SEQ ID NO: 100818 - protein, 435 aa, Azorhizobium caulinodans
MIDEKFDAIVVGAGMAGNAATLTLARRGLKVLQLERGEYSGSKNVQGAILYADMLEKLVPDFRETRRWSAHLVEQRFWMLDDRSHVGLHYRSEDFNEEKPNRYTIIRAQFDKWFSSKVKEAGATVLCETTVTELVQDAYGKVIGVKTDRSGGQIHADVVVLAEGVNGLLGTKAHLRERPKPEHVALAVKEMHFLPRETIEARFNLQGDEGVVIEAAGTISRGMTGMGFIYANKECISLGIGCLVSDFQKTGETPYGLLERFKSHPSVAPLIEGSEVKEYAAHLIPEGGFKAIPQLFGDGWVVVGDAAQLNNAVHREGSNLAMTSGRIAAEAIFQVKSRREPMSAKNLSLYKTMLEESFVLKDMKKYKDLPALLHINSQNFFLTYPQLVSKAMQNFVRVDGTPKVEKEKRSVRAFVEARSWFGLFGDAFRFARAWR

SEQ ID NO: 100819 - DNA, 1284 bp, Azotobacter vinelandii
  CDS (1)..(1284): transl_table=11
atggctgaaagattcgacgtgatcgtggtcggcgccggcatggccggtaacgccgccgcatacaccctggccaagggggggctcaaggtgctgcagatcgagcggggcgaaacccccggttcgaagaacgtgcagggcgccatcctctatgccgacgccatcgagaagatcattcccgacttccgcgacgacgcgcccctggagcggcacctgatcgagcagcgcgtgtgggtgatggacgacgcttcctacgggtaccactaccgttcggaggacttcaacaagccgccctacaaccgctacaccatcatccgcgtgcatttcgaccagtggttcaacaagaaggcccgcgaggccggcgtgctgaccatctgcgaaacacgtcacgatctgctgatcgagggtggcaaggtggtgggcgtgcgcaccgatcgccagggcggcgaagtccgtgccgacgcggtgatcctggccgacggggtgaactcgcgcctggcggtgaaggccggcttcagccgagatcagcccgagaactgggccctggcggtgaaggaaatccatttcctgccccaggaaaccatggaggcgcgcttcaacatcggcgaagaggaagctgccatcgagatggccggcaagatcgacgccggcatgatgggcaccggcttcctctacaccaacaaggagtcgatcaccctgggggtcggctgcatgctgtccgacttcaagcagcagaagatctccccctatgagctgctggaccggatgaagacccacccctccatcgcgcccttgatcgccggcagcgacatgaaggagtacgccgcccacctgatccccgaaggcggctacaacgccattccccaggtatacggcgacggctggatgatcgccggcgacgcgccgattcgtcacggcatccatcgcgaaggctccaacctggccatgaccaccggcatgctggcggcccagaccctggtcgagctgcgggccgcggacaagcccttcagcgccgccaacctggccgagtacaagaagaagctggacgacagcttcgtcatgaaggacctgaagaagtaccggcgcatgccggagatcttccacaagaacaagcagttcttcaccacctatccggacctgctctccagggccgcgcagacccttatccgggtcgatggcgtggacaagaaaaccaaggaaaaggaaatcaagaaaagcttcatcggcctacgttcgctgttcgggctgatcggcgatgccttcaagttctggcgtgccgtcgagtaa

SEQ ID NO: 100820 - protein, 427 aa, Azotobacter vinelandii
MAERFDVIVVGAGMAGNAAAYTLAKGGLKVLQIERGETPGSKNVQGAILYADAIEKIIPDFRDDAPLERHLIEQRVWVMDDASYGYHYRSEDFNKPPYNRYTIIRVHFDQWFNKKAREAGVLTICETRHDLLIEGGKVVGVRTDRQGGEVRADAVILADGVNSRLAVKAGFSRDQPENWALAVKEIHFLPQETMEARFNIGEEEAAIEMAGKIDAGMMGTGFLYTNKESITLGVGCMLSDFKQQKISPYELLDRMKTHPSIAPLIAGSDMKEYAAHLIPEGGYNAIPQVYGDGWMIAGDAPIRHGIHREGSNLAMTTGMLAAQTLVELRAADKPFSAANLAEYKKKLDDSFVMKDLKKYRRMPEIFHKNKQFFTTYPDLLSRAAQTLIRVDGVDKKTKEKEIKKSFIGLRSLFGLIGDAFKFWRAVE

SEQ ID NO: 100821 - DNA, 1308 bp, Bradyrhizobium japonicum
  CDS (1)..(1308): transl_table=11
atgattgaagagagattcgatgcgatcgtggtcggagccggtatggccggcaacgcggcggcattgacgatggccaaacagggcatgaaggtgctgcagctcgagcggggcgaatatcccggatcgaaaaatgtgcagggggccatcctctatgccgacatgatggaaaagctgatccccgagtttcgagaggaggcgccactcgaacgccacctgatcgaacagcggttctggatgatggacgatcgctcgcatgtcggcatgcactaccgttcggaggacttcaacgagcagaggccgaaccgctatacgattatacgcgcccagtttgacaaatggttttcttcaaaggtgcgggaagctggcgcgatcgtgctttgcgagaccaccgtcacagagctcgcgcaggacgatcgtaacagggtcgtcggtgttcgtacagatcgccgtgacggcgagatacatgctgacgtcgtcgttctggccgaaggggtcaatggcttgctcggcacgcgtgcgggcctgcgcgcccgtccggcacccgataacgttgcgctcgcggtgaaggaaatgcacttcttgccccgtgaaaccatcgaagcacgcttcaatcttaagggggatgaaggcgtcgtgatagaggctgccggtaccatttcccgcggcatgaccgggatgggtttcatctacgccaacaaagagtgcatttcgcttggcatcggttgtctcgtcgccgacttccaacgcacgggccaaacgccgtatggcctgctcgatgaattcaaaaggcatccctctgtggcgccactgatagcagggtccgaagtaaaggaatattcggcgcatctcattcccgaaggcggttacaaatcgatcccacagctttatggggagggctgggtcgtcgtgggcgatgccgcccaactcaacaatgccgttcatcgtgagggctccaatctcgcgatgacatcgggccgtatcgcggccgaagcgataggtctggtcaaatcgcgcggcgaaccgatgagtgcaacaaatctctcaatctacaaaaagatgttggacgattctttcgtcatcaaagatctcaagaagtacaaggatttgccacccctcatgcatacccactccgaaaatttctttctcacttatccgcagcttatctccaaggcgatgcagaactttgtgcgcgtcgatggtacgcccaaggttgagaaggagaaggcgagcctcaaatcctttgtcaagacgcggtcatggtcaggtctggtcggcgatgcttaccgttttgccagggcctggcggtga

SEQ ID NO: 100822 - protein, 435 aa, Bradyrhizobium japonicum
MIEERFDAIVVGAGMAGNAAALTMAKQGMKVLQLERGEYPGSKNVQGAILYADMMEKLIPEFREEAPLERHLIEQRFWMMDDRSHVGMHYRSEDFNEQRPNRYTIIRAQFDKWFSSKVREAGAIVLCETTVTELAQDDRNRVVGVRTDRRDGEIHADVVVLAEGVNGLLGTRAGLRARPAPDNVALAVKEMHFLPRETIEARFNLKGDEGVVIEAAGTISRGMTGMGFIYANKECISLGIGCLVADFQRTGQTPYGLLDEFKRHPSVAPLIAGSEVKEYSAHLIPEGGYKSIPQLYGEGWVVVGDAAQLNNAVHREGSNLAMTSGRIAAEAIGLVKSRGEPMSATNLSIYKKMLDDSFVIKDLKKYKDLPPLMHTHSENFFLTYPQLISKAMQNFVRVDGTPKVEKEKASLKSFVKTRSWSGLVGDAYRFARAWR

SEQ ID NO: 100823 - DNA, 1308 bp, Rhizobium meliloti
  CDS (1)..(1308): transl_table=11
atgacaaaggaaaaatttgacgccatcgtcgttggtgccggtatgtccgggaatgcggcggcttacgcgatggctagccgtgggctaaaggtgctgcagttggagcgcggagagtatccgggttcaaagaacgtccaaggcgctataatgtacgccaacatgctggaggcaatcattccagatttccggaatgacgcaccgctcgagcggcatctcgtcgagcagcgattctggataatggacgatacgtctcacaccgggatgcactaccggtcagacgatttcaatgaggtgacgccaaaccgctacacgatcattcgcgctcaattcgataaatggttatcgcgcaaggtgtgcgaggctggcggaacggtcctgtgtgaaacaacggctacaggactggaatgggacagtgccgggaaggcgataggcgtccgcactgaccgcgctggcgacgtcgttcttgcagatgtggtcgtgctcgctgaaggggtcaacggactccttggcacgcgcgccggcttacgtgagatgccgaagtcgaaaaacgtagccctcgcggtaaaggaattgcatttcctccccgaagaggtgatcgcagagcgcttcggactgacaggcgatgaaggatgcgtgattgaggcgggcgggacaatttcgcgcggaatggcaggattgggcttcctctacaccaataaggagtcaatctcactcggcatcggctgcctcatctcgaacttcgccgagaccatggagagaccttacgcgcttctcgacgcctttaaacgccacccttcaatccagccgctaatagcagggtcggaagtaaaggaatatgcggcccatctcattccggagggcggtttcaacgcaataccgcggctctgcggtaacggctgggtcgtcgttggagacgcggcgcaacttaacaatgccgtgcaccgcgaagggtctaaccttgccatggcatctgggaggatggcgggagaggcgatttcaatcataaagagccgcgggggggtaatggataaggcgagcctctctctctacaaaacgatgctagacaagtccttcgttgttgaggacctgagcaaacaaaaggacatgccttccctgctccataccaattccccaaacttcttcacgacgtacccgcagctgatatcgcatgccgcgcagaacttcgtgcgcgtggacggcacgcctaagattgagagggaaattgcgaccaccgccgcctttctcagggcacgatcccgatggggtctcgtcagtgacgcggttcgccttgcctccgcctggcgctaa

SEQ ID NO: 100824 - protein, 435 aa, Rhizobium meliloti
MTKEKFDAIVVGAGMSGNAAAYAMASRGLKVLQLERGEYPGSKNVQGAIMYANMLEAIIPDFRNDAPLERHLVEQRFWIMDDTSHTGMHYRSDDFNEVTPNRYTIIRAQFDKWLSRKVCEAGGTVLCETTATGLEWDSAGKAIGVRTDRAGDVVLADVVVLAEGVNGLLGTRAGLREMPKSKNVALAVKELHFLPEEVIAERFGLTGDEGCVIEAGGTISRGMAGLGFLYTNKESISLGIGCLISNFAETMERPYALLDAFKRHPSIQPLIAGSEVKEYAAHLIPEGGFNAIPRLCGNGWVVVGDAAQLNNAVHREGSNLAMASGRMAGEAISIIKSRGGVMDKASLSLYKTMLDKSFVVEDLSKQKDMPSLLHTNSPNFFTTYPQLISHAAQNFVRVDGTPKIEREIATTAAFLRARSRWGLVSDAVRLASAWR

SEQ ID NO: 100825 - DNA, 1308 bp, Rhizobium sp
  CDS (1)..(1308): transl_table=11
atgaccgaagaaagattcgacgccatcgtcgtcggtgccggtatgtctggaaacgcggctgcatacaccatggcaagtcgcggtctaaaagtgttgcagttggagcgcggagaatatccgggctccaagaacgtccaaggcgccatcttgtacgccaacatgctggagacaatcattcccgatttccgggatgatgcacctcttgagcggcatctggtcgagcagcgattctgggtaacggacgacacgtcacacaccggaatgcactaccggtcggacgacttcaatgagccggcgccaaaccgttacacgatcattcgcgcccagttcgacaagtggttttcgcggaaagtccgagcggcgggcgcgatagttttgtgcgagacgacggtgacggaactggctcttgatgctgccggcaaggtgataggcgtccataccgatcgagcgggcggggtcatccatgcggacgtggtcgtgctcgccgaaggcgtaaacggcctcctcggcacgagagcacgatttcgcaaggtgccgaaacccgaagccgtggcactcgctgtcaaggaaatgcatttcctaccggaagaggtcatcaatgaacgcttcggccttaccggcgatcaaggctgtgttattgaggcggcagggacaatctcgcgcggaatggccggcttgggattcctctacaccaacaaggaatcgatctctcttggcatcggctgccttgtctcccatttcgcagcgaccctggaaagtccttacgcgctacttgacgcattcaagaaccacccatcaatccggccgctacttgcgggctcggagattaaggaatatgcggcgcacctcattccggagggcggattcaaggcaattccgcagctctttggcgatggctgggtcgtggttggcgacgcggcgcagctcaacaacgccgtgcaccgcgagggctcgaacctcgccatgacgtcgggccgcatcgccggcgaggcgatcgccgcaatcaagagccgaaaacacccgatgacgagtgacaatctctcactttacaaggccatgctggacaagtctttcgttctgaaagacctcagaaagtacaaggacatgcccgctctgctccacacgaattcacacaatttcttcacgacttatccgcagttgatgtcgcaggcggcgcaaaacttcgtgcgcgtcgacggcacacccaagatcgagaaggaaagagcgaccacggccgctcttattaaagcgcgttcgcgatggggactggtcagcgacgcagtccgcttggcactggcatggcgctaa

SEQ ID NO: 100826 - protein, 435 aa, Rhizobium sp
MTEERFDAIVVGAGMSGNAAAYTMASRGLKVLQLERGEYPGSKNVQGAILYANMLETIIPDFRDDAPLERHLVEQRFWVTDDTSHTGMHYRSDDFNEPAPNRYTIIRAQFDKWFSRKVRAAGAIVLCETTVTELALDAAGKVIGVHTDRAGGVIHADVVVLAEGVNGLLGTRARFRKVPKPEAVALAVKEMHFLPEEVINERFGLTGDQGCVIEAAGTISRGMAGLGFLYTNKESISLGIGCLVSHFAATLESPYALLDAFKNHPSIRPLLAGSEIKEYAAHLIPEGGFKAIPQLFGDGWVVVGDAAQLNNAVHREGSNLAMTSGRIAGEAIAAIKSRKHPMTSDNLSLYKAMLDKSFVLKDLRKYKDMPALLHTNSHNFFTTYPQLMSQAAQNFVRVDGTPKIEKERATTAALIKARSRWGLVSDAVRLALAWR

SEQ ID NO: 100827 - DNA, 1287 bp, Salmonella typhi
  CDS (1)..(1287): transl_table=11
atgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgtttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcactggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctagggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatga

SEQ ID NO: 100828 - protein, 428 aa, Salmonella typhi
MSEDIFDAIIVGAGLAGSVAALVLAREGAQVLVIERGNSAGAKNVTGGRLYAHSLERIIPGFADQAPIERMITHEKLAFMTDNGAMTIDYCNGEDASASQVSYSVLRSKFDAWLMEQAEEAGAQLITGIRVDNVVQRDGKVVGVEADGDILEAKVVILADGVNSLLAEKLGMAKRVEASHVAVGVKELIELPKSVIEDRFQLQGNEGAACLFAGAPTDGLMGGGFLYTNETTLSLGLVCGLHHLKDAKKSVPQMLEDFKQHPAVAPLIAGGKLVEYAAHVVPEAGMNMQPELVGDGVLIAGDAAGMCMNLGFTIRGMDLAISAGEAAAKTVLSAMKRDDFSKQSLGEYRQHLDEGPMRDMRMYQKLPAFLDNPRMFTAYPEMAVSIARDLFTVDGSAPVPMRKKILRHAKKVGFINLMKDGLKGVTVL

SEQ ID NO: 100829 - DNA, 1287 bp, Salmonella typhimurium
  CDS (1)..(1287): transl_table=11
atgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgcttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcctattccgtcttacgcagtaaatttgacgcctggctgatggagcaggccgaagaggcgggggcgcaactgatcaccggtattcgcgtggataacgttgttcagcgtgatggcaaagtcgtgggcgtggaagccgatggcgatattctggaagccaaagtcgtgatcctcgctgacggggtgaattctctgctggctgaaaagctgggcatgaccaagcgtgttgaggcatcgcatgttgctgtcggcgtgaaggaactgatcgaattgccgaagttggtcattgaagatcgtttccagttacagggcaacgaaggtgccgcctgtctgtttgccggagcgccgaccgatggtctgatgggcggtggcttcctgtatacgaatgaaacaaccctttccctggggctggtctgcggtcttcatcatctgaaagacgcgaaaaaatcggtcccgcaaatgctggaagatttcaaacagcatccggcagttgcgccgctgatcgccggtggcaagctggtggaatatgccgcgcacgttgtacccgaggcgggaatgaatatgcagcctgaactggtgggcgatggcgtactgattgccggggatgctgccggcatgtgtatgaacctcggctttaccatccggggtatggatctcgccatatccgcaggcgaagcggcggcgaagacggtgctttcggcgatgaagcgcgacgattttagcaagcagtcgctgggtgaataccgtcagcatctggacgaaggtccgatgcgcgatatgcgcatgtatcagaaactaccggcttttcttgataatccccgcatgtttaccgcttatcccgaaatggcggtcaatatcgcgcgcgacctgttcaccgtggatggctccgctccggtgcccatgcgtaaaaaaatcctgcgccatgcgaagaaagtgggcttcattaatctgatgaaagatggcctgaaaggagtgaccgtattatga

SEQ ID NO: 100830 - protein, 428 aa, Salmonella typhimurium
MSEDIFDAIIVGAGLAGSVAALVLAREGAQVLVIERGNSAGAKNVTGGRLYAHSLERIIPGFADQAPIERMITHEKLAFMTDNGAMTIDYCNGEDASASQVSYSVLRSKFDAWLMEQAEEAGAQLITGIRVDNVVQRDGKVVGVEADGDILEAKVVILADGVNSLLAEKLGMTKRVEASHVAVGVKELIELPKLVIEDRFQLQGNEGAACLFAGAPTDGLMGGGFLYTNETTLSLGLVCGLHHLKDAKKSVPQMLEDFKQHPAVAPLIAGGKLVEYAAHVVPEAGMNMQPELVGDGVLIAGDAAGMCMNLGFTIRGMDLAISAGEAAAKTVLSAMKRDDFSKQSLGEYRQHLDEGPMRDMRMYQKLPAFLDNPRMFTAYPEMAVNIARDLFTVDGSAPVPMRKKILRHAKKVGFINLMKDGLKGVTVL

SEQ ID NO: 100831 - DNA, 1176 bp, Methanococcus jannaschii
  CDS (1)..(1176): transl_table=11
atgagagagttaaatgatgtatatgatgtagtggttgttggagcaggtcccggaggaagtatggcaagttatgcatcagcaaagaatggagctaaaacactattaattgagaaatctcaagagattggtgagccagttaggtgtgctgaggcaattccatcaatagaggaatttggattaaaaccagaaccagagtttgttagaaacattattaagggaggaattttattttctccttctggaaaaaaagttacagtaactcaagataaggctcaaggatatgtagttgagagaaaaatttttgataaatatttggctataagggcagctaaagcaggagctaaagtagcagtaaaaacaacagctattggtttagagagggacggagattattggaatgttatagttgaatttttaggagaggagtatgttataaaaactaaagtggttatagctgctgatggtgttgagagcaatatagctgaatatgctggtttaaaggcaaagaaaaagccattggagatttgctcctgtgctgaatatgagatgacaaatgttgaattgttggataaaaatatgatggaattctattttggtaatgaagtggctccaggagggtatgtttggatattccccaaaggagaaacagctaatgttggtttgggagttagagataaaaagaagaaggcaatagaatatttagaagagttcatagaaaatggtttagctaaagataggttaaaggatgcaacaccaatagaattcaaagttggaggagctcctgtttctggccctatagaaaaaacctatactgatggtcttttagttgtgggggatgctgctgggcagataagcccattaactggtggaggaatttatttagctatggattgtggattaatagctggagaagtagcaagtaaagctataaaattaaatgattggagtgaagaaaccctaaaagaatatgaaagaagatggaaagaaaagcattatgaatatttaatgagccatttaaagtatagaaaaatcttagagaaaatgagtgatgatgagttagatgctttagcagaagctttaggagaaagtttagacggcattgacttgaaaaaatttgtcaagagaataataactaaaaaaccatcacttttaaaatactttaaggatttattataa

SEQ ID NO: 100832 - protein, 391 aa, Methanococcus jannaschii
MRELNDVYDVVVVGAGPGGSMASYASAKNGAKTLLIEKSQEIGEPVRCAEAIPSIEEFGLKPEPEFVRNIIKGGILFSPSGKKVTVTQDKAQGYVVERKIFDKYLAIRAAKAGAKVAVKTTAIGLERDGDYWNVIVEFLGEEYVIKTKVVIAADGVESNIAEYAGLKAKKKPLEICSCAEYEMTNVELLDKNMMEFYFGNEVAPGGYVWIFPKGETANVGLGVRDKKKKAIEYLEEFIENGLAKDRLKDATPIEFKVGGAPVSGPIEKTYTDGLLVVGDAAGQISPLTGGGIYLAMDCGLIAGEVASKAIKLNDWSEETLKEYERRWKEKHYEYLMSHLKYRKILEKMSDDELDALAEALGESLDGIDLKKFVKRIITKKPSLLKYFKDLL

SEQ ID NO: 100833 - DNA, 1290 bp, Escherichia coli
  CDS (1)..(1290): transl_table=11
atgtcggatgacaaatttgatgccattgtggtcggtgcgggcgttgctggtagcgttgccgcactggtcatggcacgagccgggctggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgagcagccagatgttccgcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatgggcgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccagcagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccatcgacggcaaaccaaaccagccggtacgaaaaatgatcatgggacatgcgaagaaaattgggctgatcaacttgctgaaagatggcattaagggagcaaccgcgctatga

SEQ ID NO: 100834 - protein, 429 aa, Escherichia coli
MSDDKFDAIVVGAGVAGSVAALVMARAGLDVLVIERGDSAGCKNMTGGRLYAHTLEAIIPGFAVSAPVERKVTREKISFLTEESAVTLDFHREQPDVPQHASYTVLRNRLDPWLMEQAEQAGAQFIPGVRVDALVREGNKVTGVQAGDDILEANVVILADGVNSMLGRSLGMVPASDPHHYAVGVKEVIGLTPEQINDRFNITGEEGAAWLFAGSPSDGLMGGGFLYTNKDSISLGLVCGLGDIAHAQKSVPQMLEDFKQHPAIRPLISGGKLLEYSAHMVPEGGLAMVPQLVNEGVMIVGDAAGFCLNLGFTVRGMDLAIASAQAAATTVIAAKERADFSASSLAQYKRELEQSCVMRDMQHFRKIPALMENPRLFSQYPRMVADIMNEMFTIDGKPNQPVRKMIMGHAKKIGLINLLKDGIKGATAL

SEQ ID NO: 100835 - DNA, 1272 bp, Escherichia coli
  CDS (1)..(1272)
atggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtag

SEQ ID NO: 100836 - protein, 423 aa, Escherichia coli
MEDDCDIIIIGAGIAGTACALRCARAGLSVLLLERAEIPGSKNLSGGRLYTHALAELLPQFHLTAPLERRITHESLSLLTPDGVTTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGRICDDLPGGAFLYTNQQTLSLGIVCPLSSLTQSRVPASELLTRFKAHPAVRPLIKNTESLEYGAHLVPEGGLHSMPVQYAGNGWLLVGDALRSCVNTGISVRGMDMALTGAQAAAQTLISACQHREPQNLFPLYHHNVERSLLWDVLQRYQHVPALLQRPGWYRTWPALMQDISRDLWDQGDKPVPPLRQLFWHHLRRHGLWHLAGDVIRSLRCL

SEQ ID NO: 100837 - DNA, 24 bp, Artificial sequence
  primer
atgtccgaagatatctttgacgcc

SEQ ID NO: 100838 - DNA, 26 bp, Artificial sequence
  primer
ttataaaacggtcactcctttcatgc

SEQ ID NO: 100839 - protein, 723 aa, Artificial sequence
  Variant (9)..(9): xaa in position 9 is any amino acid
  Variant (12)..(12): xaa in position 12 is any amino acid
  Variant (14)..(14): xaa in position 14 is any amino acid
  Variant (16)..(17): xaa in position 16 to 17 is any amino acid
  Variant (19)..(24): xaa in position 19 to 24 is any amino acid
  Variant (25)..(43): xaa in position 25 to 43 is any or no amino acid
  Variant (45)..(45): xaa in position 45 is any amino acid
  Variant (51)..(53): xaa in position 51 to 53 is any amino acid
  Variant (56)..(57): xaa in position 56 to 57 is any amino acid
  Variant (62)..(62): xaa in position 62 is any amino acid
  Variant (64)..(67): xaa in position 64 to 67 is any amino acid
  Variant (68)..(75): xaa in position 68 to 75 is any or no amino acid
  Variant (77)..(78): xaa in position 77 to 78 is any or no amino acid
  Variant (80)..(80): xaa in position 80 is any or no amino acid
  Variant (82)..(82): xaa in position 82 is any or no amino acid
  Variant (84)..(98): xaa in position 84 to 98 is any or no amino acid
  Variant (100)..(102): xaa in position 100 to 102 is any or no amino acid
  Variant (104)..(105): xaa in position 104 to 105 is any amino acid
  Variant (107)..(110): xaa in position 107 to 110 is any amino acid
  Variant (112)..(123): xaa in position 112 to 123 is any amino acid
  Variant (124)..(139): xaa in position 124 to 139 is any or no amino acid
  Variant (141)..(141): xaa in position 141 is any or no amino acid
  Variant (143)..(144): xaa in position 143 to 144 is any amino acid
  Variant (145)..(149): xaa in position 145 to 149 is any or no amino acid
  Variant (153)..(154): xaa in position 153 to 154 is any amino acid
  Variant (157)..(158): xaa in position 157 to 158 is any amino acid
  Variant (159)..(169): xaa in position 159 to 169 is any or no amino acid
  Variant (171)..(172): xaa in position 171 to 172 is any amino acid
  Variant (174)..(181): xaa in position 174 to 181 is any amino acid
  Variant (184)..(186): xaa in position 184 to 186 is any amino acid
  Variant (187)..(194): xaa in position 187 to 194 is any or no amino acid
  Variant (196)..(196): xaa in position 196 is any or no amino acid
  Variant (199)..(201): xaa in position 199 to 201 is any amino acid
  Variant (202)..(218): xaa in position 202 to 218 is any or no amino acid
  Variant (220)..(221): xaa in position 220 to 221 is any amino acid
  Variant (223)..(223): xaa in position 223 is any amino acid
  Variant (225)..(227): xaa in position 225 to 227 is any amino acid
  Variant (229)..(229): xaa in position 229 is any amino acid
  Variant (233)..(236): xaa in position 233 to 236 is any amino acid
  Variant (238)..(251): xaa in position 238 to 251 is any amino acid
  Variant (252)..(258): xaa in position 252 to 258 is any or no amino acid
  Variant (266)..(266): xaa in position 266 is any amino acid
  Variant (267)..(267): xaa in position 267 is any or no amino acid
  Variant (269)..(269): xaa in position 269 is any amino acid
  Variant (270)..(284): xaa in position 270 to 284 is any or no amino acid
  Variant (286)..(287): xaa in position 286 to 287 is any amino acid
  Variant (288)..(291): xaa in position 288 to 291 is any or no amino acid
  Variant (293)..(293): xaa in position 293 is any amino acid
  Variant (294)..(294): xaa in position 294 is any or no amino acid
  Variant (296)..(304): xaa in position 296 to 304 is any or no amino acid
  Variant (307)..(307): xaa in position 307 is any amino acid
  Variant (311)..(326): xaa in position 311 to 326 is any amino acid
  Variant (327)..(367): xaa in position 327 to 367 is any or no amino acid
  Variant (369)..(375): xaa in position 369 to 375 is any amino acid
  Variant (377)..(377): xaa in position 377 is any or no amino acid
  Variant (379)..(394): xaa in position 379 to 394 is any or no amino acid
  Variant (396)..(396): xaa in position 396 is any or no amino acid
  Variant (398)..(400): xaa in position 398 to 400 is any or no amino acid
  Variant (402)..(402): xaa in position 402 is any amino acid
  Variant (403)..(434): xaa in position 403 to 434 is any or no amino acid
  Variant (436)..(437): xaa in position 436 to 437 is any amino acid
  Variant (439)..(439): xaa in position 439 is any amino acid
  Variant (443)..(444): xaa in position 443 to 444 is any amino acid
  Variant (446)..(447): xaa in position 446 to 447 is any amino acid
  Variant (450)..(451): xaa in position 450 to 451 is any amino acid
  Variant (455)..(457): xaa in position 455 to 457 is any amino acid
  Variant (458)..(460): xaa in position 458 to 460 is any or no amino acid
  Variant (462)..(463): xaa in position 462 to 463 is any amino acid
  Variant (467)..(468): xaa in position 467 to 468 is any amino acid
  Variant (471)..(471): xaa in position 471 is any amino acid
  Variant (473)..(475): xaa in position 473 to 475 is any amino acid
  Variant (476)..(478): xaa in position 476 to 478 is any or no amino acid
  Variant (482)..(484): xaa in position 482 to 484 is any amino acid
  Variant (487)..(487): xaa in position 487 is any amino acid
  Variant (490)..(490): xaa in position 490 is any amino acid
  Variant (495)..(501): xaa in position 495 to 501 is any amino acid
  Variant (502)..(543): xaa in position 502 to 543 is any or no amino acid
  Variant (545)..(550): xaa in position 545 to 550 is any amino acid
  Variant (552)..(556): xaa in position 552 to 556 is any amino acid
  Variant (557)..(646): xaa in position 557 to 646 is any or no amino acid
  Variant (648)..(653): xaa in position 648 to 653 is any amino acid
  Variant (655)..(670): xaa in position 655 to 670 is any amino acid
  Variant (671)..(676): xaa in position 671 to 676 is any or no amino acid
  Variant (678)..(698): xaa in position 678 to 698 is any amino acid
  Variant (699)..(718): xaa in position 699 to 718 is any or no amino acid
  Variant (720)..(722): xaa in position 720 to 722 is any amino acid
DVVIVGAGXAGXSXAXXLXXXXXXXXXXXXXXXXXXXXXXXXXVXVLEKGXXXGAXXLSGAXLXXXXXXXXXXXXLXXLXPXWXXXXXXXXXXXXXXXLXXXVXXDXXXXLXXXXXXXXXXXXXXXXXXXXXXXXXXXXYXVXXXXXXXWLAXXAEXXXXXXXXXXXXXGXXIXXXXXXXXVLXXXXXXXXXXXVXGVXXXXXXXXXXXXXXXXXXXXGXXLXAXXXIXAEGXXXXLXXXXXXXXXXXXXXXXXXXXXGIGIKELXXIXXXXXXXXXXXXXXXXGXXXXXXGXXLXXXXXXXXXGGXFLYXXXXXXXXXXXXXXXXXXXXXXXXXXXXXXXXXXXXXXXXXXXXXXXXXXXXXXXXXPXXXXXXXKXHXXXXXXXXXXXXXXXXPXIXXXLXXXXXXXXXXXXXXXXXXXXXXXXXXXXXXXXXGXXIXYGAXXIXXGGXXSLPXXXXXXGXXLIGXXAGXLXXXXXXIKGXXXAMXSGXLAAEXXXXXXXXXXXXXXXXXXXXXXXXXXXXXXXXXXXXXXXXXXXXXXXXXYXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXLXXXXXXXXXXXXXXXXXXXXXXLXXXXXXXXXXXXXXXXXXXXXXXXXXXXXXXXXXXXXXXXXVXXXV

SEQ ID NO: 100840 - protein, 16 aa, Artificial sequence
  Variant (2)..(2): xaa in position 2 is Ala, Ile or Val
  Variant (3)..(3): xaa in position 3 is any amino acid
  Variant (4)..(5): xaa in position 4 to 5 is Ile or Val
  Variant (7)..(7): xaa in position 7 is Ala or Gly
  Variant (9)..(9): xaa in position 9 is any amino acid
  Variant (10)..(10): xaa in position 10 is Ala, Gly or Ser
  Variant (12)..(12): xaa in position 12 is any amino acid
  Variant (13)..(13): xaa in position 13 is any or no amino acid
  Variant (15)..(15): xaa in position 15 is any or no amino acid
DXXXXGXGXXGXXAXA

SEQ ID NO: 100841 - protein, 20 aa, Artificial sequence
  Variant (2)..(3): xaa in position 2 to 3 is any amino acid
  Variant (4)..(4): xaa in position 4 is Ile, Leu or Val
  Variant (6)..(6): xaa in position 6 is Lys or Arg
  Variant (7)..(7): xaa in position 7 is Ala, Gly or Ser
  Variant (8)..(10): xaa in position 8 to 10 is any amino acid
  Variant (12)..(12): xaa in position 12 is Ala, Cys, Gly or Ser
  Variant (13)..(13): xaa in position 13 is His or Lys
  Variant (14)..(14): xaa in position 14 is any amino acid
  Variant (15)..(15): xaa in position 15 is Ile, Leu, Met or Val
  Variant (16)..(16): xaa in position 16 is any amino acid
  Variant (18)..(19): xaa in position 18 to 19 is any amino acid
  Variant (20)..(20): xaa in position 20 is Phe, Ile, Leu, Met or Val
VXXXEXXXXXGXXXXXGXXX

SEQ ID NO: 100842 - protein, 47 aa, Artificial sequence
  Variant (2)..(27): xaa in position 2 to 27 is any amino acid
  Variant (28)..(29): xaa in position 28 to 29 is any or no amino acid
  Variant (31)..(41): xaa in position 31 to 41 is any amino acid
  Variant (42)..(43): xaa in position 42 to 43 is any or no amino acid
  Variant (45)..(45): xaa in position 45 is any amino acid
  Variant (47)..(47): xaa in position 47 is Ala or Glu
GXXXXXXXXXXXXXXXXXXXXXXXXXXXXLXXXXXXXXXXXXXGXKX

SEQ ID NO: 100843 - protein, 54 aa, Artificial sequence
  Variant (2)..(2): xaa in position 2 is any amino acid
  Variant (3)..(3): xaa in position 3 is Ala or Gly
  Variant (4)..(8): xaa in position 4 to 8 is any amino acid
  Variant (11)..(14): xaa in position 11 to 14 is any amino acid
  Variant (16)..(20): xaa in position 16 to 20 is any amino acid
  Variant (21)..(21): xaa in position 21 is any or no amino acid
  Variant (23)..(24): xaa in position 23 to 24 is any amino acid
  Variant (25)..(25): xaa in position 25 is Ala, Ile, Leu or Val
  Variant (26)..(26): xaa in position 26 is any amino acid
  Variant (28)..(38): xaa in position 28 to 38 is any amino acid
  Variant (39)..(41): xaa in position 39 to 41 is any or no amino acid
  Variant (43)..(45): xaa in position 43 to 45 is any amino acid
  Variant (46)..(46): xaa in position 46 is Ala or Ser
  Variant (47)..(48): xaa in position 47 to 48 is any amino acid
  Variant (49)..(49): xaa in position 49 is Gly, Ser or Thr
  Variant (50)..(50): xaa in position 50 is Ala or Gly
  Variant (51)..(52): xaa in position 51 to 52 is any amino acid
  Variant (53)..(53): xaa in position 53 is Ala or Cys
  Variant (54)..(54): xaa in position 54 is Ala, Gly or Ser
YXXXXXXXGGXXXXPXXXXXXGXXXXGXXXXXXXXXXXXXXGXXXXXXXXXXXX

SEQ ID NO: 100844 - DNA, 795 bp, Escherichia coli K12
  CDS (1)..(795): transl_table=11
atgaaaccgaccaccatctccttactgcagaagtacaaacaggaaaaaaaacgtttcgcgaccatcaccgcttatgactatagcttcgccaaactctttgctgatgaagggcttaacgtcatgctggtgggcgattcgctgggcatgacggttcaggggcacgactccaccctgccagttaccgttgccgatatcgcctaccacactgccgccgtacgtcgcggcgcaccaaactgcctgctgctggctgacctgccgtttatggcgtatgccacgccggaacaagccttcgaaaacgccgcaacggttatgcgtgccggtgctaacatggtcaaaattgaaggcggtgagtggctggtagaaaccgtacaaatgctgaccgaacgtgccgttcctgtatgtggtcacttaggtttaacaccacagtcagtgaatattttcggtggctacaaagttcaggggcgcggcgatgaagcgggcgatcaactgctcagcgatgcattagccttagaagctgctggggcacagctgctggtgctggaatgcgtgccggttgaactggcaaaacgtattaccgaagcactggcgatcccggttattggcattggcgcaggcaacgtcactgacgggcagatcctcgtgatgcacgacgcctttggtattaccggcggtcacattcctaaattcgctaaaaatttcctcgccgaaacgggcgacatccgcgcggctgtgcggcagtatatggctgaagtggagtccggcgtttatccgggcgaagaacacagtttccattaa

SEQ ID NO: 100845 - protein, 264 aa, Escherichia coli K12
MKPTTISLLQKYKQEKKRFATITAYDYSFAKLFADEGLNVMLVGDSLGMTVQGHDSTLPVTVADIAYHTAAVRRGAPNCLLLADLPFMAYATPEQAFENAATVMRAGANMVKIEGGEWLVETVQMLTERAVPVCGHLGLTPQSVNIFGGYKVQGRGDEAGDQLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 100846 - DNA, 1044 bp, Arabidopsis thaliana
  CDS (1)..(1044)
atggcgtcctcactcactaggaattgctctcgcttctcaaaagccatctctgtccgtttcatgagtaacctaccggaaaacaccgtctacggaggaccaaagccacaaaacccaaaccaaagagtgacgctaacgcatctcagacaaaaacaccggagaggagaaccgatcaccgtcgtaactgcctacgattacccatccgccgttcatttagacacagctggtatcgatgtttgtcttgtcggtgactcagcttccatggttgttcatggtcacgacacaacacttcctatctccttagacgagatgcttgttcattgtcgtgccgttgctcgaggcgctaaacgacctctcctagttggtgacttgccatttggtacctacgagtcaagctctagtcaggcggttgatactgcggttagggttttgaaggaaggaggaatggatgcgattaagctcgaaggaggatcagcttctaggatcactgctgcaaaagctatagttgaagcaggaattgcggttattggtcatgtgggtctaacccctcaggcgattagcgttcttggtggtttcagaccccaaggcagaaacatagctagtgctgttaaagttgttgagactgcaatggctttacaagaagctggatgtttttcggttgttttggaatgcgttccacctcctgtagctgctgctgcaacttctgccctcaagataccaaccattggcattggggctggacctttctgcagtggacaggtgctagtttaccatgatcttcttggtatgatgcaacatccacatcatgccaaggttactccaaagttttgcaagcagtacgctaatgtcggagaagtgattaacaaagccctaatggaatacaaagaagaagtctctaaaaaagtgtttccaggtccttctcacagtccttacaagatcacagcaagtgagctcgatgggttcttaaccgagttgcagaagcttggttttgacaaggctgcttctgcagcagctttagcagctgagaacatggagccttcaaagtga

SEQ ID NO: 100847 - protein, 347 aa, Arabidopsis thaliana
MASSLTRNCSRFSKAISVRFMSNLPENTVYGGPKPQNPNQRVTLTHLRQKHRRGEPITVVTAYDYPSAVHLDTAGIDVCLVGDSASMVVHGHDTTLPISLDEMLVHCRAVARGAKRPLLVGDLPFGTYESSSSQAVDTAVRVLKEGGMDAIKLEGGSASRITAAKAIVEAGIAVIGHVGLTPQAISVLGGFRPQGRNIASAVKVVETAMALQEAGCFSVVLECVPPPVAAAATSALKIPTIGIGAGPFCSGQVLVYHDLLGMMQHPHHAKVTPKFCKQYANVGEVINKALMEYKEEVSKKVFPGPSHSPYKITASELDGFLTELQKLGFDKAASAAALAAENMEPSK

SEQ ID NO: 100848 - DNA, 741 bp, Xylella fastidiosa 9a5c
  CDS (1)..(741): transl_table=11
atgttgactgcttatgatgctgggtttgctcgtattcttgacgcaaacggcgtagacctagtccttgttggcgattcgttgggaatggtggtacagggccatgactcgactcttccggtgagtgtgcatgacatggtgtaccacactgcgtgtgtggctcggggggtacgtcaggcaatgcttgtggttgatttgccatttcaggctgatgcgtcgccggagcgtgcgctagaggctgccactccattactgcgggtgggggcacagatgatcaaaatcgaaggtgctgggcacaagcttgaggtgattagttacttggttgagcgtgagattccggtgtgttcgcacttggggctgactccgcaatcggtactgcgttttggaggttataaggtgcaaggacgtggtgaggaggctggggggcgtttgcgtgccgaggcacgtgcggcggtggaggctggtgctactctcttgctattggagtgtgtgccgtcgcagttggcagcgcagatcactaccgatgtatcggtgccgacgattggtatcggtgccggtgctggttgtgatggccaagtgctggtgctgcatgatctccttggcctagacagtggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 100849 - protein, 246 aa, Xylella fastidiosa 9a5c
MLTAYDAGFARILDANGVDLVLVGDSLGMVVQGHDSTLPVSVHDMVYHTACVARGVRQAMLVVDLPFQADASPERALEAATPLLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 100850 - DNA, 801 bp, Yersinia pestis CO92
  CDS (1)..(801): transl_table=11
gtgatgaaaaccaccaccatgagccaattacgccaatggaaacaagagaaacgtaaattcgcaacgctgacggcctatgatgccagttttgcccagttatttgccgaacagggtattcaggtgctattggtgggggattcgctcggtatgacgttacaagggttcgattccacgctgccagtgaccgttgccgatatggcctaccatacccgtgcagtgcgccgtggtgcgcctcattgcctgttattggccgatatgccattcatgagttatgccacgccagaactggcctttacccacgcggcagagctaatgcgggccggagccaatatggtcaaactggaaggtgggagctggctgtgcgataccattcgcatgttggcagagcgcgcggtgccggtttgtgggcatctggggctcacgccacaatcggtgaatattttcggcggctataaagtacagggtcgtgaagaagtggcggccaatcaactgttgcaagatgctattgccctggaacaggcaggggctcaactgttggtactggaatgcgtgccggtagaactggcacagcgggtgaccgaagagttaaccataccggttattggtattggtgcggggaatgtcactgacggtcagattttggttatgcatgatgcactcggtattaccgggggtcatacgccaaaattcagtaaaaactttttagcacacagtgcgggcgatattcgtgccgccattaagctctatattgaagaagttgagggggggatttatcctgctgaagagcatacattccagtaa

SEQ ID NO: 100851 - protein, 266 aa, Yersinia pestis CO92
MMKTTTMSQLRQWKQEKRKFATLTAYDASFAQLFAEQGIQVLLVGDSLGMTLQGFDSTLPVTVADMAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 100852 - DNA, 759 bp, Caulobacter crescentus CB15
  CDS (1)..(759): transl_table=11
gtgcccattgtctgtctgaccgcctacaccgcgcctgtcgcggcggcgctcgacgacgcctgtgacgtgctgctggtcggggactcggtgggcatggtcgtgcatggcctgcccaacaccgtcggcgtgaccatggagatgatgatcctgcacggtcaggccgtgatgcggggctccaagaaggccatggtcgtcgtcgacatgccgttcggctcctacgaggcctcgcacgaggaggcctacgccaacgccgtgcggatcatgaaggagacgggcgcccaggcggtgaaggtcgagagcggcccgaccgtacccgagacgatcgcctacctgacccgccgcggcgtgccggtgatgggccacgtcggccttcgcccgcaagcggtgctgctggaaggcggcttcaaggccaagggcaaggatgatgcgggccgcgccaaggtgttggaagaagcgcgtctcaccgccgaggccggcgcgttcgccatcgtcgtggaaggggtcgccgaaagcctggcgcgcgaagtgaccgagtcggtctccgtgccgaccatcggcatcggcgcctcggccggttgcgatggccaggtgctggtcgtcgacgacatgctgggcctgttcgactggacgcccaagttcgtgcgtcgctacgccgacctgaagggcgagatcgagcgggcggccgcgcaatacgccagcgacgtgcgcgatcgcagcttcccgggaccggcggaaacctactacgccaagaagccataa

SEQ ID NO: 100853 - protein, 252 aa, Caulobacter crescentus CB15
MPIVCLTAYTAPVAAALDDACDVLLVGDSVGMVVHGLPNTVGVTMEMMILHGQAVMRGSKKAMVVVDMPFGSYEASHEEAYANAVRIMKETGAQAVKVESGPTVPETIAYLTRRGVPVMGHVGLRPQAVLLEGGFKAKGKDDAGRAKVLEEARLTAEAGAFAIVVEGVAESLAREVTESVSVPTIGIGASAGCDGQVLVVDDMLGLFDWTPKFVRRYADLKGEIERAAAQYASDVRDRSFPGPAETYYAKKP

SEQ ID NO: 100854 - DNA, 867 bp, Brucella melitensis 16M
  CDS (1)..(867): transl_table=11
atgcggcgccacagatcacacaggaaagggcagcctgacatgagtgcacccgtaacccgcaaacggctgacgccgaaggttattcaggcgatgaagggcgagtgtcccatcgtcagcctcaccgcttatacgacgccggttgcgcgtctgctcgacccgcattgcgacctgcttctggtgggggattcgcttggcatggtactttacggcatggagtccacccttgccgtcacgctcgacatgatgatcatgcatgggcaggcggtcatgcgcggtacaagccatgcctgcgtgatcgtggatatgcctttcggctcctatcaggaatcgaaggagcaggccttccgcaatgccgcccgtgtgatgcaggaaacgggctgtgacggcgtgaagctggaaggcggcgaggaaatggccgaaacggtggcctttctcgtccggcgcggcattccggtcttcggccatgtcgggctgatgccgcagcaggtgaatacggtcggcgggtttcgttcgctggggcgcggcgacgatgaagccggcaagatacgccgcgacgcgcaagccattgcccaagcgggtgctttcgcggtggtcatcgaaggcacggtcgagccgcttgcgcgcgaaataacggccttgatcgatattccgaccgtcggtatcggcgcttcatccgcctgcgacgggcaggttctggtttcggatgacatgctgggcctgttccaggatttcacgccgcgtttcgtcaagcgttttgcgcatctggcgccgcaggtgtcgcaagcggccgaagcctatgccgaagaggtgcgcgcgcgcagatttcccggcccggaacatgttttcggggccaagcccggagcgtga

SEQ ID NO: 100855 - protein, 288 aa, Brucella melitensis 16M
MRRHRSHRKGQPDMSAPVTRKRLTPKVIQAMKGECPIVSLTAYTTPVARLLDPHCDLLLVGDSLGMVLYGMESTLAVTLDMMIMHGQAVMRGTSHACVIVDMPFGSYQESKEQAFRNAARVMQETGCDGVKLEGGEEMAETVAFLVRRGIPVFGHVGLMPQQVNTVGGFRSLGRGDDEAGKIRRDAQAIAQAGAFAVVIEGTVEPLAREITALIDIPTVGIGASSACDGQVLVSDDMLGLFQDFTPRFVKRFAHLAPQVSQAAEAYAEEVRARRFPGPEHVFGAKPGA

SEQ ID NO: 100856 - DNA, 831 bp, Corynebacterium efficiens YS-314
  CDS (1)..(831): transl_table=11
gtggcctctatactcatcgtcatgtctggcattgatgcaaagaagatccgcacccgtcacatccatgaggcgaaggcgaatgggacgaagatttccgtcctcaccagttatgacgcgatgaccgccgccatctttgatgaggcggggatcgatatgctgctggtcggtgattccgccgccaatgtggtgctggggcgggagaccaccctgtcgatcaccctggatgagatgatcgtgctggccaaggcggtcaccatcgcggctaaacgtgcgctggtcattgtggatctgcccttcggcacctatgaggtcagtgagcagcaggcggtggaatccgccgtgcgcgtcatgcgggagaccggcgccgcggccgtcaagatcgagggtggtgtggagatggcctccaccatccggcgcattgtcgacgccggcattcccgtctgcgggcacatcggtttcaccccgcagtccgagcatgccctcggcggacccgtggtccagggccgcggcagcggtgcggacaagctgcttgccgacgcccacgccgtccaggccgccggtgccttcgccgtggtcctggagatggtccccgccgagatcgccaccgaggtgaccaaccagctcgacatcgccaccatcggcatcggcgcaggtaacggcaccgatggccaggtgctcgtgtggcaggatgccttcgggttcaaccggggccgcaagccgcgtttcgtccgtgagtacgccaccttaggcgatcagctgctcgaggccgcccgcgcctacgccgatgaggtgggctccggcgcgttccccggcgaggtggagagctactga

SEQ ID NO: 100857 - protein, 276 aa, Corynebacterium efficiens YS-314
MASILIVMSGIDAKKIRTRHIHEAKANGTKISVLTSYDAMTAAIFDEAGIDMLLVGDSAANVVLGRETTLSITLDEMIVLAKAVTIAAKRALVIVDLPFGTYEVSEQQAVESAVRVMRETGAAAVKIEGGVEMASTIRRIVDAGIPVCGHIGFTPQSEHALGGPVVQGRGSGADKLLADAHAVQAAGAFAVVLEMVPAEIATEVTNQLDIATIGIGAGNGTDGQVLVWQDAFGFNRGRKPRFVREYATLGDQLLEAARAYADEVGSGAFPGEVESY

SEQ ID NO: 100858 - DNA, 981 bp, Bradyrhizobium japonicum USDA 110
  CDS (1)..(981): transl_table=11
atgagtcgcgtttcggagcaaccggtcgaccgcatcacaattcccctcctgcagcggtggaagcaggacggccggcgtctagtcatgacgactgcctacgacgcggttgcggcgcctatcccggatccttccatcgatatcagtctcgtcggtgacagcgggggtaacgtctgccttggattcgaaaacacgcctccagtaagtgttgcgatgatgaaccatcacctcgaagccgccgtacgcagcaaaccgcgtgccttgctcgtcgccgatatgtcctttcttagcttccacgtcagcgttgaggagaccatacgaaatgctggcggatttctgcagcgaggagcagctgcggcgagactcgagggcggtggcaaaagaatcgagatggtgcgtgccattgtcgattgcgagattcccgtgatgggtcatctcggtcttgttccgcagagcgttaatgtcatgggcggcttcaaagtgcagggccgcaaagtggatgaagcgctgcgtttgctcgatgatgctcatcgtctgcaggaggccagctgtttcgctttggtattggagggcactccggctgagcttactgctcgagtaagcgattccttgacaataccgacgatcggaatcggctcgggcccagactgttcagagcaggtgctctgtttcatgacgtgctgggccaaaccgaaggtcatcgccccaaattcgttcccgcctatacggaaggctttcagcagttccatgatgcgctttcgcgcggggcagcggatgtccgccgtggcgcgttccccggcccgcaagagtcctatcggcttcccgaaggcgttggggaggcaattgccaactgggcgccatccacctcaaattatcacgagcgtcgctgaacttcgccgcactctcgcaaaatcccgcagtgccaatcaaagggccggattgtgccgacggtgggctatctccacgatggccacctggcgctga

SEQ ID NO: 100859 - protein, 326 aa, Bradyrhizobium japonicum USDA 110
MSRVSEQPVDRITIPLLQRWKQDGRRLVMTTAYDAVAAPIPDPSIDISLVGDSGGNVCLGFENTPPVSVAMMNHHLEAAVRSKPRALLVADMSFLSFHVSVEETIRNAGGFLQRGAAAARLEGGGKRIEMVRAIVDCEIPVMGHLGLVPQSVNVMGGFKVQGRKVDEALRLLDDAHRLQEASCFALVLEGTPAELTARVSDSLTIPTIGIGSGPDCSEQVLCFMTCWAKPKVIAPNSFPPIRKAFSSSMMRFRAGQRMSAVARSPARKSPIGFPKALGRQLPTGRHPPQIITSVAELRRTLAKSRSANQRAGLCRRWAISTMATWR

SEQ ID NO: 100860 - DNA, 897 bp, Bradyrhizobium japonicum USDA 110
  CDS (1)..(897): transl_table=11
gtgcggagcggattcaatatgagccacagttcagagcagcctctagagcgtgtcacgattccggcactgcagcagtggaaggataaaggacggcgtgtcgtgatgaccaccgcctacgatgcggttgcggcgcgcatcgcggatcccattgtcgatatcatcctggtcggcgatagcgttggaaacgtctgcctgggattcgacaacacgctgcccgtcagcgtggccatgatgaatcatcacctggaggctgttgcgcgcacgaggcctcatgccttgcttgtggccgacatgccctttctcagctttcatgtcggttctgaggatacgattcgcaatgcaggaggttttttacagcgtggcgccgatgctgtgaaactcgagggtggtgccaaacgcatcgagatggtacgcgccttggtcgattgcgacattcctgtgatgggacatctcggtctgaccccgcagagcgtcaacgtcatgggtggattcaaagtgcagggaaggacaacagataccgccttgcggttgctcgatgacgcgcaccgtctgcaggaagccggttgcttcgcgcttgtcctggagggcattcctgccgagctcgcggcgcgagcgaccgaatctctcacgatacccaccatcgggatcggagcaggagccgattgctcgggccaagtgctcgtgtttcatgatgtcttggggctaaccgaaggccatcgccccaaattcgttcgtgcctatacaaatggattccagttgttccaggaggcgctgtcgcgctgggctgccgatatccgcaaaggggcgttcccgggctcagaggagtgctatcggcttcctgatcagcttcggcatgccgtcgccaactgggtgccctccagttcaacctcaaggtaa

SEQ ID NO: 100861 - protein, 298 aa, Bradyrhizobium japonicum USDA 110
MRSGFNMSHSSEQPLERVTIPALQQWKDKGRRVVMTTAYDAVAARIADPIVDIILVGDSVGNVCLGFDNTLPVSVAMMNHHLEAVARTRPHALLVADMPFLSFHVGSEDTIRNAGGFLQRGADAVKLEGGAKRIEMVRALVDCDIPVMGHLGLTPQSVNVMGGFKVQGRTTDTALRLLDDAHRLQEAGCFALVLEGIPAELAARATESLTIPTIGIGAGADCSGQVLVFHDVLGLTEGHRPKFVRAYTNGFQLFQEALSRWAADIRKGAFPGSEECYRLPDQLRHAVANWVPSSSTSR

SEQ ID NO: 100862 - DNA, 819 bp, Tropheryma whipplei str. Twist
  CDS (1)..(819): transl_table=11
gtgatctgtatgtcacgcaaaccttctccaaccagacgaacaaggatacatcgctttcataaaggttcctgcggcaggaagctggtgggtcttacatgttatgacttttcaacagccagggtcctgagtgattgcgagctcgactttcttctagttggtgattcagcaagcggtgtgatttatggatatgaaaacacaggcagtgtctgtcttgacgaaattatttaccttgccgcaggcgttgtaagaggtgcaccaaatagctttattattgttgaccttccctttggaacatacgaaaaatctgatgaattagctgtcgaaacagcaatagaggttataaaaagaactggggcctcggctgtaaagcttgaaggtggtgctcgaatggcatgtaggataagcgcgattgtaagagctggtgtgccggttatgggacatattgggtttaccccgcagaccattaacgctcttggggggtacaaaatacagggacgtgataacgccgatttgatttacctggatgcacaggctgttgagcaggcaggggcttttgcggttgttatggaaatggtaactgaagatcttgcgaaaaccataacctcagaaatcaagataacaacaattggcgtcggcgcggggagatacacagatggacagttattagtcataaatgatttaattggcctgagtgaaaagaaaataacattcgcgccacgatacgcaagtattgataatactgtggcatcctgcgtaaaactatggcgaaaagatgttctagagggcaatttccctcagaaagaccatattccagcataa

SEQ ID NO: 100863 - protein, 272 aa, Tropheryma whipplei str. Twist
MICMSRKPSPTRRTRIHRFHKGSCGRKLVGLTCYDFSTARVLSDCELDFLLVGDSASGVIYGYENTGSVCLDEIIYLAAGVVRGAPNSFIIVDLPFGTYEKSDELAVETAIEVIKRTGASAVKLEGGARMACRISAIVRAGVPVMGHIGFTPQTINALGGYKIQGRDNADLIYLDAQAVEQAGAFAVVMEMVTEDLAKTITSEIKITTIGVGAGRYTDGQLLVINDLIGLSEKKITFAPRYASIDNTVASCVKLWRKDVLEGNFPQKDHIPA

SEQ ID NO: 100864 - DNA, 810 bp, Tropheryma whipplei TW08/27
  CDS (1)..(810): transl_table=11
atgtcacgcaaaccttctccaaccagacgaacaaggatacatcgctttcataaaggttcctgcggcaggaagctggtgggtcttacatgttatgacttttcaacagccagggtcctgagtgattgcgagctcgactttcttctagttggtgattcagcaagcggtgtgatttatggatatgaaaacacaggcagtgtctgtcttgacgaaattatttaccttgccgcaggcgttgtaagaggtgcaccaaatagctttattattgttgaccttccctttggaacatacgaaaaatctgatgaattagctgtcgaaacagcaatagaggttataaaaagaactggggcctcggctgtaaagcttgaaggtggtgctcgaatggcatgtaggataagcgcgattgtaagagctggtgtgccggttatgggacatattgggtttaccccgcagaccattaacgctcttggggggtacaaaatacagggacgtgataacgccgatttaatttacctggatgcacaggctgttgagcaggcaggggcttttgcggttgttatggaaatggtaactgaagatcttgcgaaaaccataacctcagaaatcaaaatagcaacaattggcgtcggcgcggggagatacacagatggacagctattagtcataaatgatttaattggcctgagtgaaaagaaaataacattcgcgccacgatacgcaagtattgataatactgtggcatcctgcgtaaaactatggcgaaaagatgttctagagggcaatttccctcagaaagaccatattccagcataa

SEQ ID NO: 100865 - protein, 269 aa, Tropheryma whipplei TW08/27
MSRKPSPTRRTRIHRFHKGSCGRKLVGLTCYDFSTARVLSDCELDFLLVGDSASGVIYGYENTGSVCLDEIIYLAAGVVRGAPNSFIIVDLPFGTYEKSDELAVETAIEVIKRTGASAVKLEGGARMACRISAIVRAGVPVMGHIGFTPQTINALGGYKIQGRDNADLIYLDAQAVEQAGAFAVVMEMVTEDLAKTITSEIKIATIGVGAGRYTDGQLLVINDLIGLSEKKITFAPRYASIDNTVASCVKLWRKDVLEGNFPQKDHIPA

SEQ ID NO: 100866 - DNA, 801 bp, Coxiella burnetii RSA 493
  CDS (1)..(801): transl_table=11
gtgattgctatgaatacccctgatttccaacgaatgaaaaaagacaataaaaaaatcagcatggtgacctgctacgattattggtcggcttgtattatctcccaaagtaacgtggactgtattttagtgggcgacagtttggcgatggtgatgtatggtcattcaacgacactacctgcgaccgtggagataatggcgcaacacattcaagcggtatcccgaggcgctcccaataaatttattatcggcgatatgccgttttgctcctatcgaaaagatttaacgacgagtatgaatgcggttgaacgactcatgcaagcgggcgcacaggcgattaaattagaaggcgctgacgcgcataatttaaaattcattcatcacgtcgtgaaatctggtattcctgtgataggacatctgggattaacgcctcagtctatttacactctcggtggttttaaagttcaaggcaaagaaccctctgcggctaaaaaattaatggcggatgcgaaggcattggctgagactggctgctttgcggtggtattagaatgtgtgccaagcgaattagcagaattaattacccactcgatttccattcccactatcggaattggtgcgggtcctgcgacttcagggcaagtgcttgtcttacaagatttgcttggcacgaataatcaatttcagcctaaataccttaaaaaatttttgaatggttttgaactgataaaaaaagccttagatgattttgatcaggaagtgaaaacctccacttatccacatctcgaaacacattgttattga

SEQ ID NO: 100867 - protein, 266 aa, Coxiella burnetii RSA 493
MIAMNTPDFQRMKKDNKKISMVTCYDYWSACIISQSNVDCILVGDSLAMVMYGHSTTLPATVEIMAQHIQAVSRGAPNKFIIGDMPFCSYRKDLTTSMNAVERLMQAGAQAIKLEGADAHNLKFIHHVVKSGIPVIGHLGLTPQSIYTLGGFKVQGKEPSAAKKLMADAKALAETGCFAVVLECVPSELAELITHSISIPTIGIGAGPATSGQVLVLQDLLGTNNQFQPKYLKKFLNGFELIKKALDDFDQEVKTSTYPHLETHCY

SEQ ID NO: 100868 - DNA, 795 bp, Helicobacter hepaticus ATCC 51449
  CDS (1)..(795): transl_table=11
atgttggataaaaaaatgagtatagctacactcaaggcaaaaaaagggattgaaaaaattacagcaattactgcgtatgatgcgcttatggcacgcatttttgatggtgaagttgatgtgattttggtaggtgatagcttgaaaatgagttttggtggagagaatgaaacattaggtgcaagtatgcaagagatgatttatcatacaaaggcagtgtgcaaaggcgctaagcattctttcatcattgcagatatgccttttggtagctatgctacaccaaatatggcattaaaaaatgcgcttagattctataaaaacactgcagcagatgcacttaagcttgaagtaggcattgataaattacctgtggtgaaagtactatgtgaagaagggattgctgtaatggcacatattggcttgaaaccccaatttatgcgctttgatggaggatttaaaataaagggcaaagatgaggttgaatctcaagaattgatagaagccgctgttgcattccaagaagctggggtttttgggattttgatagagggagtgaaatcggaatctggtgcacgcattacacaagctttagagattccaacgattggcattggtgcaggtgtggagtgtgatgggcagattcttgtatggagcgatgcttttggcttttttgatgagtttaagccaaaatttgtgcgccgctattgtgatggtaaagcgatacttaaagatgccataagagcgtatgccaaagatgtaaaatctcaagcatttccacaagcccaagagagctattaa

SEQ ID NO: 100869 - protein, 264 aa, Helicobacter hepaticus ATCC 51449
MLDKKMSIATLKAKKGIEKITAITAYDALMARIFDGEVDVILVGDSLKMSFGGENETLGASMQEMIYHTKAVCKGAKHSFIIADMPFGSYATPNMALKNALRFYKNTAADALKLEVGIDKLPVVKVLCEEGIAVMAHIGLKPQFMRFDGGFKIKGKDEVESQELIEAAVAFQEAGVFGILIEGVKSESGARITQALEIPTIGIGAGVECDGQILVWSDAFGFFDEFKPKFVRRYCDGKAILKDAIRAYAKDVKSQAFPQAQESY

SEQ ID NO: 100870 - DNA, 771 bp, Prochlorococcus marinus subsp. marinus str. CCMP1375
  CDS (1)..(771): transl_table=11
atgcttcctaaggaattagttcgatttaaagaacttggaaatcaaatcacaatcctcactgcttgggacagcctttcttcggcaattgttgaagctgcaggagcagatgttgttcttgtaggggactcactagcaatgttcattcatgggcataccacaacattgcctgtaactcttgaacaaatgctccatcacactcaagctgttgggagaggttttttaagtccaaaaaataagcaacctctagtagtttgtgatcttccatttctgagttatcaatgtggagaagataaagccgtagcggcagctggaaccttactgaaaaactcttgtgctgcagctgtaaaaatcgaaggagctgaacctgaagtcatttcagttattgaaaggcttattcgaatgggcatacctgtaatggggcaccttggcttaaccccacaatcagttaataatcttgggtatcatcgacaagctgaagacgcattggggcaagaaaagttagtcactcaggctctaaaaattgaacaggttggctgcttttcagtagtcttagaacatgtcccttcaaaagttgccagtaaagtaactcaaatgctcaaaatccctgtaataggaattggtgcaggagaggaatgtgatggtcaagtaagagtaaccgcagatttactaggccttacagacaaacagcctccatttgcaaaaccccttatagatggaaggtccttatttatagaatcacttacaagttgggttgatcaattgaggaattaa

SEQ ID NO: 100871 - protein, 256 aa, Prochlorococcus marinus subsp. marinus str. CCMP1375
MLPKELVRFKELGNQITILTAWDSLSSAIVEAAGADVVLVGDSLAMFIHGHTTTLPVTLEQMLHHTQAVGRGFLSPKNKQPLVVCDLPFLSYQCGEDKAVAAAGTLLKNSCAAAVKIEGAEPEVISVIERLIRMGIPVMGHLGLTPQSVNNLGYHRQAEDALGQEKLVTQALKIEQVGCFSVVLEHVPSKVASKVTQMLKIPVIGIGAGEECDGQVRVTADLLGLTDKQPPFAKPLIDGRSLFIESLTSWVDQLRN

SEQ ID NO: 100872 - DNA, 774 bp, Prochlorococcus marinus subsp. pastoris str. CCMP1986
  CDS (1)..(774): transl_table=11
atgttgccatcagaactagttaaatataaaaaaaaatctcaaaagattattgcattaactgcatgggattctatttcaggttctctagctgaacattcaggagcagatattgttctagtgggagactctttagcaatggtctgtttgggatacaaatcgaccttgcctgttacgttagagaatatgatttatcatacaaatgcagtttctagagggttcagcaaagaaatagaagaacagtcattattagtatgtgatatgccttttcttacttatcaatgcggagaaaacaaggcagtggaatatgcaggaaaaataattaagaatacttatgcaaaggcagtaaaagttgagggcgctgatccagaggtacagaatgttatttcaagactcataaggatgggaattcctgtcatgggtcatttagggcttactccacaaagctatttgaatctaggatttaaacaacaagggaacaattcagaaagtcacgaaaaaatcaaacgagatgctttatcactagaaaaattaggatgtttttctatagttttagaacatattccagaattacttgctaaagaaattcaaaccgaattagaaataccaacaataggtataggtgcaggaaaattttgtgatggacaagtaagagttactgctgatttattaggactaaatgataagcaacctccattttgtagaccaattattgatggaaaaaaaatttttggtgaaaaactaaaagaatgggtagcagccgaaaagctcaattaa

SEQ ID NO: 100873 - protein, 257 aa, Prochlorococcus marinus subsp. pastoris str. CCMP1986
MLPSELVKYKKKSQKIIALTAWDSISGSLAEHSGADIVLVGDSLAMVCLGYKSTLPVTLENMIYHTNAVSRGFSKEIEEQSLLVCDMPFLTYQCGENKAVEYAGKIIKNTYAKAVKVEGADPEVQNVISRLIRMGIPVMGHLGLTPQSYLNLGFKQQGNNSESHEKIKRDALSLEKLGCFSIVLEHIPELLAKEIQTELEIPTIGIGAGKFCDGQVRVTADLLGLNDKQPPFCRPIIDGKKIFGEKLKEWVAAEKLN

SEQ ID NO: 100874 - DNA, 819 bp, Prochlorococcus marinus str. MIT 9313
  CDS (1)..(819): transl_table=11
atgcgccccagcgaattaactcaactcaagcaggacgggcgagcgatcagcatcctcacagcctgggatggcataagtgcggccttggttgaggccgctggagccgatgtggttctagtaggagactccctagcgatggtggcactgtgccatgcaaccaccctgcctgtgacagtggagcagatgctccaccacaccaaagcggtggggaggggtttcactcgccctctgccacaacagcccctcgtcgtctgcgacctcccattcctgagctaccaatgcggagaagacaaggctgtagctgcagctggaagcctgctcaagcactcctgtgcagccgccgtgaagctagaaggagcagagccagaggtcctagcagtcattgagcgtctggtgcgcatggggatcccagtcatggggcatttgggcctcactccacaagcagtacatcagctcggctaccgccgtcaggcggaggaccctcgcagccaagcgcaaatgctgcaacaagcaaaacaacttgagcaagcgggctgtttcgccctggtggtcgaacatgtgccgagttccatcgctcgttgcctgagtcaacaactcaccatccccgtgatcggtatcggcgctggcgaagattgcgatggacaggtaagggtcaccgctgacctgttgggactgactcccagccaaccccccttcagtcaaccattgatccaaggtcgccagctgtgcgtagaagcccttcaaggttgggtgaagcaactgcatcagcaggcaaagactgccaccacaacaacatctccaccagaacctgattgctga

SEQ ID NO: 100875 - protein, 272 aa, Prochlorococcus marinus str. MIT 9313
MRPSELTQLKQDGRAISILTAWDGISAALVEAAGADVVLVGDSLAMVALCHATTLPVTVEQMLHHTKAVGRGFTRPLPQQPLVVCDLPFLSYQCGEDKAVAAAGSLLKHSCAAAVKLEGAEPEVLAVIERLVRMGIPVMGHLGLTPQAVHQLGYRRQAEDPRSQAQMLQQAKQLEQAGCFALVVEHVPSSIARCLSQQLTIPVIGIGAGEDCDGQVRVTADLLGLTPSQPPFSQPLIQGRQLCVEALQGWVKQLHQQAKTATTTTSPPEPDC

SEQ ID NO: 100876 - DNA, 804 bp, Synechococcus sp. WH 8102
  CDS (1)..(804): transl_table=11
gtgcgtccagctgatctgatccgacagaagcagaacggtcgaacgatcacgatcctcacggcctgggacagtctctctgcggccctggtggaagccgctggcgcggatgctgttttggtgggggactccctggcgatggtggccctgggacatgccaccaccctgccggtgaccctcgatcagatgcggcaccacacccttgcggtcagccgcggattcgccgcagctccctccaagcaaccgctgttgatctgcgaccttcccttcctcagctatcaatgcggggcagacctcgccgttcaggccgcaggaacgctgttgaaggaaacacccgctgccgccgtcaagctcgagggggccgaggctgaggtcctggccgtgatcgaccggctggtgcggatggggattccagtcatgggccatttgggactgacgccgcaggcggtgcatcgtcttggctaccggcggcaagccgaagatccggtgagtcaggaacggctgctcacccaggcgattgccctcgagcaggcgggttgcttcgcgcttgtgctcgagcatgtcccctcggctcttgctagagaggtgcgacgacgtctcctgatccctgtgatcggcatcggtgctggagacgactgcgatggccagatccgcgtcaccgctgacctgctgggcctgacggagcagcaaccacccttcagcccggccctgattcccgggcagcagctgtttgtggaggcgctgcggacgtggattgctgcacagactcccaccacaacaccacctccagcaacacccgattactga

SEQ ID NO: 100877 - protein, 267 aa, Synechococcus sp. WH 8102
MRPADLIRQKQNGRTITILTAWDSLSAALVEAAGADAVLVGDSLAMVALGHATTLPVTLDQMRHHTLAVSRGFAAAPSKQPLLICDLPFLSYQCGADLAVQAAGTLLKETPAAAVKLEGAEAEVLAVIDRLVRMGIPVMGHLGLTPQAVHRLGYRRQAEDPVSQERLLTQAIALEQAGCFALVLEHVPSALAREVRRRLLIPVIGIGAGDDCDGQIRVTADLLGLTEQQPPFSPALIPGQQLFVEALRTWIAAQTPTTTPPPATPDY

SEQ ID NO: 100878 - DNA, 1095 bp, Oryza sativa (japonica cultivar-group)
  CDS (1)..(1095)
atgatgatgatgatgcggcgggcgttccggcacctggcgcggcagcagcggcggccgctgagccacgtgccggagtcggccgtctacggcgggccgcggccgcaggatgtgggggcggcggcgggagcgggggcgggggcgggggcgacgcggcgggtgacggtgacgacgctccgcgggaagcaccgacgcggggagcccatcaccgtcgtcacggcctacgactacccgtccgcggtgcacgtcgactcggccgggatcgacgtctgcctcgtcggggactcggcggccatggtggtgcacggccacgacaccacgctccccatctcgctcgacgtcatgctcgagcactgccgcgccgtcgcccgcggcgccaccaggccgctcctcgtcggcgacctccccttcggttgctatgagtcctcctccacgcgggctgttgactctgcggtgagggtgctaaaagaaggtggaatggacgcaatcaagctggaaggaggtgcaccctcgagaatcagtgcggctaaggctattgtggaggctggaatcgctgtaatggggcatgttgggctcacgccgcaggctattagcgtgcttggtggatttcgaccacaaggaaagacggttgatagtgctgtgaaggttgtggagacagcacttgccttgcaggaggctggctgcttctcggttgtgttggagtgtgtgccagctcctgtggcagctgctgcaacatcagcattgcaaatcccaaccattggaattggtgctggaccattctgcagtggacaggtcttagtttaccatgacttgttagggatgatgcaacatccacaccatgccaaggtcacaccgaaattctgcaaacaatttggaaatgtcggtcatgtcatcaacaaggctctatcggagtacaagcaggaagtggaaacccggagtttcccaggtcccagccatacgccgtacaagatagctgccgcggatgtggatggcttcgcgaatgcactgcagaagatgggcttggacgaggctgcaaatgctgcagctgccgcagctgaaaacgcagagaaagatggagaactacccgagaacaaatga

SEQ ID NO: 100879 - protein, 364 aa, Oryza sativa (japonica cultivar-group)
MMMMMRRAFRHLARQQRRPLSHVPESAVYGGPRPQDVGAAAGAGAGAGATRRVTVTTLRGKHRRGEPITVVTAYDYPSAVHVDSAGIDVCLVGDSAAMVVHGHDTTLPISLDVMLEHCRAVARGATRPLLVGDLPFGCYESSSTRAVDSAVRVLKEGGMDAIKLEGGAPSRISAAKAIVEAGIAVMGHVGLTPQAISVLGGFRPQGKTVDSAVKVVETALALQEAGCFSVVLECVPAPVAAAATSALQIPTIGIGAGPFCSGQVLVYHDLLGMMQHPHHAKVTPKFCKQFGNVGHVINKALSEYKQEVETRSFPGPSHTPYKIAAADVDGFANALQKMGLDEAANAAAAAAENAEKDGELPENK

SEQ ID NO: 100880 - DNA, 1200 bp, Oryza sativa (japonica cultivar-group)
  CDS (1)..(1200)
atgtctttctcccgcctcctaaccccaagaattctcctggacaccaccgccgtgttcccgccaagcagcagcgtcgtcgccccgtcgctctcccgccaactgcggtgcacgcgcacgggtgggtcgccgccggcgccgccgcataggctcgtggcgcggcgggcgatgagcaacggggcggcggagccggccatctacggcggcggcggcggcgcacaacaggcggcgtcgtctgctgcggcgcggcgcgtgacgctggcgacgctccgcgggaagcaccggcgcggggagccgatcagcatggtgaccgcctacgactacccgtccggggtgcacgtcgacgccgccgggttcgacatctgcctcgtcggcgactccgccgccatggtcgcgcacggccacgacaacaccctccccatctccctcgacctcatgatcgagcactgccgcgccgtggcgcgcggcgcggccaggacgttcctcgtcggcgacctcccgttcggcagctacgaggcctccaccgcacaggctgtcggctcggcggtgagggtgatgaaggaaggcggcgtgaattcaatcaagctggaagggagcgcgccgtcgaggatcagcgcggcgagggccatcgtggacgccgggatcgccgtgatggggcacatcgggctcacgccgcagtccgtcagcgcgctcggcgggttccggccacaggggaagacggtcgagagcgccgtcaaggtcgtggaggcggcgctcgcgttgcaggaggccggctgcttcgccgtcgtgctggagtgcgtgccggctccggtggcggcggcggcgacttcggcactgacaatcccgaccattggcatcggcgccgggccattctgcagcgggcaggtcttagtctaccacgacttgttagggacgttccaaacaagtcatgccaaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttga

SEQ ID NO: 100881 - protein, 399 aa, Oryza sativa (japonica cultivar-group)
MSFSRLLTPRILLDTTAVFPPSSSVVAPSLSRQLRCTRTGGSPPAPPHRLVARRAMSNGAAEPAIYGGGGGAQQAASSAAARRVTLATLRGKHRRGEPISMVTAYDYPSGVHVDAAGFDICLVGDSAAMVAHGHDNTLPISLDLMIEHCRAVARGAARTFLVGDLPFGSYEASTAQAVGSAVRVMKEGGVNSIKLEGSAPSRISAARAIVDAGIAVMGHIGLTPQSVSALGGFRPQGKTVESAVKVVEAALALQEAGCFAVVLECVPAPVAAAATSALTIPTIGIGAGPFCSGQVLVYHDLLGTFQTSHAKVSPKFCKQYGNIGDVINRALSKYKQEVETQSFPGPSHTPYKLAATDVDAFLNALKMKGLNVAADAAADAVEYTDEKEINGTPQLKVYA

SEQ ID NO: 100882 - DNA, 792 bp, Corynebacterium diphtheriae NCTC 13129
  CDS (1)..(792): transl_table=11
gtgacccgtcccgtccgactgcaagacttgcgcgactacaaaaagaacaaccgtccgtgggccatgctgaccacctacgactactccaccactcgcgcatttgtggacgcgggtatcgaggttttcctcgtaggagattctgcggccaacacaatgctgggatattccggaactaaccaggtgagctttgaggagatggtcatgctcacggcggcggtggtgcgcggtgcgggtcctgcgatggtggtggctgaccttccgttcggcacctacgaggcgagtgacgagcaggcggtgcgcagtgccacggagatggttcgtcgaactggtgctcacgtggtcaagcttgaaggtggcgttcggatggcgtcgcggattcgcgctattacagatgcaggggttccggtgtgcgcacacctaggttttactccgcagtcgatgaatcagctttctggttttaaggtgcagcgaggcgcggagaagctgacggctgatgtggatgctgtcgtggaggcgggtgcagagatggtggtgtttgagatggttccggcggatcttgccgcggagcttactgcccgctgcccgattccggtgattggaattggcgccggcaatgctaccgacgcccaggtgttggtgtggcacgatatcgcgaatcttcctaaaggtgatcatcgtgcccgttttgttaagacgtatgcagaggttggttcgcagcttacttgcgcggcgcggttctatcgaaaggatgtggaggcacgtcgcttccccgctgaggagcacacgttctaa

SEQ ID NO: 100883 - protein, 263 aa, Corynebacterium diphtheriae NCTC 13129
MTRPVRLQDLRDYKKNNRPWAMLTTYDYSTTRAFVDAGIEVFLVGDSAANTMLGYSGTNQVSFEEMVMLTAAVVRGAGPAMVVADLPFGTYEASDEQAVRSATEMVRRTGAHVVKLEGGVRMASRIRAITDAGVPVCAHLGFTPQSMNQLSGFKVQRGAEKLTADVDAVVEAGAEMVVFEMVPADLAAELTARCPIPVIGIGAGNATDAQVLVWHDIANLPKGDHRARFVKTYAEVGSQLTCAARFYRKDVEARRFPAEEHTF

SEQ ID NO: 100884 - DNA, 1065 bp, Arabidopsis thaliana
  CDS (1)..(1065)
atggctgcttcgctcgtcaggagttgttgctctcgtgcttcgagagccatcaccaccgtccggtttatgagcaacgtaccggaggacacggtttacggaggaccgaaaccgcagaactcgaatcagagagtgactttgacgcaattgagacagaagcatcggaaaggtgagccgataactatggtcaccgcctacgattacccttctgccgttcacatcgatacagctggaatcgatgtttgtctcgtcggagattcagctgccatggttgtccatggctatgacaccactcttcctatctccttagaggagatgcttgttcactgtcgcgccgttgctcgcggagccaaaagaccacttcttgtcggcgatttgccgtttggtacttatgaatctagcaccaatcaggcggttgatactgcagttagggtgttgaaagaaggaggaatggatgctattaaacttgaaggaggatcaccttcaaggatcactgctgcaaaatccattgtggaagcagggattgccgttatgggacatgttgggttgactcctcaagctatcagtgttcttggtggtttcaggccacagggcaaaaacattgctagtgctgttaaggttgtggaaactgctatggctttgcaagaagctggatgtttttcggttgttttagaatgtgttccacctcctgtggctgctgctgcaacctctgctcttaatattccaaccattggcataggagctggccctttctgcagtggtcaggttttagtctaccatgatcttctgggaatgatgcagcatccacatcacgctaaggttactccaaagttttgcaaacagtacgctcaagtaggagaagtgatcaacaaagccctcttggagtataaggaagaagtatccaaacacttgtttccaggtccttctcacagcccttacaagatctcctcaagcgacctggacggattcttaagcgagttacagaaattgggattagataaagctgcttctgatgcagcagcatcagctgaaaagatggatcattcagattcaccatcttctcagtga

SEQ ID NO: 100885 - protein, 354 aa, Arabidopsis thaliana
MAASLVRSCCSRASRAITTVRFMSNVPEDTVYGGPKPQNSNQRVTLTQLRQKHRKGEPITMVTAYDYPSAVHIDTAGIDVCLVGDSAAMVVHGYDTTLPISLEEMLVHCRAVARGAKRPLLVGDLPFGTYESSTNQAVDTAVRVLKEGGMDAIKLEGGSPSRITAAKSIVEAGIAVMGHVGLTPQAISVLGGFRPQGKNIASAVKVVETAMALQEAGCFSVVLECVPPPVAAAATSALNIPTIGIGAGPFCSGQVLVYHDLLGMMQHPHHAKVTPKFCKQYAQVGEVINKALLEYKEEVSKHLFPGPSHSPYKISSSDLDGFLSELQKLGLDKAASDAAASAEKMDHSDSPSSQ

SEQ ID NO: 100886 - DNA, 927 bp, Eremothecium gossypii
  CDS (1)..(927)
atgctagctagcagaccaatcaaagccatggcgcttcggcgtatgtactcgatccattcctcgtcaaagcaaaagacaattccggacatttttaagaagtaccatgcaaaagagccgatctcgatgatcaccgcgtatgattatatcacagcaacatgggcacacgccgcacacacagacatgatactggtcggtgattcgctggcaatgtccacgctgggtcatgtgtccacggtggacctggatctgcaggagttccaataccacgtccggtcggtgtgtagagcaccaggctcgtcctttataattgcagatatgccatatggtagctttgagcgaagcattgagcagggagtagagacggcgatctcgcttatgaagacatccagcagggtgggtgctgttaagctcgaggttggcgcggaagaaaacgactactgtcttgagcttgccgcagagctctgcaggcgcgggatcccagtaatgggccatgtcgggctgaccccgcagcgcatgcatgcattgggcgggtacaaggttcagggcgcaaaggacttgggccaggcgctggcggcgtaccaccgggctaaagatctgcaggctgcaggctgtttttccatcgtcatcgaatgcattccaactaaactagccggtatcataacggagaaactcagtatacctactattggcattggcgcgggcccccagacaagcgggcaggtgctcgtacagtcggatctgctgggcatgttgccagggaaggcgccgaaatttgtgcagaagtacgcggacttccacggggacgccataggttccttgtgctcctatgttgaagatgtgcgccagggcgtcttcccgaaagtggggcaacatacgtttactgtctcagaggaattgctagaggaattctctaaacaggttgattga

SEQ ID NO: 100887 - protein, 308 aa, Eremothecium gossypii
MLASRPIKAMALRRMYSIHSSSKQKTIPDIFKKYHAKEPISMITAYDYITATWAHAAHTDMILVGDSLAMSTLGHVSTVDLDLQEFQYHVRSVCRAPGSSFIIADMPYGSFERSIEQGVETAISLMKTSSRVGAVKLEVGAEENDYCLELAAELCRRGIPVMGHVGLTPQRMHALGGYKVQGAKDLGQALAAYHRAKDLQAAGCFSIVIECIPTKLAGIITEKLSIPTIGIGAGPQTSGQVLVQSDLLGMLPGKAPKFVQKYADFHGDAIGSLCSYVEDVRQGVFPKVGQHTFTVSEELLEEFSKQVD

SEQ ID NO: 100888 - DNA, 930 bp, Neurospora crassa
  CDS (1)..(930)
atgggcctcccgcccaccaacccccgcaaaaaggtcacgctcaacacgctgcagtccatgtacaaaaagggcgagaaaatcaccatgatcacggcgcacgatttcccttcggcacacgtggccgagcacgcgggcatggacatgatcctggtgggcgacagcctggccatggttgctctggggatggaggacacgagcgaggtgttggtggaggagatgttgctgcattgtcggagtgtggcgagggctactagccgggcttttactgtcggcgacctccccatgggctcctacgaaatctccccccaacaagccctctccaccgccatccgcttcatcaaagaaggccgcgtgtccgccgtcaaactcgaaggcggcgccgagatggcccccaccatccgcgccatcaccaccgccggcatccccgtgctcgcccacatcgggctcactccccagcgccaaaacgccctgggtggcttccgcgtccagggcaaatccaaagaatccgccaagcgattactccgagacgccctggccgtccaggaggccggtgctttcgccgtggtggtggaggccgtgccgcaggaggtggcggccttcatcaccggtctcctgaaaatcccaaccattggcattggtgctggaaacggcacgagtggccaggtgctggtgcaggccgatatgacggggaatttcccgcctgggaggttcttgcccaagtttgtgaaaaagtatggcgatgtgtggggggaggcgttgagggctattgagacgtatagggatgaagtcaagggcgggagttatccggccgaggagcatacgtacccgatggcgaaggaggaggtggaggcctttgtgggggatgtgaggaggctgatgaatgcgaatgcgtctgccaaggctgaaggggagggtgagaaggatgcgtga

SEQ ID NO: 100889 - protein, 309 aa, Neurospora crassa
MGLPPTNPRKKVTLNTLQSMYKKGEKITMITAHDFPSAHVAEHAGMDMILVGDSLAMVALGMEDTSEVLVEEMLLHCRSVARATSRAFTVGDLPMGSYEISPQQALSTAIRFIKEGRVSAVKLEGGAEMAPTIRAITTAGIPVLAHIGLTPQRQNALGGFRVQGKSKESAKRLLRDALAVQEAGAFAVVVEAVPQEVAAFITGLLKIPTIGIGAGNGTSGQVLVQADMTGNFPPGRFLPKFVKKYGDVWGEALRAIETYRDEVKGGSYPAEEHTYPMAKEEVEAFVGDVRRLMNANASAKAEGEGEKDA

SEQ ID NO: 100890 - DNA, 1122 bp, Magnaporthe grisea 70-15
  CDS (1)..(1122)
atgcaccctcccgcagccacaacggccctggcccggtcgtgtgcctcagtggcttccacattggtcaggggtcgcgcgatcaacttgcccaggacacaacagccatgccgcactttgagcagcatcgcagtctcgccggcaaggccttcaaaccacccagaccaggtgtctactgcagcctcgcagaaaccacaacaacagcaacaatgcagacatagctcgcattccccaatgggcgcacctattgccaaccagcgcaagaaggtaaccctcggcaccctgcgttccctctacaaaaaaggggaaccaatcactgtcatgacggcgcatgactttcccagcgcccatgtcgccgatgctgccggcatggacatcatcctcgtgggcgacagcctggccatggttgccctgggtatggaggataccagcgaggtcgtgttggacgagatgttgctgcactgccgttcggtcgcaagggccacaaaatccgcattcactattggcgaccttcctatgggctcctatgaggtctcacccgaacaggcccttcagacagctattcgcttcgttaaggaaggccgggtgcagggcattaagatcgaaggcggccgagagatggcaccgacgatccgcaaaatcaccggtgctggcattcccgtcctgggccacattggcctgaccccccaacgccaacactcgctgggtgggttccgagtccaaggcaaaacatctgctgctgcccaatccctcctgcaagatgccctcgcagttcaggaagccgggtgctttgcaacagtcgtcgaagctgtccccgctgaggtttctgcccttttaaccaagaagctgtccatacctacgattggtatcggcgcgggcaatggctgttccggacaggttctggtgcagattgatatgacggggaacttcccacccggtcgcttcctacccaagttcgtcaagaagtacggagatgtttggggagagtcgatgagggcgatcgaggcttatcgggatgaggttaagagcagagcctatcctggccctgagcatacgtatccgatgccgagcgaagagctggctgcgttcaaagccgtgatcgagggcgagaagagcttggaatag

SEQ ID NO: 100891 - protein, 373 aa, Magnaporthe grisea 70-15
MHPPAATTALARSCASVASTLVRGRAINLPRTQQPCRTLSSIAVSPARPSNHPDQVSTAASQKPQQQQQCRHSSHSPMGAPIANQRKKVTLGTLRSLYKKGEPITVMTAHDFPSAHVADAAGMDIILVGDSLAMVALGMEDTSEVVLDEMLLHCRSVARATKSAFTIGDLPMGSYEVSPEQALQTAIRFVKEGRVQGIKIEGGREMAPTIRKITGAGIPVLGHIGLTPQRQHSLGGFRVQGKTSAAAQSLLQDALAVQEAGCFATVVEAVPAEVSALLTKKLSIPTIGIGAGNGCSGQVLVQIDMTGNFPPGRFLPKFVKKYGDVWGESMRAIEAYRDEVKSRAYPGPEHTYPMPSEELAAFKAVIEGEKSLE

SEQ ID NO: 100892 - DNA, 1404 bp, Gibberella zeae PH-1
  CDS (1)..(1404)
atgtcatcccttatcaatcctaccatgaggtcttgcacctctttcctatcccggatgcccgtgtcgtcctatcggccggcgatccggtccctcggcagctccgttcggcccctcatcatccgaggtgtggcgcagtcccggtatagttcacactctcccatgggtgcgcctccggctgcccagcgcaagaaggtcactgtcggaacccttcgctccatgcaccgcaagggtgatcccatcactgtcatgacagctcatgatttccccagtggtcatgttgccgatcatgcaggcatggacatcattcttgtcggtgatagtcttgccatggttgcccttggtatggaagacacaagtgaagttatcatggaggagatgctgctgcactgccggtcggttgcgagagccactaaatccgctttcactgtcggcgacctgcccatgggtacatatgagataagccctgaccaggctcttgcgactgccatccgttttatcaaggaaggtcgtgttcaaggtgtcaagcttgagggtggaaaggagatggctcccaccatcaagaaaatcaccactgctggtattcccgttcttggccatatcggtttgacccctcagcgacagaacgctcttggtggcttccgcgtccagggcaagacaagtagcggtgctatgagcatcctcgaggatgcccttgctcttcaagaagctggctgctttgctatggttgttgaagctgttcctgccgaggtggccgcgctcatcaccgagaagctctctgttcccacgatcggtattggtgctggtaacggtacctctggtcaagtccttgtgcaggtcgacatgattggaaacttccctcctggaagattcctccccaagtttgtcaagaagtacggtgatgtctggggcgagagtttgagagccatcgaggcgtatcgcgacgatgtcaaatcccgtcagtaccctggccccgagcacacgtacccaatttcagcagaggaactcgagagttttaccaaggcgatagaagaaattgacctcgttggcctcatccaaaagcaggtgttagagagtaagcaacaacaagttgaccgtacactgtccgtctctttacacctcaacttcttcctcaagtatctcacaacctcttcaaaacgtctcgtggcactgatcttgcatacatcttgggccaacaacggcgcagacccgacgggtttaaatcgcaccacgatcttgtcggtcttgaaacttcctgcggcttcgagcgcggccgttgcatctcttggtaggtcggccagtactactgacgccgacatgattcaaggcttttctgttttccagtttggtggaaatatgtttgttggtgagagttacgtcttcatcatgactcctcaagctttttaa

SEQ ID NO: 100893 - protein, 467 aa, Gibberella zeae PH-1
MSSLINPTMRSCTSFLSRMPVSSYRPAIRSLGSSVRPLIIRGVAQSRYSSHSPMGAPPAAQRKKVTVGTLRSMHRKGDPITVMTAHDFPSGHVADHAGMDIILVGDSLAMVALGMEDTSEVIMEEMLLHCRSVARATKSAFTVGDLPMGTYEISPDQALATAIRFIKEGRVQGVKLEGGKEMAPTIKKITTAGIPVLGHIGLTPQRQNALGGFRVQGKTSSGAMSILEDALALQEAGCFAMVVEAVPAEVAALITEKLSVPTIGIGAGNGTSGQVLVQVDMIGNFPPGRFLPKFVKKYGDVWGESLRAIEAYRDDVKSRQYPGPEHTYPISAEELESFTKAIEEIDLVGLIQKQVLESKQQQVDRTLSVSLHLNFFLKYLTTSSKRLVALILHTSWANNGADPTGLNRTTILSVLKLPAASSAAVASLGRSASTTDADMIQGFSVFQFGGNMFVGESYVFIMTPQAF

SEQ ID NO: 100894 - DNA, 954 bp, Candida glabrata CBS138
  CDS (1)..(954)
atgatgatgctaaatagattgaaatgtttgggaaaagggccgttgaggttttattcagttcattcagatacggcaggagctactaagactattttggacttgcagcggaagtatgtggaaaggaaaccacttactatgtgtacagcatatgatttcattactgcaagttgggttcagaaagcggatacagatattcttttgattggtgattccatgggcatgacttccctagggtatgattcaacttcatcgttaactttagatgaatttaaatatcatgtcaaatctgtctgtagagcagaaggtccgtcttttattgtcagtgatatgccattcggaagttttgaaactagcataagccaaggtattcaaacggcaattgatctaatgagatccagcagtaaagtaaaatcaatgaaaattgagtccggttcctgtcatagtgaccatcatacctacaagttaattggcgaactttgttcaagaggtatacctgtgatgggccatataggtttaacaccacagcgacaacactcattgggtggtttcaaagtccaagccaacaagagtgtgcaggaaatacatgatcttttggcatctgcaaagaaattagaagaacttggatgctggggcatcgtattggaatgcatacctcagagagtggctggatttatcacgaaagcattatccataccaacaattggtataggtgctggtaaccagactagtggccaagtccttgttgtatcagatttgttgggcttcctggatagcacaccgccaaaatttgtaaaagaatatgacaacttggggcaacgagcaattgatagcattaaagcatacaactcagacgttactacaaaggctttcccagaaactggaaaacataatttcaaaattaaagaggatatatggaaccaattcttgtcggaagtaaaagttgataaaacataa

SEQ ID NO: 100895 - protein, 317 aa, Candida glabrata CBS138
MMMLNRLKCLGKGPLRFYSVHSDTAGATKTILDLQRKYVERKPLTMCTAYDFITASWVQKADTDILLIGDSMGMTSLGYDSTSSLTLDEFKYHVKSVCRAEGPSFIVSDMPFGSFETSISQGIQTAIDLMRSSSKVKSMKIESGSCHSDHHTYKLIGELCSRGIPVMGHIGLTPQRQHSLGGFKVQANKSVQEIHDLLASAKKLEELGCWGIVLECIPQRVAGFITKALSIPTIGIGAGNQTSGQVLVVSDLLGFLDSTPPKFVKEYDNLGQRAIDSIKAYNSDVTTKAFPETGKHNFKIKEDIWNQFLSEVKVDKT

SEQ ID NO: 100896 - DNA, 957 bp, Kluyveromyces lactis NRRL Y-1140
  CDS (1)..(957)
atgtggagcaacggtatgattcggtgtataggcaggagatggtactcgctgcagaacagctcggcggttgcagcaaccgccaaagctgttcatcagcttaccgttaaggatattatggcaaaataccatcgtagaaaccccatttcgatggttactgcgtatgactatataacagcaagctgggcacagaatgccaactcagatatgattttagtaggtgactccgtcgctatgtgttctttagggtatgaatcaactactcagctttctcttgacgaatttcaatatcatgttggtgctgtttgtcgcgctccaggtcctgcatttgtcgttgtcgatatgcccttcggatcctttgaaagatcaatttctgatgggatcggtaacgcgttccagttgttacatttgaatcccaaagtgcaagccgtgaaagtagagtgtggattgtctcaagatgattactcgctagaatatatcaaagagttggttagacgtggtatatcagtgatagggcatataggattgactccacaaagagtccattcactaggcgggtacaaggcccagggtggtcaacagagcactgatgctgtggcgttgtacaacgttagtcaaactttgcaacagatcggatgtttcggtattgtattggaatgtattccgcataagatatcttctgtcatcacggacaaattacacattcccaccattggtatcggtgcaggcccagatactagtggccaggtgttggtgcaatctgacgttcttgggatgcttcccggacataaaccgaaatttgttaaaatgttcgcagattttaagaaggacgctgtttctgctttgtctcagtacgttcaagaagttcatgataaatctttcccacatataggccaccacactttcaaagtaaacgatgaagtgtaccaagattttatttctaagatagatactgagtga

SEQ ID NO: 100897 - protein, 318 aa, Kluyveromyces lactis NRRL Y-1140
MWSNGMIRCIGRRWYSLQNSSAVAATAKAVHQLTVKDIMAKYHRRNPISMVTAYDYITASWAQNANSDMILVGDSVAMCSLGYESTTQLSLDEFQYHVGAVCRAPGPAFVVVDMPFGSFERSISDGIGNAFQLLHLNPKVQAVKVECGLSQDDYSLEYIKELVRRGISVIGHIGLTPQRVHSLGGYKAQGGQQSTDAVALYNVSQTLQQIGCFGIVLECIPHKISSVITDKLHIPTIGIGAGPDTSGQVLVQSDVLGMLPGHKPKFVKMFADFKKDAVSALSQYVQEVHDKSFPHIGHHTFKVNDEVYQDFISKIDTE

SEQ ID NO: 100898 - DNA, 963 bp, Debaryomyces hansenii CBS767
  CDS (1)..(963)
atggttctatttagaagtcaaataaggagtatccctcgtttaagatacttcagtaccaagtctataatcaggtcatcgtatcagactgatgttaaacggaagacattactagatatacaacgactctacgagaccaagactcctatatcagtggtgactgcgtacgatttcataacaggtaagtatgcagaaagtgctgatgtagatatcaatttagttggagattcattagctatggttgcgttaggttatgaagatactacagaaatttcattcgacgagttcttataccatacaaaagctgttctcagaggtaataagctgtccttcatggtggcagatataccatttggatctactgaaatatcagttgaacaggcagtttcttcggctataaaattagtgaagtatggaaaagttcaaggtgtaaagattgaaggtggaagtgatatagtgcctactgtcaagaaattgtcctcgataggtattcccgtaatggcccatgttggtttgacaccacaacgccataatgcattgggtggtttcaaagttcaaggaaataatacggagagagctctcgagatctatagagactgtttggacttacaagaagctggggccttttcacttcttctagaatgtatacctaacaaattatctgagtatattactaagaatatatcaataccaacgattggaattggtgccggtccgggttgttcgggccaagttttagttatgtccgatttgcttggaatgggagatccaaaagactcaatgaaacctaaattcgtcaagcaatacaatgacttcttctctagtgctatacattcgctacatgcttacaagagggatttacagcatggaaagtttcctcttgcagacgaccacggctttaaaataaagaaagaggtattccacgatttcaagatgcaggccgaagcaatgaaaaaggctaactaa

SEQ ID NO: 100899 - protein, 320 aa, Debaryomyces hansenii CBS767
MVLFRSQIRSIPRLRYFSTKSIIRSSYQTDVKRKTLLDIQRLYETKTPISVVTAYDFITGKYAESADVDINLVGDSLAMVALGYEDTTEISFDEFLYHTKAVLRGNKLSFMVADIPFGSTEISVEQAVSSAIKLVKYGKVQGVKIEGGSDIVPTVKKLSSIGIPVMAHVGLTPQRHNALGGFKVQGNNTERALEIYRDCLDLQEAGAFSLLLECIPNKLSEYITKNISIPTIGIGAGPGCSGQVLVMSDLLGMGDPKDSMKPKFVKQYNDFFSSAIHSLHAYKRDLQHGKFPLADDHGFKIKKEVFHDFKMQAEAMKKAN

SEQ ID NO: 100900 - DNA, 942 bp, Yarrowia lipolytica CLIB99
  CDS (1)..(942)
atgtctcttttgcgcactctgaggcccgttctgggctcggcccggcctgtcacaccagttttggcccggtcctactcggcccatcactctcctcagacatcagatcaaactcgaaaaaaggtcactattcccgagttggccaagatgcgacgaaacaaggagaagatcagcatggtaacggcccatgattacgtgaccggtctgatcgctgacaaagccggtgttgatatgattctggtcggagactccttggccatggtggctctggggtaccccaacaccaaccaaatcgagctcgaggaaatggtgtatcatgctaaggctgtttctcgaggtgttaagagcgcgtttatggttgcagacctgccttttggttcgtatgaagagtccccagagaaagctatccgatctgctattcagatgatccaaaagggaggaatggaggctgtcaagatggaaggaggcaaggaactggcgcccactatcaagcgactgaccgaggtgggaatccctgttctgggacatatcggactcaccccccagcgtcagtcgtcgttgggaggattcagagtgcagggtaagactgcctctggagcagagagtattctggaagacgcgtatgaactgcagaaggctggatgttttgctattgtgcttgaagcagttcccgacaaggttggagaatggctcagttcgaagctagaggtccctaccatcggtattggtgctggacccggaacctccgggcaggtgctggtcatgctcgatatgctgggaggatttggaagcttcacgcccaagtttctcaaaaagtactcgcagtttcttgatattaatgttggagctgtcaagcagtaccatgaggaggtcaagggtggagtgttccctgcccaggagcattgttataagatgggtgatgaggaagcggctaaactgaaataa

SEQ ID NO: 100901 - protein, 313 aa, Yarrowia lipolytica CLIB99
MSLLRTLRPVLGSARPVTPVLARSYSAHHSPQTSDQTRKKVTIPELAKMRRNKEKISMVTAHDYVTGLIADKAGVDMILVGDSLAMVALGYPNTNQIELEEMVYHAKAVSRGVKSAFMVADLPFGSYEESPEKAIRSAIQMIQKGGMEAVKMEGGKELAPTIKRLTEVGIPVLGHIGLTPQRQSSLGGFRVQGKTASGAESILEDAYELQKAGCFAIVLEAVPDKVGEWLSSKLEVPTIGIGAGPGTSGQVLVMLDMLGGFGSFTPKFLKKYSQFLDINVGAVKQYHEEVKGGVFPAQEHCYKMGDEEAAKLK

SEQ ID NO: 100902 - DNA, 2502 bp, Dictyostelium discoideum
  CDS (1)..(2502)
atgattaaaatcaataaacaatttaaaataataaataaatttaaaaataaattatcaatatatagtaacttaaataataataataataaattatttttacctaccaacaatggtttaaatattattaataataataataataataataataataatattaattataataataaaaaaaatgaattatttggaaaatatcaacaacaacaacaacaacaacaaagattaaattattcaacacatgttaaagaggaaatgggagaaaataaaaaaaagacagttttagatattttaaagaaatataaagatggtataccaatttcaatggttacagcatatgattttacaagttcaaagatagttgataaatcaggaatggatatgatactggtgggagattcattaggtatggttatgaatggtgagagtggtacaacatcagtgacaatggaacaaatgatttatcattgtaaatcagtgatgaaaggtagtaaaaggtcatttgtagttggtgatatgccattcggtagttatgaaacatcaacaaaagatgcggtttcaaatgcaattcgtttaataaaggaaggtggtgttgatgctattaaattggaaggtggtaaaaaacaatttgaaaagattaaagcaatttgtgatactggtatattggttgtcggccatattggtctaacaccacaaacttcaacttcactaggtggatttaaattacagggtaaaaccgaacaagaagcattatcattattagaggacgcaaaatcattacaagaagcaggttgttttgctattgttttagaaatggtacctcatgcaaccgctatggccataactaataccctatcgattccaaccattggtattggtgctggtaatggtacaagtggtcaagttttagtttatcatgatctattgggactatattcagatttcgtccctaaattttgtaaacaatatgcaacactatcagaaaatattgatcaatctttgaaaaactataaaaatgaagttgaatcaagagaatttccatcacctactcattctttctcaatgaaagaatctgaattatcaccatttttagataaaattataaatagtaatacaacatcaacttcattatttgataaatcatcaattttatcatcaaataaaaatattttaaatcaaaataaagcattaaaacaacaacaacagcagcaacaacaacaacaagtaatagtacctaatactactactactaccacaatggcacaagtatcaccacaaattaaagaaaatgaaaatgaaaaagataaaatcaaattaacaccaacaccaccaataacagaagagatttcaacaaaattaattaataatgaaattaaaaataatattttaccaaataaaatgacattgaatggttcaaggaaaccaaagatcgttgtgattggagcaggtgcaatgggaagtctttttagtgcaaaattggcttcaaaaggtattgctgatgtttggatggtttcagcttggaaagaacatgtcgaaagtatcaataagaatggaatgaaattttttaatcctcaaggtaaagaagagaatattaaaggtattaaagcaaccttggatggaatgcaagtattaaaagatggtatttcaccagatttagcattggttttggtaaagagtaactcaactaaacaagctgcattaactgccgctacattggttggtggaaatcctaaagctgctgtattaactttacaaaatggtattggaaatcgtgaagaactcgaaagtataattaatattgataaaggtttgaaaaaccatgtttggcaaggtgtaactagtaatggtgcaattgtagtatctcctggctcagttaaacaaactggtattggttcaacatttttatcatcaccttatttaaataataataataataataataataataaaaaacaacaacaactacaacaacagcaattgttatcacaatttccaccaccttccactcgtgaagagattttagcattgaaagcattttgtgatattttaaatgaatctggaatttcaagtgatatctctgatgatttagagggtttggtttggaataaagtggtggctaatgctgccattaatcctttatcagcagttttaggtgtatcaaatggtcaattattagagaatgaatactccaagaatttaatgaaaaaaattatcattgaagcattaagtgtttgtaaagcaaaaaatatatcattaccatatggagaggattcagatgaagcatttaaatatgttgctgatattgtcttgaaaacttctgctaactattcaagtatgttacaagatatactcagaggtcaacctaccgaagtaaattcaattaatggcgtaatagttaaagagggtgaaaagttcgatttaaacgtctctcacaataaaatgattatggaaatggttttatctcgtacaaaaacaaatccaccattaagattatttaattaa

SEQ ID NO: 100903 - protein, 833 aa, Dictyostelium discoideum
MIKINKQFKIINKFKNKLSIYSNLNNNNNKLFLPTNNGLNIINNNNNNNNNNINYNNKKNELFGKYQQQQQQQQRLNYSTHVKEEMGENKKKTVLDILKKYKDGIPISMVTAYDFTSSKIVDKSGMDMILVGDSLGMVMNGESGTTSVTMEQMIYHCKSVMKGSKRSFVVGDMPFGSYETSTKDAVSNAIRLIKEGGVDAIKLEGGKKQFEKIKAICDTGILVVGHIGLTPQTSTSLGGFKLQGKTEQEALSLLEDAKSLQEAGCFAIVLEMVPHATAMAITNTLSIPTIGIGAGNGTSGQVLVYHDLLGLYSDFVPKFCKQYATLSENIDQSLKNYKNEVESREFPSPTHSFSMKESELSPFLDKIINSNTTSTSLFDKSSILSSNKNILNQNKALKQQQQQQQQQQVIVPNTTTTTTMAQVSPQIKENENEKDKIKLTPTPPITEEISTKLINNEIKNNILPNKMTLNGSRKPKIVVIGAGAMGSLFSAKLASKGIADVWMVSAWKEHVESINKNGMKFFNPQGKEENIKGIKATLDGMQVLKDGISPDLALVLVKSNSTKQAALTAATLVGGNPKAAVLTLQNGIGNREELESIINIDKGLKNHVWQGVTSNGAIVVSPGSVKQTGIGSTFLSSPYLNNNNNNNNNKKQQQLQQQQLLSQFPPPSTREEILALKAFCDILNESGISSDISDDLEGLVWNKVVANAAINPLSAVLGVSNGQLLENEYSKNLMKKIIIEALSVCKAKNISLPYGEDSDEAFKYVADIVLKTSANYSSMLQDILRGQPTEVNSINGVIVKEGEKFDLNVSHNKMIMEMVLSRTKTNPPLRLFN

SEQ ID NO: 100904 - DNA, 930 bp, Candida albicans SC5314
  CDS (1)..(930): transl_table=12
atgtatagacgagcttttgttgggctgtcacgtctcttttcaacttcttcctatttcagatcttcatacaccagtgcagctagaaagaccattgcggatatacatgagttatacaaaacgggagagtctatctcgatggtcacatcccatgactttattacatcacagatattagaacaagcaaaagttgacataaatcttataggtgactctttggccaacacaactttaggatacgacgacaccaatgagttaacacttgacgaatttttatatcatgtcaaatcagttcagagaggtaactcccattccttgttggttgcagatatgccttttggaagttttgaaagttcgattgaacaggctactacgacagcagtaaaactaatacagaaaggtaaaattcaagctgtgaagatcgaaggaggcaacgaagagattatccctaccatcaagaaaatagtttcagttggtataccagtcatgggtcacgttggattgactccccaaaaacataattcgttaggagggtataaacttcaaggaagaagtgttgatgattccgtcaggatttttcaagaatgccttaatttacaaaatgctggggtgtttgcaattgtgttagagtgtattcctaataaattgtctcagtacataacagataagctttcaattcccacaattggaataggtgctggaccttatacttcgggccaggttttggttatatctgacttgttgggaatgaaagatgggcacgtggctaagtttgttcagcagtataacaatttcttccaacagggtgttgaaggtgtaaaacagtataccaaagatgtcaaatcaaagaagtttccaaatccggatacacatggttataaaatgaagaaagatgtacttgatgagttcaaagaaattgccaaagatttgtag

SEQ ID NO: 100905 - protein, 309 aa, Candida albicans SC5314
MYRRAFVGSSRLFSTSSYFRSSYTSAARKTIADIHELYKTGESISMVTSHDFITSQILEQAKVDINLIGDSLANTTLGYDDTNELTLDEFLYHVKSVQRGNSHSLLVADMPFGSFESSIEQATTTAVKLIQKGKIQAVKIEGGNEEIIPTIKKIVSVGIPVMGHVGLTPQKHNSLGGYKLQGRSVDDSVRIFQECLNLQNAGVFAIVLECIPNKLSQYITDKLSIPTIGIGAGPYTSGQVLVISDLLGMKDGHVAKFVQQYNNFFQQGVEGVKQYTKDVKSKKFPNPDTHGYKMKKDVLDEFKEIAKDL

SEQ ID NO: 100906 - DNA, 1068 bp, Aspergillus fumigatus Af293
  CDS (1)..(1068)
atgatttcgtcccgaacagccatacagctggcgctacccttacggtcgcttgccagggcggctggggtgcggcctggtctatctcctatcgtccgttttgcccttcgtggtagctacctcccagcccgtcatgttcccccgccatgcacgcctcaggttcgacatagttctcactcgccgctgggggcggcgccggtgaaccctcggaaaaaggtgacgatgcagaccttacggagtctctacaagaagggagaacccatcacaatgctcaccgcgcatgactttcccagcggccatgttgccgacgcagctgggatggagatgatcttggtcggcgacagcctggccatggtcgcccttgggatggaggatacaagcgaggtgttaatggaagagatgttgctgcattgtcggagtgtagcgcgcgcagctaaaagcgctttcacggtcgcagacctccccatgggctcgtatgaagtgtcgccggaacaggctgtgcaatcggctattcgcatggtgaaggaaggtcgcgtacaggccgtgaaactggagggaggcgaggagatggcgccgacgattaagcggattgttgaggctggaattcctgtcgtcggacacatcggactcactcctcaacgccagaatgctttgggaggcttcagagtgcagggaaagtcgacagccggtgcgttacggttgctcaaagacgctttggccgtgcaagaggctggcgcattcatgatggtggtcgaagcagtaccggctgagattgctgcgatcattactaagaagctctctgtgcccactattggtatcggcgcaggcaacggctgttccggacaggtcctggtgcaaattgatatgactggcaactatcctcccggtcgtttcctcccaaaatttgtcaagaggtacgccgatgtttggggcgagagcatcaaaggaatcgaacagtacagagaagaagtcaagagtcgcgcgtacccttcacaagaatacacttatccgatagccgaagaggaactcgcggaatttaaaaaggctgctgacgtgattaagcgctcctga

SEQ ID NO: 100907 - protein, 355 aa, Aspergillus fumigatus Af293
MISSRTAIQLALPLRSLARAAGVRPGLSPIVRFALRGSYLPARHVPPPCTPQVRHSSHSPLGAAPVNPRKKVTMQTLRSLYKKGEPITMLTAHDFPSGHVADAAGMEMILVGDSLAMVALGMEDTSEVLMEEMLLHCRSVARAAKSAFTVADLPMGSYEVSPEQAVQSAIRMVKEGRVQAVKLEGGEEMAPTIKRIVEAGIPVVGHIGLTPQRQNALGGFRVQGKSTAGALRLLKDALAVQEAGAFMMVVEAVPAEIAAIITKKLSVPTIGIGAGNGCSGQVLVQIDMTGNYPPGRFLPKFVKRYADVWGESIKGIEQYREEVKSRAYPSQEYTYPIAEEELAEFKKAADVIKRS

SEQ ID NO: 100908 - DNA, 855 bp, Thermus thermophilus HB27
  CDS (1)..(855): transl_table=11
atgtactcgtccagggtcttgggcctaagggcgaggtcgtccacgctcctccatgatagccttattcccgtgcggcgcacggtgaaggacttccgcaacgccaagggccagcggctcgtctacctcaccgcctacgactaccccacggcccgcctggccgaggcggccggggtggacgccattttggtgggggactccttggggatggtggtcctgggctacccctccacggtgcccgtgaccttggaggagatgctccaccacaccaaggccgcccgcaggggggccccggagacctttctcgtggccgacctcccctacctcgcctacgccaccctggaccgggccctcctcgccgcggagcgcctcctcaaggaggggggggcggacgcggtgaagctggaggggggcgaggaggtggcggagatcgtccggggcctggtgcgggcgggggttccggtcctgggccacgtgggcctcaccccccagacggcgagccagcttggcggctacaagctccaaggccggcgcccggaggaggcggagcgcatcctcaagggggccttggccttggaggaggccggggcctacggcgtggtcttggagatggtgcccgcccgcctggccaaggaggtcaccgagaggctttccgtccacaccgtggggatcggggccgggccccacacggacgcccaggtcctcgtcttccacgacgtggtggggctctacggcgacttcaagccccgcttcgtgaagcgctacctggaggcgggcaggctcatccaggaggccttgagccggtacgcgcaggaggtccgggaaggggtcttccccggggaggagcatagtttctga

SEQ ID NO: 100909 - protein, 284 aa, Thermus thermophilus HB27
MYSSRVLGLRARSSTLLHDSLIPVRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVRGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 100910 - DNA, 924 bp, Desulfovibrio vulgaris subsp. vulgaris str. Hildenborough
  CDS (1)..(924): transl_table=11
atgagcacacatacgcccccctcttcagccacgccgacatccgggcaaggcgtacggccactcaccaccgccgacatccgcaaggccaagggacggcagcgtctggccatgctcacagcctacgactacacttcagcccgtatcgtggatggtgccggggccgacctcattctcgtgggcgactcgctgggcatggtcatgcttgggcgtgaagacaccctctcggtcaccctcgacgagatgctgcaccactgccgcgcggtggtacgtggtacgcggcacgcgatggtcgtggcggacatgcccttcatgacctacgagaccggcgtgcgtgacgcactcctcaacggtgcgcgtctcttccgggagagtggcgtgcgtgcggtgaaactcgaaggtgccggcccggtgctaccgcaggtacgggcactggtcgacgcgggcatcccggtcatgggacatctgggcctcaccccgcaacgggtggcggagatgggaggcttcaaggttcagggaagacaggcggaagcggccctgcgcctcttcgacgacgcgcttgccttgcaggaagcgggctgtttcagccttgtgctcgaatgtgttccggcaccggtcgccgaacaggtcacggcccggctgcacatccccaccatcggcataggcgcgggcgcgggttgcgacgggcaagtgctcgttctacacgacatgctggggctgtacggcgagctttcaccgcgattcgtcaaacgctacgccgacctcgccggcatggcgggtgaagctgtggcccgctatgcgcatgaagtacgcgaggggtcattccctgctgcggaacacaccttcggtatcgacgacgggcagtttgaggccttcatggctgcactggacaaacgcggatgccgccagacaccgacaggagaatga

SEQ ID NO: 100911 - protein, 307 aa, Desulfovibrio vulgaris subsp. vulgaris str. Hildenborough
MSTHTPPSSATPTSGQGVRPLTTADIRKAKGRQRLAMLTAYDYTSARIVDGAGADLILVGDSLGMVMLGREDTLSVTLDEMLHHCRAVVRGTRHAMVVADMPFMTYETGVRDALLNGARLFRESGVRAVKLEGAGPVLPQVRALVDAGIPVMGHLGLTPQRVAEMGGFKVQGRQAEAALRLFDDALALQEAGCFSLVLECVPAPVAEQVTARLHIPTIGIGAGAGCDGQVLVLHDMLGLYGELSPRFVKRYADLAGMAGEAVARYAHEVREGSFPAAEHTFGIDDGQFEAFMAALDKRGCRQTPTGE

SEQ ID NO: 100912 - DNA, 753 bp, Acinetobacter sp. ADP1
  CDS (1)..(753): transl_table=11
ttgacttgttatgatgcaagtatggctaaagcgatggagtttgccgaaattgactcgattcttattggggattctttagggatggtcattcagggtcacgattcgactttacctgttacggtggatgatatggcttaccatactgcggctgtacgtcgtggtaatcagcattcgtttattatgactgacttaccctttatgagttatgccaccttgcctgatgccctgaataacgccaaaaaagtcatgcaggcaggggcacagatgatcaagattgaaggtggtgcctggttaagcgaatccattcgtgttttgacacaaaatggtattcctgtatgtgtacacttgggtttaacacctcagtctgtacatgtttttggtggatataaattacaagccaaaactcgagaagctgcggatcaactgattgcagattgtcaggcggtggttgatgcgggagccgcaattttgttactcgaatgtgtgccagcgcagttagggcaggaaattgcagaattatttccacaaacgcctgtcattggtattggtgcgggtaaagaaactgatggacaggtattggttgctcaagacatgctgggactcagctttggcaaagtagcacgttttgtccgtaactttatgaaagaacaagctggagagactgcaattgtagatgcatttaaggcatatcatgctgctgtacaagaccagtcatttcctgcacgagaacatacatttcaggtagagctgtaa

SEQ ID NO: 100913 - protein, 250 aa, Acinetobacter sp. ADP1
MTCYDASMAKAMEFAEIDSILIGDSLGMVIQGHDSTLPVTVDDMAYHTAAVRRGNQHSFIMTDLPFMSYATLPDALNNAKKVMQAGAQMIKIEGGAWLSESIRVLTQNGIPVCVHLGLTPQSVHVFGGYKLQAKTREAADQLIADCQAVVDAGAAILLLECVPAQLGQEIAELFPQTPVIGIGAGKETDGQVLVAQDMLGLSFGKVARFVRNFMKEQAGETAIVDAFKAYHAAVQDQSFPAREHTFQVEL

SEQ ID NO: 100914 - DNA, 855 bp, Desulfotalea psychrophila LSv54
  CDS (1)..(855): transl_table=11
ttgaggattcctgttatgcgtaagaccgttgtggatattattgcaatgaaggccgccgggcagaagataagcatgcttaccgcctatgatgcctccatgtctgccctgcttgatcaggctggaatcgacatcctcttggttggtgattctcttggaatgaccgtgctcggctatgattcgacggttcctgtcaccatggctgatatggttcatcatatggcagcggtgcgtcgcggggccccagatgcctttgtggtgggcgatatgccctttggctcctatcaaacaggggcgcgtgatgctgtccttaatgccatgcgtttgctgaaagagggtggttgtgatgtggtaaagcttgaaggtggtgaggtcgtctgtcctgtggttaaggccattgttgatgcggggattcctgttatgggccatttagggcttactcctcagactgcggcagtgctcggtggttacaaggtgcagggtcgtgatatggaggctgccagaaaactctttgccgatgccaaaagattggaagaggccggggtctgtgggctggttctggagtgcattcctgcaggtcttgccgaagttgttacagcatccatagcggtgcccaccgtaggcattggggcgggcaagggctgtgatggccaggttctggttattaacgatatgctgggactctttgaaaaatttactcccaagtttgtcaaacattatgcccagctagctcctctggtccggcagggagtagaaaactatatcggcgaggttcgtgccggtgcctttccggaggcagagcatacctttaccagttcctgtgattataaggttctcctctccggagatgatcagtaa

SEQ ID NO: 100915 - protein, 284 aa, Desulfotalea psychrophila LSv54
MRIPVMRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 100916 - DNA, 834 bp, Bacillus licheniformis ATCC 14580
  CDS (1)..(834): transl_table=11
atgaagacaaaaactgactttctaaaaatgaaacaagagggagagccgatcgtcatgctgactgcctacgattatccggcggcaaagcttgccgaacaggccggcgtcgatatgatccttgtcggcgattcactcggcatggttgtactcggccttgactcgaccgtatctgttacggttgctgatatgatccaccatacaaaagctgtcaaacgcggggcaaaagatacgtttgttgtgacggatatgccttttatgtcatatcactgctctttggaaagcgctctgaaaaatgccgcggcgatcgttcaagaaagcggggcagatgctttgaagcttgaaggcggcgacggtgtgtttgagacgatcacggctttaacacgcggcggaatacctgttgtcagccatttaggcttgactcctcaatccgtcggtgttttgggaggctataaagttcaagggaaagatgaagaaagcgccggcaagctgattgaagacagcaggcgctgtgaagaagcaggcgcgatggcgctcgttctggaatgcgtcccggcagcgctcgctgaacggatttcaaaggagctcacaattcctgtcatcggcattggagcaggtgctggcacggacggacaggttctcgtttaccacgatgttgtcggacacggagtaagccggacgcctaaatttgtcaagcagtatgcacaaatcgaccagccgcttgaacaagcgcttcggggatatgttgaggatgtcagaagccgcgtgtttcctgaagatgctcattcgttccgtatagatcagcaagttcttgaaggattatacggagggaaatag

SEQ ID NO: 100917 - protein, 277 aa, Bacillus licheniformis ATCC 14580
MKTKTDFLKMKQEGEPIVMLTAYDYPAAKLAEQAGVDMILVGDSLGMVVLGLDSTVSVTVADMIHHTKAVKRGAKDTFVVTDMPFMSYHCSLESALKNAAAIVQESGADALKLEGGDGVFETITALTRGGIPVVSHLGLTPQSVGVLGGYKVQGKDEESAGKLIEDSRRCEEAGAMALVLECVPAALAERISKELTIPVIGIGAGAGTDGQVLVYHDVVGHGVSRTPKFVKQYAQIDQPLEQALRGYVEDVRSRVFPEDAHSFRIDQQVLEGLYGGK

SEQ ID NO: 100918 - DNA, 867 bp, Legionella pneumophila subsp. pneumophila str. Philadelphia 1
  CDS (1)..(867): transl_table=11
ttgatccatgagacaggtacctgtattaccatcattcttatctattccaggcgcattctcctattcagggagaacggcatgaaaatccatgattttaaaataaaaaagcaggaacaaaagaaaatttccatgttgacctgttacgattacccttcagcatgcatagtagcagaatcaaatatcgattgtgttctcgtgggtgattccgtagctatggcagtgcacggccaccctacaaccattatggccactatcgaaatgatggaattacatacccaggcagtagctcgtggtttaggcaaacagtttttgattactgacttaccttttctcggacataaatcatctcaaggtcatacagtagaaaacgtaaaaaggctgttacaggctggagcccaagcagttaaaatcgagggcgctgataaagacacctgccaaacgatttcccatttagttaatgccggcatccctgttatgggtcatatcggcttaactccccaatccattcatcaattaggcggttataaagtccagggaaaaaacagcgaacaggcagaaactctattacaacaggcagccaccctggaacaagccggctgctttgcggtagttattgaatgtgttccgcaggagctggcaaaaacgattaccgattcgttagttattcctactataggaattggcgcaggcccaggaactgatgggcaagtccttgtctggcacgatatgctaggtttacagacttcatttaatcctaaatttgtaaaaaaatattttagagccaaagaccattttattgaagccttaaacagctatgtccagcaagtacaacaaatgcatttcccagctaatgaacattctttctag

SEQ ID NO: 100919 - protein, 288 aa, Legionella pneumophila subsp. pneumophila str. Philadelphia 1
MIHETGTCITIILIYSRRILLFRENGMKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 100920 - DNA, 789 bp, Legionella pneumophila str. Paris
  CDS (1)..(789): transl_table=11
atgaaaatccatgattttaaaatgaaaaagcaggaacaaaagaaaatttccatgttgacctgttacgattacccttcagcatgcatagtagcagaatcaaatatcgattgtgttctcgtgggtgattccgtagctatggcagtgcacggccaccctacaaccattatggccactatcgaaatgatggaattacatacccaggcagtagctcgtggtttaggcaaacagtttttgattactgacttaccttttctcggacataaatcatctcaaggtcatacagtagaaaacgtaaaaaggctgttacaagctggagcccaagcagttaaaatcgagggcgctgataaagacacctgccaaacgatttcccatttagttaatgccggcatccctgttatgggtcatatcggcttaactccccaatccattcatcaattaggcggttataaagtccagggaaaaaacagcgaacaggcagaaactctattacaacaggcagccaccctggaacaagccggctgctttgcggtagtcattgaatgtgttccgcaggacctggcaaaaacgattaccgattcgttggttattcctactataggaattggcgcaggcccaggaactgatgggcaagtccttgtctggcacgacatgctgggtttacagacttcatttaatcctaaattcgtaaaaaaatattttagagccaaagaccattttattgaagccttaaacagctatgtccagcaagtacaacaaatgcatttcccagctaatgaacattctttctag

SEQ ID NO: 100921 - protein, 262 aa, Legionella pneumophila str. Paris
MKIHDFKMKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQDLAKTITDSLVIPTIGIGAGPGTDGQVLVWHDMLGLQTSFNPKFVKKYFRAKDHFIEALNSYVQQVQQMHFPANEHSF

SEQ ID NO: 100922 - DNA, 789 bp, Legionella pneumophila str. Lens
  CDS (1)..(789): transl_table=11
atgaaaatccatgattttaaaataaaaaagcaggaacaaaagaaaatttccatgttgacctgttacgattacccttcagcatgcatagtagcagaatcaaatatcgattgtgttctcgtgggtgattctgtagccatggcagtacacggctaccctacaaccattatggccactatcgaaatgatggaattacatacccaggcagtagctcgtggtttaggcaagcagtttttgattactgacttaccttttctcggacataaatcatctcaaggtcatacagtagaaaacgtaaaaaggctgttacaggctggagcccaagcagttaaaatcgagggcgctgataaagacacctgccaaacgatttcccatttagttaatgccggcatccctgttatgggtcatatcggcttaactccccaatccattcatcaattaggcggttataaaatccagggaaaaaacagcgaacaggcagaaactctattacaacaggcaaccaccctggaacaagccggctgctttgcggtagtcattgaatgtgttccgcaggacctggcaaaaacgattaccgattcgttggttattcctactataggaattggcgctggcccaggaactgatgggcaagtccttgtctggcacgatatgctaggtttacagacttcatttaatcctaaatttgtaaaaaaatattttagagccaaagaccattttattgaagccttaaacagctatgtccagcaagtacaacaaatgcatttcccagctaatgaacattctttctag

SEQ ID NO: 100923 - protein, 262 aa, Legionella pneumophila str. Lens
MKIHDFKIKKQEQKKISMLTCYDYPSACIVAESNIDCVLVGDSVAMAVHGYPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKIQGKNSEQAETLLQQATTLEQAGCFAVVIECVPQDLAKTITDSLVIPTIGIGAGPGTDGQVLVWHDMLGLQTSFNPKFVKKYFRAKDHFIEALNSYVQQVQQMHFPANEHSF

SEQ ID NO: 100924 - DNA, 783 bp, Haloarcula marismortui ATCC 43049
  CDS (1)..(783): transl_table=11
atggctggtgaggagccgatcacgatgctgacagcgtacgacgccgttaccgcgagcatcgttgacgacaccggcgtggacgtcattcttgtcggcgacagcatggggaacgccgtgctcggccacgacgacacgctcccggtcacgctcgatgagatggcctcccgggtcggcgcggtcgcacgcggcgcggacgacgcgctggtcgtcgccgatatgccgtttctctccttcggcgcgcacgaaagcgagagcatccagaactgtgggcgaatgctgaaagaagagggcgcaaacgcgatcaagctcgaatctggaccacatacagtcgaactgaccgagcggctgaccgagctcggaatcccaacaatggcccacctcgggctcacgccacagagcgtgaaccagaccggctacacgagacaggcgacgggccgtgaggaggccgaggaaatcctcgacctcgcgcgagagcacgaggccgccggcgcgttcgcgctggtgctcgaacacatcccggccaacctcgcggccaaggtcaccgaggccgttgatatcccaacaatcggtattggggccggcggtgactgcgacggtcaggtgctcgttttcaccgacgtggtcggcctctcggagtccagcccgccgttcgccgagcagttcggcgacgttcgcggtgaggtggccgacgctgtcgacgagtacatcgacgccgttgagtccggcgagttcccgcgcgagtcacacagccacaccgaagacgaactcgacgacctgtactga

SEQ ID NO: 100925 - protein, 260 aa, Haloarcula marismortui ATCC 43049
MAGEEPITMLTAYDAVTASIVDDTGVDVILVGDSMGNAVLGHDDTLPVTLDEMASRVGAVARGADDALVVADMPFLSFGAHESESIQNCGRMLKEEGANAIKLESGPHTVELTERLTELGIPTMAHLGLTPQSVNQTGYTRQATGREEAEEILDLAREHEAAGAFALVLEHIPANLAAKVTEAVDIPTIGIGAGGDCDGQVLVFTDVVGLSESSPPFAEQFGDVRGEVADAVDEYIDAVESGEFPRESHSHTEDELDDLY

SEQ ID NO: 100926 - DNA, 786 bp, Thermus thermophilus HB8
  CDS (1)..(786): transl_table=11
gtgcggcgcacggtgaaggacttccgcaacgccaagggccagcggctcgtctacctcaccgcctacgactaccccacggcccgcctggccgaggcggccggggtggacgccattttggtgggggactccttggggatggtggtcctgggctacccctccacggtgcccgtgaccttggaggagatgctccaccacaccaaggccgcccgcaggggggccccggagacctttctcgtggccgacctcccctacctcgcctacgccaccctggaccgggccctcctcgccgcggagcgcctcctcaaggaggggggggcggacgcggtgaagctggaggggggcgaggaggtggcggagatcgtccagggcctggtgcgggcgggggtcccggtcctgggccacgtgggcctcaccccccagacggcgagccagcttggcggctacaagctccaaggccggcgcccggaggaggcggagcgcattctcaagggggccttggccttggaggaggccggggcctacggcgtggtcttggagatggtgcccgcccgcctggccaaggaggtcaccgagaggctttccgtccacaccgtggggatcggggccgggccccacacggacgcccaggtcctcgtcttccacgacgtggtggggctctacggcgacttcaagcctcgcttcgtgaagcgctacctggaggcgggcaggctcatccaggaggccttgagccggtacgcgcaggaggtccgggaaggggtcttccccggggaggagcatagtttctga

SEQ ID NO: 100927 - protein, 261 aa, Thermus thermophilus HB8
MRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVQGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 100928 - DNA, 834 bp, Anaplasma marginale str. St. Maries
  CDS (1)..(834): transl_table=11
gtgcttttgaatatactagacatacaggcgaaaaaggggctggaaaaaatcgcctgcctgaccgcttatactttcccgatggcgcgtattttggatgagcactgcgatcttatcctcgtgggagattccgtcggacagaccgtgtatggcatggagtccacattgtctgtcacgctagatatgatgattgcgcacggcaaggcggttgtaaaggcgcgtagtaaggctttggttgtggtagacatgccatttgccagctattacaccccggagcttgcgtacaagaatgcatctcgtattttgagtgaaaccgggtgcgatgccgtgaagctagaaggcggggtatgtgttgcggaagagatcgcatttttggtagcacgcggaattccggttatgggtcacgtaggcctgatgccccaacatttcaatcagctgggtgggtacaagtgccaaggcaagactgacagctcacgtcagcacattaaggaagacgccaaagcggtgtgcgaagccggtgcgttttgcgttgtgctggagtgcataagcccgtccctggctgcagagctaactcaggagttgccggtacctaccattggcatcggggcttctaacgcatgtgacgggcagattttggttgttgatgatatgttaggccaatcatcacgctatccaaagttcgtaaaacggtttgctgacctcgagcacacgataaaagacgccgtggtcggctatgtgcgcgcagtgaagtgtagtgaatttcccggggatgaacattgctacagcgacgggccgcacttacgtgtgtttcgtgcacaccctcatcacgcccaatga

SEQ ID NO: 100929 - protein, 277 aa, Anaplasma marginale str. St. Maries
MLLNILDIQAKKGLEKIACLTAYTFPMARILDEHCDLILVGDSVGQTVYGMESTLSVTLDMMIAHGKAVVKARSKALVVVDMPFASYYTPELAYKNASRILSETGCDAVKLEGGVCVAEEIAFLVARGIPVMGHVGLMPQHFNQLGGYKCQGKTDSSRQHIKEDAKAVCEAGAFCVVLECISPSLAAELTQELPVPTIGIGASNACDGQILVVDDMLGQSSRYPKFVKRFADLEHTIKDAVVGYVRAVKCSEFPGDEHCYSDGPHLRVFRAHPHHAQ

SEQ ID NO: 100930 - DNA, 816 bp, Azoarcus sp. EbN1
  CDS (1)..(816): transl_table=11
atgagctacctccaggacgacaaacccgtcaccctgttcgaaattggcaagatgcgcgccgaagggcgcaagatcagcatgctcacctgttatgacgcgagcttcgcgtcgctgctcgagcgcgcgggagtcgacatcctcctcgtcggtgattcgctcggcaacgtcgtgcagggacagaagtccacgctgcccgtgacgctggagcacatgatctaccataccgaatgtgtcgtgcgcggctccacccgcccgttcatcgtcaccgacatgccgttcggtgcgtatcacgagagcccgtcgcaggcgatgcacaacgcagccagcctgctcgccgccggcgcgcagatggtcaagctcgaaggcggcaccttcatggccgaaaccgtccgtttcctcgtcgaacgcggcatcccggtatgcgcccacatcgggctcacgccgcagtccgtgcaccagctgggaggttatcgcgtacagggccgcagcgaggccgcagcggcgcagctgaaaggcgatgcgctggcgctggaacaggccggcgccgcgctgatggtcatggaaatggtccccgccgcgctcgctcgggaagtcaccgcgagcctcgcctcgatggcgacgatcggcatcggcgcgggcccggactgtgacggccaggtgctcgtgctgcacgacatgattggcgtctatccgggcaagaaagcgcgcttcgtcaggaatttcatgaccgggaagactgacatcgacgaagctgtcgcgagctacgtccaggccgtccgggacggcagttttccggccgccgaacactgttattga

SEQ ID NO: 100931 - protein, 271 aa, Azoarcus sp. EbN1
MSYLQDDKPVTLFEIGKMRAEGRKISMLTCYDASFASLLERAGVDILLVGDSLGNVVQGQKSTLPVTLEHMIYHTECVVRGSTRPFIVTDMPFGAYHESPSQAMHNAASLLAAGAQMVKLEGGTFMAETVRFLVERGIPVCAHIGLTPQSVHQLGGYRVQGRSEAAAAQLKGDALALEQAGAALMVMEMVPAALAREVTASLASMATIGIGAGPDCDGQVLVLHDMIGVYPGKKARFVRNFMTGKTDIDEAVASYVQAVRDGSFPAAEHCY

SEQ ID NO: 100932 - DNA, 921 bp, Zymomonas mobilis subsp. mobilis ZM4
  CDS (1)..(921): transl_table=11
atgcacaacaacgtgaatcagcacggccggagcgccgaaccaggagtcgccagcgaagggatagcgccttacggcgacgctcatcgaggtatagccgcgaagcgcaagaagacgaccaccgcgcgcatttctcaaatgcgtgtggatggcgagaagatagcggtgctcaccgcctacgacgcgacctttgcggccgcagcggatgctgctggcgtcgattgcatcatggtcggtgattccctgggcatggtctgccaaggccgaaccaccaccgtcggcgtgtcactggaagacatgctttatcacacccgctgcgtatcacaaggcattgcgcgggccgatggcagcgcgctcatcatcgcggatcttcctttcggcagctaccagcagtccaacgagcaggccatcgcttcggccgtccaactcatgcaggccggtgcccacatggtcaagctcgaaggcggcgactggtggacggtggacattgtggagttcctggttcagcgcggcattccggtctgcgcacacctgaggctgacgccgcagacggtatcggcgctgggtggctatcgtgtccagggacgtagcgaagaagccgccgagaaactgcgtgtggatgccggtgcactcgataacgctggcgcatccatgatggtgctggagatgattcccaccgaattggcgaccagcattaccagcgaaatgaagtcctgcgcgacgatcggcattggcgctggcagcggcaccgctgggcaagttttggtcatgcacgacatgctgggtatcaaccttggtcgcatggctaagttcgtgcggaatttcatgcgtgatgcggaggatgtacctactgctttcgccgcttatgtagcagcagtcaaggacggttcgtttcctgacgacaagctgcatggatttctctga

SEQ ID NO: 100933 - protein, 306 aa, Zymomonas mobilis subsp. mobilis ZM4
MHNNVNQHGRSAEPGVASEGIAPYGDAHRGIAAKRKKTTTARISQMRVDGEKIAVLTAYDATFAAAADAAGVDCIMVGDSLGMVCQGRTTTVGVSLEDMLYHTRCVSQGIARADGSALIIADLPFGSYQQSNEQAIASAVQLMQAGAHMVKLEGGDWWTVDIVEFLVQRGIPVCAHLRLTPQTVSALGGYRVQGRSEEAAEKLRVDAGALDNAGASMMVLEMIPTELATSITSEMKSCATIGIGAGSGTAGQVLVMHDMLGINLGRMAKFVRNFMRDAEDVPTAFAAYVAAVKDGSFPDDKLHGFL

SEQ ID NO: 100934 - DNA, 822 bp, Zymomonas mobilis subsp. mobilis ZM4
  CDS (1)..(822): transl_table=11
atgtcagccatcccttcttctaataagcgccgaactattcccgagcttcgcgcgcgtaaaggcaagtcgccgatcgttgctttaacggcttacagtgctttaaccgcccgttttgttgatccttacgccgatttcattcttgtcggggacagtcttgccatggtcgaacatggtatggcgacgactattggtgcctcgcttgatatgatgattttacatggtcaaagcgtgatgcgcggttccgagaaggccgctgtcgtcatcgacatgccttttggttcttacgaagcgagtccacaggaagcctatcataatgctgtccgtattttgtccgaaacaggatgttcagccgtaaaacttgaaggcggctctcatctcgcgcctgttatcgccttcctcacagcacgaggggtgccggttatggggcatattgggttgacgcctcaatatgttcagactttgggcggtttcaaaatacaaggccatagctcggaacaacaagacaagattaaacaggatgctcttgattttgaggccgccggtgctttttccgtcgtgctagaaggggtgaccgaaccgcttgcccgtgaaattacggataatatcgcgataccaacgattggtatcggtgcctcttcttattgtgatggccaagttttggttttggaagatatgctgggcttcaatgacaaggtgccgcgtttcgtcaaaaaatttgctcatcttggggatgacatcaaaaaagcggtttcagactatgccactgcggtttcaaatcgtagttttccagcagaagacaacatctacaggccaaaatcttaa

SEQ ID NO: 100935 - protein, 273 aa, Zymomonas mobilis subsp. mobilis ZM4
MSAIPSSNKRRTIPELRARKGKSPIVALTAYSALTARFVDPYADFILVGDSLAMVEHGMATTIGASLDMMILHGQSVMRGSEKAAVVIDMPFGSYEASPQEAYHNAVRILSETGCSAVKLEGGSHLAPVIAFLTARGVPVMGHIGLTPQYVQTLGGFKIQGHSSEQQDKIKQDALDFEAAGAFSVVLEGVTEPLAREITDNIAIPTIGIGASSYCDGQVLVLEDMLGFNDKVPRFVKKFAHLGDDIKKAVSDYATAVSNRSFPAEDNIYRPKS

SEQ ID NO: 100936 - DNA, 840 bp, Silicibacter pomeroyi DSS-3
  CDS (1)..(840): transl_table=11
atgagtgcgactgcccgcaagactgcccccaatgcgcaggatatccgcgcgcgcaagggcggggtgccgctggtcagcctgaccgcctataccacgccgatggcgcggctgatggatgggcattgcgatttcgtgctggtgggcgacagcgtcggcatggtgctgcacgggctgaattccaccctgggtgtgacgatggagatgatgatcctgcacggtcaggcggtggcgcgcgggctggaccgcgcgatgctggtgatcgacatgccattcgccagctacgaggagggtccggcgcaggcgttccgcaatgccgcccggctgatggccgagaccggcgctggtgcggtcaagctggaaggcggggtcgagatggccgagaccatccgctttctggtcaagcgcggcattccggtgatggcccatatcgggctgacgccgcagtcgatcaacacgctgggcggatacaaggtgcagggccgcgacgatcaggcccaggcggtgctggccgatgcccgcgcggtggccgatgcgggcgctttttcggtcgtgctcgagaaggtgcctgcgacgctggccgaccggatcactgccgaggttgcgattccgaccattggcatcggggcctctgccgggtgcgacgggcagatcctggtggttgatgacatgctgggctttttcaccgcgttcaaaccgaaattcgtcaaacggtacgccgatctgggtccgctggccgaggcggcgattgccgaatacgccgccgaagtgcgcgcgcgcagctttccggcggcggaacatgtgtttggcgatcaggccccggccaaaggtgccaaggcatga

SEQ ID NO: 100937 - protein, 279 aa, Silicibacter pomeroyi DSS-3
MSATARKTAPNAQDIRARKGGVPLVSLTAYTTPMARLMDGHCDFVLVGDSVGMVLHGLNSTLGVTMEMMILHGQAVARGLDRAMLVIDMPFASYEEGPAQAFRNAARLMAETGAGAVKLEGGVEMAETIRFLVKRGIPVMAHIGLTPQSINTLGGYKVQGRDDQAQAVLADARAVADAGAFSVVLEKVPATLADRITAEVAIPTIGIGASAGCDGQILVVDDMLGFFTAFKPKFVKRYADLGPLAEAAIAEYAAEVRARSFPAAEHVFGDQAPAKGAKA

SEQ ID NO: 100938 - DNA, 708 bp, Dehalococcoides ethenogenes 195
  CDS (1)..(708): transl_table=11
atggtggtgcttgggtatgattccaccgtaagcgtgaccatggaagatatgctgcaccatctgaaagccgtagtcaggggcagccaaaaggccatggtcatagccgatatgccctttatgacctatcacctaagcccggaacaggcactcctgaacgcagggcgttttatgcaggaaggcggcgctcaggcagtcaaactggagggcggggtaaatgtggctgacaaggttaaacgtatagttgactgcggcattcccgttatggggcatatagggctgactccccagtctgttaaccagctaagcgggtttaaagtccaggggaaaactctgacagctgctttagccctgctagaagatgccagggctctggaaaaagccggggcgtttgctatagtgctggagactatgccggctgagctggcggccatgattaccgctgccgtttccatacctaccataggcataggggcaggtgaaaattgtgatggccaggtgcaggtggtatccgatatgctgggtatgtttactgattttgtacctaaacataccaaaaaatacgctgatttaaacggtattatctcaaaagctgtatccggatatgtaactgaggttgcaaaaggtgaatttcccactttgaaagaaagcttcacccttgataaaaaggtattggaggaactgaaaaagtgcgtatcatcagaacagtag

SEQ ID NO: 100939 - protein, 235 aa, Dehalococcoides ethenogenes 195
MVVLGYDSTVSVTMEDMLHHLKAVVRGSQKAMVIADMPFMTYHLSPEQALLNAGRFMQEGGAQAVKLEGGVNVADKVKRIVDCGIPVMGHIGLTPQSVNQLSGFKVQGKTLTAALALLEDARALEKAGAFAIVLETMPAELAAMITAAVSIPTIGIGAGENCDGQVQVVSDMLGMFTDFVPKHTKKYADLNGIISKAVSGYVTEVAKGEFPTLKESFTLDKKVLEELKKCVSSEQ

SEQ ID NO: 100940 - DNA, 816 bp, Xanthomonas oryzae pv. oryzae KACC10331
  CDS (1)..(816): transl_table=11
atgagcagccacgccgacagcaatccctggaccgtgcccgccttggcgcaggccaagcgcgcgggtcgaaaactggtcatgttgaccgcgtacgacgccagcttcgcgcgcaccttcgacgtcaatggcgtggacctgatcctggttggcgactcgctcggcatggtgatgcaggggcatgattccaccttggcggtgaccaccgccgacatggtctaccacaccgccgcggtggcccgcgcgctcgatcgcgcattgctggtggccgacctgtcgttccaggccgacgccacgcccgaacgtgcattggatgccgccacccaactgctgcaggccggtgcggagatggtcaagatcgagggcgccgggcataagctcgaggtcatccgttacctggtcgagcgcgagattccggtctgctcgcacctggggctgaccccgcaatcggtgctgcgcttcggcggctacaaggtgcagggccgcggcgaagccggcgagcagttgcgccgcgatgcgcaggcggtggtcgacgccggtgccagcctggtggtactggaatgcgtgccgacgccgatcgccacgcaaatcagcgcagaactcagcgtgcccaccatcggcatcggtgccggccccggttgcgacggccaggtgctggtgatgcacgacatgctgggcctggacagcggtcatcgtcggcccaagttcgtcaaggatttcctggccgaaggcggctcggtggctggtgcggtgcgtgcctacgcgcaggccgtgcgcgatggcagctttcccgatgcagagcacgcgtacgccgcatga

SEQ ID NO: 100941 - protein, 271 aa, Xanthomonas oryzae pv. oryzae KACC10331
MSSHADSNPWTVPALAQAKRAGRKLVMLTAYDASFARTFDVNGVDLILVGDSLGMVMQGHDSTLAVTTADMVYHTAAVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLVVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 100942 - DNA, 867 bp, Vibrio fischeri ES114
  CDS (1)..(867): transl_table=11
atgtccttttgccgatatatatacataaatggacatgttagcatcatttcttttatgacaaaaattgagttactaatgaaaaaaataaccatctcagatttaaacaactggaaagaagtaggtgaaaaatttgcatcaataaccgcttatgatgccagctttgctaaaatatttgaagagcaaagtatgcctgtcataattgtcggagattcacttggttctgtcatacaaggtaagccaacaactttagatgtaagtattgaagaattggtttatcacacaaaatgcgttagagcaggaagtccaaatgctttcattatttcagacctgcctttcatgagttatcacacccctgaagcagcatgtggttcagcagctaaattaatgaaagcaggtgcaaatatggtaaagattgaaggcggtagttggttaattaatacagttaagatgttaactgaacgcgcagtaccagtttgtgctcatttaggtttaatgccacaagccgtaaatatatatggtggatataaacttcaaggtaaaacagaagaacaagccacaaaaatgctagaaaatgcaaaagaacttcagcgtgcaggtgctcaagcactgatacttgaatgtatccctgcgaaattggcacgacaaatcacattagaattacacattccagtaataggaattggtgcaggtaatgataccgatggtcaagttttagttatgcatgatattttaggtatatctgctaattatattccaagattctctagaaatttcctcgctgaaaccgggtcgatcgaagccgctgtaaaaaaatatatagatgaagtcaaacaacaaaccttccctggtgaaaaacattgtttttaa

SEQ ID NO: 100943 - protein, 288 aa, Vibrio fischeri ES114
MSFCRYIYINGHVSIISFMTKIELLMKKITISDLNNWKEVGEKFASITAYDASFAKIFEEQSMPVIIVGDSLGSVIQGKPTTLDVSIEELVYHTKCVRAGSPNAFIISDLPFMSYHTPEAACGSAAKLMKAGANMVKIEGGSWLINTVKMLTERAVPVCAHLGLMPQAVNIYGGYKLQGKTEEQATKMLENAKELQRAGAQALILECIPAKLARQITLELHIPVIGIGAGNDTDGQVLVMHDILGISANYIPRFSRNFLAETGSIEAAVKKYIDEVKQQTFPGEKHCF

SEQ ID NO: 100944 - DNA, 792 bp, Neisseria gonorrhoeae FA 1090
  CDS (1)..(792): transl_table=11
atgattactgtgaacacactgcaaaaaatgaaggcggccggcgagaaaatcgttatgctgaccgcttacgaatccagttttgccgcgctgatggacgatgccggcgtggatgtgctgttggtcggggattctttgggaatggcggttcaggggcgacagtcgacgctgccggtcagcctgcgcgatatgtgctatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggtcaaactcgaaggcggcgtgtggatggcggaaacgactgaatttctgcaaatgcgcggaattccggtctgtgcccacatcggtctgaccccgcaatccgtgtttgccttcggcggatataaagttcaggggcgcggcggcaaggcgcaggcgttgcttaacgatgccaaggcgcatgatgaagccggagctgccgtcgtactgatggaatgcgtgccggcggaactggcaaaaaaggtaactgaaactgtttcctgtccgaccatcggcatcggggcgggcgcggattgcgacggtcaggttttggtgatgcacgatatgctcggtattttcccgggcaaaacggcgaaattcgtcaaaaactttatgcgcgggcaaagcagcatccaggctgcggttcgggcgtatgttgccgaagtcaaagccaaaaccttccctgctgcggaacatatttttgcagattga

SEQ ID NO: 100945 - protein, 263 aa, Neisseria gonorrhoeae FA 1090
MITVNTLQKMKAAGEKIVMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDEAGAAVVLMECVPAELAKKVTETVSCPTIGIGAGADCDGQVLVMHDMLGIFPGKTAKFVKNFMRGQSSIQAAVRAYVAEVKAKTFPAAEHIFAD

SEQ ID NO: 100946 - DNA, 792 bp, Salmonella enterica subsp. enterica serovar Choleraesuis str
  CDS (1)..(792): transl_table=11
atgaaacccaccactatttcactgctgcagaaatgcaagcaagagaaaaaacgcttcgcgacaattaccgcctacgactacagcttcgctaagttatttgccgacgaaggtatcaatgtgatgctggttggcgactcactgggcatgacgattcaggggcacgactccaccctgccggtcaccgtggaagatatcgcttaccacactcgtgccgtgcgacgtggcgcgcccaactgtctattgctctccgacctgccgtttatggcttacgccaccccggaacaggcatgtgaaaacgcggctatcgtgatgcgtgcgggggccaatatggtcaaaattgaaggcggcgcctggctggttgatacggtgaaaatgctcaccgaacgtgccgtgccggtttgtggtcatctggggttaacgccccagtcggtgaatatcttcggcggctataaaattcagggccgtggagatgcaggacaagtgctgctggatgacgcgctggctttagaagccgctggcgctcaactgctggtactggagtgcgtgccagttgagctggcgaagcgcgtcacggaagcgctgtcgattccggtgatcggcatcggcgcgggcaacgtcaccgacggtcagatcctggtgatgcacgatgcgtttggcatcaccggcggtcatattccaaaattcgcgaaaaatttcctcgccgaagcgggcgacatgcgcgccgctgtacggcagtatatggctgaagtggagtccggcgtttatccgggcgaagaacacagctttcactaa

SEQ ID NO: 100947 - protein, 263 aa, Salmonella enterica subsp. enterica serovar Choleraesuis str
MKPTTISLLQKCKQEKKRFATITAYDYSFAKLFADEGINVMLVGDSLGMTIQGHDSTLPVTVEDIAYHTRAVRRGAPNCLLLSDLPFMAYATPEQACENAAIVMRAGANMVKIEGGAWLVDTVKMLTERAVPVCGHLGLTPQSVNIFGGYKIQGRGDAGQVLLDDALALEAAGAQLLVLECVPVELAKRVTEALSIPVIGIGAGNVTDGQILVMHDAFGITGGHIPKFAKNFLAEAGDMRAAVRQYMAEVESGVYPGEEHSFH

SEQ ID NO: 100948 - DNA, 816 bp, Corynebacterium glutamicum ATCC 13032
  CDS (1)..(816): transl_table=11
atgcccatgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttttaa

SEQ ID NO: 100949 - protein, 271 aa, Corynebacterium glutamicum ATCC 13032
MPMSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 100950 - DNA, 801 bp, Pseudomonas syringae pv. syringae B728a
  CDS (1)..(801): transl_table=11
atgccgaacataaccgttacgtcgctgctggccatgaagcagaagggtgagaagatcaccatgctgacctgctacgacgcaaccttcgcccacacggcctcccaggcgggtgtcgaagtgctgctgataggcgactcgctgggcatggtcctgcaaggtcacgacagcaccctgcctgttaccaccgctgaaacggcgtaccacgttgcctgtgtgaaacgcggcaaccagggcgcgatgattcttgccgacctgccgttcatggccaacgcaacgctggagcagaccctgatcaacagcgcaacgctgatgcaggcgggcgcccacatgatcaaggtcgaaggcgctgcctggctggccgagtcgatccgtttgctggccgagcgcggcattccggtgtgcgcgcacatgggcctgaccccacaggcagtcaacgtgctgggcggctacaaggttcagggccggctggagacgcaggcgcggcagatgcgcgccgatgccatcgcactggaacaggcgggcgcagcgatgatcctgctggagtgcgtgcccagcgaactggccgaggaaatcacccaggcggtgaaggtcccggtcatcggcattggcgcaggcagcgccactgatggtcaggtcctggtgctgcacgacatgctcggcctgtccatcaccgggcgcgtgcccaagttcgtgaaaaacttcatgaccggccagcccgatatccagtcggctatccgggcctacgtgaccgccgtcaaagacctcagctttccggccactgaacacggattctcggcatga

SEQ ID NO: 100951 - protein, 266 aa, Pseudomonas syringae pv. syringae B728a
MPNITVTSLLAMKQKGEKITMLTCYDATFAHTASQAGVEVLLIGDSLGMVLQGHDSTLPVTTAETAYHVACVKRGNQGAMILADLPFMANATLEQTLINSATLMQAGAHMIKVEGAAWLAESIRLLAERGIPVCAHMGLTPQAVNVLGGYKVQGRLETQARQMRADAIALEQAGAAMILLECVPSELAEEITQAVKVPVIGIGAGSATDGQVLVLHDMLGLSITGRVPKFVKNFMTGQPDIQSAIRAYVTAVKDLSFPATEHGFSA

SEQ ID NO: 100952 - DNA, 861 bp, Corynebacterium jeikeium K411
  CDS (1)..(861): transl_table=11
atgaacagcatgactgcaacatctggaacatctagctccacccccactggctacctggtccccaccaagaaggtgcgtatcgctgacttgaaggcgcgcaagggcacgggcgagccgttcgcgatgctgaccgcctacgattactccaccgccgttgctttcgccgaggcgggcgtggagatcatgttagtcggcgattctgccgcgaatgtggtgtttggttacgatgccacccagcgcatcagcatggacgagatggtttacctgaccgcggccgtcgtccgcggagccggcaatgccgccgtggtcgctgacctgcccttcggcacctatgaggcctcggatgagcaggccgtgaaggcggcttccgagatgctgcatcgcacgggcgcgcacgcggtgaagatcgaaggcggggtgcggattgcggatcgcattcgcgctattactgacgccggcatctccgtctgtgcgcacatcggctttactccgcagtccgtcaaccagctgggcggtttcaaggtgcagggccgcggcgctggcgcagagcagctgctggccgatgcccgcgccgtgcaggaagccggtgccgacatggtggttctggaaatggtgcccgcagacgtggcggcttcggtgactaaggagctggacatcccgacgattggcattggcgcaggtccggactgcgatgggcaggttctggtgtggcacgacatggctgcgttcccagccggcgggcaccgtccgcgcttcgctaagcagtgggcttcggtgggttcggacctgacagccgccgctgctgcctacaagcgagaggttgctgaaggcggattcccgacgcaggagcactgcttctaa

SEQ ID NO: 100953 - protein, 286 aa, Corynebacterium jeikeium K411
MNSMTATSGTSSSTPTGYLVPTKKVRIADLKARKGTGEPFAMLTAYDYSTAVAFAEAGVEIMLVGDSAANVVFGYDATQRISMDEMVYLTAAVVRGAGNAAVVADLPFGTYEASDEQAVKAASEMLHRTGAHAVKIEGGVRIADRIRAITDAGISVCAHIGFTPQSVNQLGGFKVQGRGAGAEQLLADARAVQEAGADMVVLEMVPADVAASVTKELDIPTIGIGAGPDCDGQVLVWHDMAAFPAGGHRPRFAKQWASVGSDLTAAAAAYKREVAEGGFPTQEHCF

SEQ ID NO: 100954 - DNA, 819 bp, Staphylococcus haemolyticus JCSC1435
  CDS (1)..(819): transl_table=11
atgaaaaatttagcaaaattagttgaaatgaaacaagacaaaacgaaaatttcgatgattacagcatatgactttccaagtgccaaacaagcacaggatgcaaatatagatatgattttagttggtgattcacttggaatgacggtactaggttatgaaacgacaacacaagtgacattagaagacatgattcatcacggcaaagcggtacgtagaggtgctgatgatacttttgtagtagtggacttaccaattggcacagttggtgtaagtgatgaacatgatttgaaaaatgcgataacactttatcaggaaacgaatgctaatgcgttaaaagcagaaggtgcacatttagttaatttcattaagaaatcaacacaaattggaataccaattgtagcgcatctaggattaatgccacaaagcgttggtgttatgggctatcgtttacaaggtagtacgaaagatgcggctgaacaattaattcaagaagctcatgcagttcaagaagcaggcgcagtggctttagtattagaagcgattccaagtgacttagctggtttaattagtgagcaattagatatacccgttattggtattggagcaggaaaagacacagatggtcaagtattggtttatcacgatatgttaaattatggcgttgatcgctatgctaaatttgtaaaacaatttggcgatttttcagtaggaattgatgccattaaacattatgacgaagaagttaaggcagggacttttccagctgaagcccacacatataagaaaaagatattgaatgaggtaaacagcaatgactaa

SEQ ID NO: 100955 - protein, 272 aa, Staphylococcus haemolyticus JCSC1435
MKNLAKLVEMKQDKTKISMITAYDFPSAKQAQDANIDMILVGDSLGMTVLGYETTTQVTLEDMIHHGKAVRRGADDTFVVVDLPIGTVGVSDEHDLKNAITLYQETNANALKAEGAHLVNFIKKSTQIGIPIVAHLGLMPQSVGVMGYRLQGSTKDAAEQLIQEAHAVQEAGAVALVLEAIPSDLAGLISEQLDIPVIGIGAGKDTDGQVLVYHDMLNYGVDRYAKFVKQFGDFSVGIDAIKHYDEEVKAGTFPAEAHTYKKKILNEVNSND

SEQ ID NO: 100956 - DNA, 828 bp, Pseudomonas fluorescens Pf-5
  CDS (1)..(828): transl_table=11
atgagcagccatacccgcacccagcgcctgagcgtcccgcaactggtggccatgaaaggccggcagaagatcgtttccctcaccgcctataccagccacatggcgcggctgatggaccccttcgtggatttcatcctgatcggtgattccaccgccatggtcggttacgggcgcacctcgaccctggacatgagcctggcggaaatcatcgcccacacccgcgcggtggtggccggcagccgcctggcctgcgtgattgccgacatgcccttcggcagctaccaggaatccccgcaacaggcctaccgcaattgcgccgaggtgatggcccgcaccggttgcgccgccctcaagctggagggcggccgggccctggcgcccaccgtggagttcctggtgcagcggggcattccggtgatggcgcatatcggcctgatgccgcagttcgtcaaccagatgggcgggttcaaggcccaggggctcgacagcgaggcggcccgcaagatcgaggaagatgcccgggcccacctcgaggccggcgccttcagcctgttgctggaaggggttgcggagcccctggcgcggcgcatcagcgacttctcgccgatgccgaccattggcatcggcgcctccccggcctgcgacggccaggtactggtgaccgaagacctgctggggctgggcgggccccaggtgccgcgtttcgtcaagcaatacgccgatgccggcgccctgatcagccaggcctgcgaacgcttcgccgcagaggttcgggagcaggcctttccgcagttgcagcattgttatggggtggttcaggaggcctga

SEQ ID NO: 100957 - protein, 275 aa, Pseudomonas fluorescens Pf-5
MSSHTRTQRLSVPQLVAMKGRQKIVSLTAYTSHMARLMDPFVDFILIGDSTAMVGYGRTSTLDMSLAEIIAHTRAVVAGSRLACVIADMPFGSYQESPQQAYRNCAEVMARTGCAALKLEGGRALAPTVEFLVQRGIPVMAHIGLMPQFVNQMGGFKAQGLDSEAARKIEEDARAHLEAGAFSLLLEGVAEPLARRISDFSPMPTIGIGASPACDGQVLVTEDLLGLGGPQVPRFVKQYADAGALISQACERFAAEVREQAFPQLQHCYGVVQEA

SEQ ID NO: 100958 - DNA, 801 bp, Psychrobacter arcticum 273-4
  CDS (1)..(801): transl_table=11
atgacaacgttatctactttaaataagtttaaaaaagacggtactaaatttacttgtctaacctgttatgacgccatgtttgcgcgcatgatggaaaaagcacaaattgacacgattttaatcggtgatagtttgggtatggtggtgcagggtcatgattcgaccttgcctgttactgtcgatgatatggcttatcatactgccaatgtcgcccgtagcaataagcaagcgcttattttagcggatttaccctttatgagctatgtaacgctgccagaagctattgctaatagccgcaagctgatgcaagtaggcgcgcacgtgattaaaattgaaggtggtagtgagctttgcgagttggtcaccatgttggcgcaagcaggtacgccaacgtgtgtgcatttgggactaacgccacagtcggtgaatgtttttggtggttataaagtccagggtcgtggcgatgaagcaggtcaaaaactccttgacgatgcaaaagccgtggttaatgccggtgccgcacttttggtgctagagtgtgttcctgctgagcttgctaaagcggtaacggaagccgttgctgtgccagtgattggcattggcgcaggcgctgataccgatggtcaagtattggtcatgcacgatatgctcggtatggctcatggacgcacgccgcgttttgtccatgattttttaactgatgagcgcaacactgagcacagtatcgaaggcgcatttgccttgtatcagcagtcagtaaaggaaggtagcttcccaaaagagcagcaccagtttagctaa

SEQ ID NO: 100959 - protein, 266 aa, Psychrobacter arcticum 273-4
MTTLSTLNKFKKDGTKFTCLTCYDAMFARMMEKAQIDTILIGDSLGMVVQGHDSTLPVTVDDMAYHTANVARSNKQALILADLPFMSYVTLPEAIANSRKLMQVGAHVIKIEGGSELCELVTMLAQAGTPTCVHLGLTPQSVNVFGGYKVQGRGDEAGQKLLDDAKAVVNAGAALLVLECVPAELAKAVTEAVAVPVIGIGAGADTDGQVLVMHDMLGMAHGRTPRFVHDFLTDERNTEHSIEGAFALYQQSVKEGSFPKEQHQFS

SEQ ID NO: 100960 - DNA, 774 bp, Candidatus Pelagibacter ubique HTCC1062
  CDS (1)..(774): transl_table=11
atgaataaaaaaatcttaaactttattaaaaaaaaaaataaaactaaaattataagtcttactgcttactctaaaaatatagcatcaataatagatagacactgtgaccttgtattggtaggcgactcccttggctctgtactttatagtttttcttctacaaaaaaagtgacattggatatgatgattgaacattctaaaagtgtaagaatgggtgttaaaaaaagtttaatggtagtagacatgcctcataacacttaccgtaactcaaaagaagccttaagtaatgcaaaaaaaataatctctaaaacgaagtgtgatgcaatcaagcttgaggggggtaaaaaagtaattcaaataattaaaactttaattaagaataaaattcctgtgatggggcatcttggtgttctaccgcaatctgcaacaaattttaaatttaaaggaaaagaaatagcagaaagaaaaattattttaagagattctaaacttttagaagatgctggtgtattttcaatagttttagagtgtgttgaaagctcgttagcaaaagaaattactaaaactgttaaagttcctacaattggaattggggcatcagtacattgtgatggtcaagttttagttactgacgacttgataggtctgaataaaattaaagctagatttgtgaaaaggtattcaaatattgaaaaacaaataaatgatgctgcactaaaatttaagaaagatgtaattagaagtaagtttcctactaaaaaacattcatattaa

SEQ ID NO: 100961 - protein, 257 aa, Candidatus Pelagibacter ubique HTCC1062
MNKKILNFIKKKNKTKIISLTAYSKNIASIIDRHCDLVLVGDSLGSVLYSFSSTKKVTLDMMIEHSKSVRMGVKKSLMVVDMPHNTYRNSKEALSNAKKIISKTKCDAIKLEGGKKVIQIIKTLIKNKIPVMGHLGVLPQSATNFKFKGKEIAERKIILRDSKLLEDAGVFSIVLECVESSLAKEITKTVKVPTIGIGASVHCDGQVLVTDDLIGLNKIKARFVKRYSNIEKQINDAALKFKKDVIRSKFPTKKHSY

SEQ ID NO: 100962 - DNA, 795 bp, Colwellia psychrerythraea 34H
  CDS (1)..(795): transl_table=11
atggctaaaatcactactgcaagcttgcttaacatgaaacaacaaggcaaaaagatatcaactattactgcctatgatgccagctttgcaaaattatttgatcaagcaggcatacacgccatacttattggcgactctttaggtatggtattacaggggcaagacagcacattacctgtgacaatcgaagatatggcttatcatacacgttgtgtaaaacgtggcgttgaagagacccttattatcgccgatatgccttttatgagctatgccaacgaagagcaagctctagcaaatgcagcgctgttaatgcaagcaggcgctagtatggtaaaaatagaaggtggtgcttggcttaacggcactatttctgcccttgttgaacgcggtgttcccgtttgtgctcatttaggtttaacaccgcaatcagttaatattttcggtggctttaaagtgcaaggccgtgacgatgacaaagcccaacaaatgatcgctgatgcaaaagcacttgaagcagctggcgctcaactattggtacttgaatgtattccagcgattttaggtgaagccatcacgcaagcgcttactattccaactattggtataggcgcaggtaaagacactgatggacaaattttagttatgcacgatgccttaggtattgcgtgtaattatatgcctaagttttcgcgcaacttcttaaaagatactggtgatattaaaaaagccgttgagctctatatcagtgaagtgagtgaaggtaacttcccaggtgatgagcatatattcaagtaa

SEQ ID NO: 100963 - protein, 264 aa, Colwellia psychrerythraea 34H
MAKITTASLLNMKQQGKKISTITAYDASFAKLFDQAGIHAILIGDSLGMVLQGQDSTLPVTIEDMAYHTRCVKRGVEETLIIADMPFMSYANEEQALANAALLMQAGASMVKIEGGAWLNGTISALVERGVPVCAHLGLTPQSVNIFGGFKVQGRDDDKAQQMIADAKALEAAGAQLLVLECIPAILGEAITQALTIPTIGIGAGKDTDGQILVMHDALGIACNYMPKFSRNFLKDTGDIKKAVELYISEVSEGNFPGDEHIFK

SEQ ID NO: 100964 - DNA, 801 bp, Pseudomonas syringae pv. phaseolicola 1448A
  CDS (1)..(801): transl_table=11
atgccgaacataaccgttacgtcgctgctggccatgaagcagaagggtgagaagatcaccatgctgacctgctacgacgcaaccttcgcccacacggcctcccaggcgggtgtcgaagtgctgctgataggcgactcgctgggcatggtcctgcagggtcacgacagcaccctgcccgtcacgaccgccgaaaccgcgtaccacgttgcctgtgtcaaacgcggtaatcagggcgcgatgattctcgccgacctgccgttcatggccaacgccacgctggagcagaccttcatcaacagcgcgacgctgatgcaggcaggtgcgcacatgatcaaggtcgaaggcgctgcatggcttggcgagtcgatccgtttgctggcagaacgcggcatcccggtgtgcgcacacatgggcctgacgccgcaggcagtcaacgtactgggcggctacaaggttcagggtcgactggaagcacaggcacggcagatgcgtgccgacgcgatcgcgctggaacaggcgggcgcagcgatgatcctgctggagtgtgtgccgagcgaactcgccgaagaaatcacccaggcggtgaaaattccggtcatcggtattggcgcaggcagcgctaccgacggccaggtactggtgctgcacgacatgctgggcctgtccatcagcgggcgcgtacccaaattcgtaaaaaacttcatgaccggtcagcccgatatccagtcggctatccgggcctacgtggccgcggtcaaagacgtcagctttccggcaactgaacacggattctcggcatga

SEQ ID NO: 100965 - protein, 266 aa, Pseudomonas syringae pv. phaseolicola 1448A
MPNITVTSLLAMKQKGEKITMLTCYDATFAHTASQAGVEVLLIGDSLGMVLQGHDSTLPVTTAETAYHVACVKRGNQGAMILADLPFMANATLEQTFINSATLMQAGAHMIKVEGAAWLGESIRLLAERGIPVCAHMGLTPQAVNVLGGYKVQGRLEAQARQMRADAIALEQAGAAMILLECVPSELAEEITQAVKIPVIGIGAGSATDGQVLVLHDMLGLSISGRVPKFVKNFMTGQPDIQSAIRAYVAAVKDVSFPATEHGFSA

SEQ ID NO: 100966 - DNA, 819 bp, Dechloromonas aromatica RCB
  CDS (1)..(819): transl_table=11
atgtctgctcaagtcgcaacccgccgcctgacccaggccgatctcgccaagctctaccaagctggtgagaaaatcgcccagttcacctgctatgacgccagctttgcccgtctgctcgacggcgccggggtcgattcgatcctgatcggcgattcgctgggtaacgtcatccagggccacgacaccacgctgccggtcaccgtcgccgacatcgcctatcacaccgccgccgtcaaacgcggctgcgaccgcgccttcattgttgccgacatgcctttcggcagttatcaggaatcgccggaacaggccttccgtaacgccgcgacactgatggccgccggcgcccagatggtcaagcttgaaggcggtgccgacatggcaccgaccgtacgtttcatggtcagccgcggcattccggtctgcggccatatcggcctgacaccacaatccgtgcatgtgctgggcggctacaaggtgcaaggcaagggcgaagctgcggcgcagcgcctgaaggacgatgccatggcgctcaaggcggccggtgccaccatgctgctgctcgaggccattccggccacgttggcagccgaagtcacggcgatgaccggcgtcatcaccatcggtatcggcgccggcaaggattgctccggccaggtcatggtgttgcacgatgcctttgatatcccgcccggcaagaaagccaagttcgtcaagaatttcatggaaggcgccagcagcattcacgacgccgcctgccgcgccatcgccgccgtcaaggacggcagctaccctggccccgaacacacctattccgcttaa

SEQ ID NO: 100967 - protein, 272 aa, Dechloromonas aromatica RCB
MSAQVATRRLTQADLAKLYQAGEKIAQFTCYDASFARLLDGAGVDSILIGDSLGNVIQGHDTTLPVTVADIAYHTAAVKRGCDRAFIVADMPFGSYQESPEQAFRNAATLMAAGAQMVKLEGGADMAPTVRFMVSRGIPVCGHIGLTPQSVHVLGGYKVQGKGEAAAQRLKDDAMALKAAGATMLLLEAIPATLAAEVTAMTGVITIGIGAGKDCSGQVMVLHDAFDIPPGKKAKFVKNFMEGASSIHDAACRAIAAVKDGSYPGPEHTYSA

SEQ ID NO: 100968 - DNA, 843 bp, Thermobifida fusca YX
  CDS (1)..(843): transl_table=11
atgagttctcacacccccgctcctgctttgtatggcggctccgcaaaccgccgggtcacggttcaggacttggccgcagcgaaagagcgcggcgaacgctggccgatgctcaccgcctatgacgcgctgactgcccggattttcgacgaggcgggcattccggtgctgctggtgggtgactctgctgcgatggtggtgttcggctacgactccacgatcccggtcacccttgacgacatgatcccgttgacggccgcggtgtcgcgggcgacgaagcgggcgctggtggtggctgacctcccgttcggctcctaccaggccggtccggagcaggctttggagtcggcggcgcggctgatgaaggagggcggcgcccaggcggtcaagctggagggcggccaccgggtcatcgcccaggtggaggctttggtgtcggcgggtatcccggtgatgggccacatcgggttgacgccgcagtcggtgaatgtgctgggcggctaccgcgtgcagggccgcagcgaggaggcggccgaggcgctgctgtctgatgcgaaggagcttgagcgggcgggcgtgttctcggtggtgctggagtgcgtgcctgcgcgggtgggcgcggagatcacccggcagttgacggtgccgacgatcgggatcggcgcgggtccggacacggacgcccaggtgctggtgtggcaggacatggccgggttgtcgccgcgggtcgccaagttcgtcaagtcgtacgcgaatctggcggagcagttgcgggacgctgccacgagtttcgcggaggaagtggtggcgggcacgttcccggacgagcagcactcctacgcctag

SEQ ID NO: 100969 - protein, 280 aa, Thermobifida fusca YX
MSSHTPAPALYGGSANRRVTVQDLAAAKERGERWPMLTAYDALTARIFDEAGIPVLLVGDSAAMVVFGYDSTIPVTLDDMIPLTAAVSRATKRALVVADLPFGSYQAGPEQALESAARLMKEGGAQAVKLEGGHRVIAQVEALVSAGIPVMGHIGLTPQSVNVLGGYRVQGRSEEAAEALLSDAKELERAGVFSVVLECVPARVGAEITRQLTVPTIGIGAGPDTDAQVLVWQDMAGLSPRVAKFVKSYANLAEQLRDAATSFAEEVVAGTFPDEQHSYA

SEQ ID NO: 100970 - DNA, 819 bp, Prochlorococcus marinus str. NATL2A
  CDS (1)..(819): transl_table=11
atgcaaaccacagaattggttcgttttaaaaagttgggcaaacagataagtgtattaactgcttgggatgctatctcatcttcaatagtcgaggctgcaggagctgatgttgttctagtgggagattcacttgggatggttgtcttgggacattcaacgactcttccggtaacacttgatcaaatgcttcaccacacaaaggctgtttgtagaggtttttgtaaacctctttcaaaacaacccttagtagtttgtgatctcccttttttaagttatcaatgtggagaggacaaggctgttgaagcggctggaactctcctaaaaaactccactgcttcagcagtgaaactggaaggagcagaacctgagactttattagtaattaagagacttattagaatggggattccagtcatggggcatcttggcctaactccacagtcagttcatcaacttggatataaatcacaagctagggataaagatagtcaagaaaaaatttttaaagattcaaaaatgcttcaagaatcaggatgttttgcaatcgttttagaacatattccaggagaaattgccagcagattaaagaaacatatagatattcctgtaattggcattggagctggaaatgattgtgatgggcaggtaagagttaccgctgatattcttggcctttcaattgcgcagcctccttttgcaaaacctttacttgcaggaagagaactttgcataaatgccctaaaagaatggattaattctactgatctcgatcaagtgaatcccaccacaaaaacatctgaatcaaaatctgattgctaa

SEQ ID NO: 100971 - protein, 272 aa, Prochlorococcus marinus str. NATL2A
MQTTELVRFKKLGKQISVLTAWDAISSSIVEAAGADVVLVGDSLGMVVLGHSTTLPVTLDQMLHHTKAVCRGFCKPLSKQPLVVCDLPFLSYQCGEDKAVEAAGTLLKNSTASAVKLEGAEPETLLVIKRLIRMGIPVMGHLGLTPQSVHQLGYKSQARDKDSQEKIFKDSKMLQESGCFAIVLEHIPGEIASRLKKHIDIPVIGIGAGNDCDGQVRVTADILGLSIAQPPFAKPLLAGRELCINALKEWINSTDLDQVNPTTKTSESKSDC

SEQ ID NO: 100972 - DNA, 822 bp, Ralstonia eutropha JMP134
  CDS (1)..(822): transl_table=11
atgagctacctcctcgatccctcccgcaagaccgtcaccatcacccggctgcaggccatgcgcgacgccggtgaaaagatcgcgatgctgaccgcttacgactccagcttcgccgcgttgctcgactactgcggcgtggaagtcatcctggtcggtgattcgctcggcaacgtgatgcaaggccagcaaaccacgctgcccgtgacgctggagcacatggcttaccacaccgaatgcgtggcacgcgccaaccagacggcgctgctggtaaccgacctgcccttcggcacctacggcacgccggaaatggcatttgcaagcgcggtcacgctgatgcgtgcgggcgcgcacatggtcaagctcgaaggcggcgactggctggccccgaccgtgaagttcctggtcgagcgcagcatcccggtgtgcgcccatatcggcctgaccccgcagtcggtgcatgcgttcggcggcttcaaggtgcagggcaagaccgatgaaggcgcagcccaactgcggcgcgacgctcaggcaatggaggctgccggcgcacagatcgtgctgatggaggcggtgccggccacgctcgccggcgagatcacgcagatgctcaaggtgccgaccatcggcatcggtgccggcgcggactgctcgggccaggtgctggtgctgcaggacatgatcaacgtctacccgggacgcaaggccaagttcgtgcgcaacttcatggacggccagacgacgatcgaaggtgcgatccgcgcctatgtggccgccgtgaaggatggcagcttcccggcagcagagcacaccttctccgcctga

SEQ ID NO: 100973 - protein, 273 aa, Ralstonia eutropha JMP134
MSYLLDPSRKTVTITRLQAMRDAGEKIAMLTAYDSSFAALLDYCGVEVILVGDSLGNVMQGQQTTLPVTLEHMAYHTECVARANQTALLVTDLPFGTYGTPEMAFASAVTLMRAGAHMVKLEGGDWLAPTVKFLVERSIPVCAHIGLTPQSVHAFGGFKVQGKTDEGAAQLRRDAQAMEAAGAQIVLMEAVPATLAGEITQMLKVPTIGIGAGADCSGQVLVLQDMINVYPGRKAKFVRNFMDGQTTIEGAIRAYVAAVKDGSFPAAEHTFSA

SEQ ID NO: 100974 - DNA, 813 bp, Staphylococcus saprophyticus subsp. saprophyticus ATCC 15305
  CDS (1)..(813): transl_table=11
atgaaaactttaaatcagttacaagatttaaaagtgaataaagaaaaaatttcaatggtgacagcatatgattatccaagtgcgaagcaagtcgaagcggctgatatagacatcattttagttggtgattcattaggaatgacggtattaggttatgatagtacagttcaggttactgtagcagatatgatccatcatacaaaagcagttagaagaggtgcacctaatacatatttgatcgtggatgtacctttcggggcagtaggtgtcaatgatcaatatgatttagaaatagcggtaaaactatataaagaaacagatgccaatgcaatcaaagcagaaggtgcacatttaactcaatatataaaaaattgtagcaatatgggtattccagttgtgtcacatttgggattaacaccacaaagtgttggtattatgggatataaaatgcaagctggtaataaagaagctgcacgacaacttattgaagatgcctatgctgtgcaacaagcgggcgctgtgatgttagttcttgaagcagtcccaagcgatttagctgcagaaatttcagataaactagatattcctgttatcggtattggggcaggaaaagaaacagacggacaagtattggtttatcatgatttattaaattatgctgtagaacatagagcgaaatttgttaaacaatttggtgatttctcagtgggcattgatgcattaaagcaatataacaatgaggtgaaagcggaacaatttcctggtgaggcccatacctataaaaagcaaattatgaatgaggttacagaatga

SEQ ID NO: 100975 - protein, 270 aa, Staphylococcus saprophyticus subsp. saprophyticus ATCC 15305
MKTLNQLQDLKVNKEKISMVTAYDYPSAKQVEAADIDIILVGDSLGMTVLGYDSTVQVTVADMIHHTKAVRRGAPNTYLIVDVPFGAVGVNDQYDLEIAVKLYKETDANAIKAEGAHLTQYIKNCSNMGIPVVSHLGLTPQSVGIMGYKMQAGNKEAARQLIEDAYAVQQAGAVMLVLEAVPSDLAAEISDKLDIPVIGIGAGKETDGQVLVYHDLLNYAVEHRAKFVKQFGDFSVGIDALKQYNNEVKAEQFPGEAHTYKKQIMNEVTE

SEQ ID NO: 100976 - DNA, 840 bp, Dehalococcoides sp. CBDB1
  CDS (1)..(840): transl_table=11
atgcgtaccactatcagccaacttaaagaaatgaaacaaaacaaacagaagatagccattttgactgcttatgactatcccactgcccaaatactggataaagccggtatcccggccatactggtaggagacagtctgggtatggtagtgctggggtatgattctaccgtaagcgttactatggaagatatgctgcaccatctgaaagccgtagtcaggggcagtcaaaaagccctgattatagcagatatgccatttatgacctaccatctgagtccggaacaggcgctgttaaatgccggtcgttttattcaggagggcggtgctcaggcagtcaagctggagggtggagtaaatgtggctgacaaggttaaaagaatagtagactgcggtatacctgttatggggcatatcggacttaccccccaatctgtaaaccagttaagcggatttaaggtgcaggggaaaactctggcaactgccctatcccttatagaagatgccaaggctctggaaaaagccggggcctttgcaatagtgctggagactatgccggctgaactggcggctattattacagccggtatttccatacctaccataggtataggtgccggagaagaatgtgacgggcaggtacaggtgatatcagatatgctgggtatgtttactgattttgtacccaagcacaccaaacggtatgctgatttaaatggcagtattacaaaagctgtatctgaatatgccgctgaagtcactaaaggtgcgtttcccactttaaaggagagcttcacccttgataaaaaggtactggaggaactgaaaaagtgcgtattataa

SEQ ID NO: 100977 - protein, 279 aa, Dehalococcoides sp. CBDB1
MRTTISQLKEMKQNKQKIAILTAYDYPTAQILDKAGIPAILVGDSLGMVVLGYDSTVSVTMEDMLHHLKAVVRGSQKALIIADMPFMTYHLSPEQALLNAGRFIQEGGAQAVKLEGGVNVADKVKRIVDCGIPVMGHIGLTPQSVNQLSGFKVQGKTLATALSLIEDAKALEKAGAFAIVLETMPAELAAIITAGISIPTIGIGAGEECDGQVQVISDMLGMFTDFVPKHTKRYADLNGSITKAVSEYAAEVTKGAFPTLKESFTLDKKVLEELKKCVL

SEQ ID NO: 100978 - DNA, 789 bp, Thiobacillus denitrificans ATCC 25259
  CDS (1)..(789): transl_table=11
atgccggtgacgctctcgacgctaaaagcgctgcggcagaagggcgagaagatcgccgtgctcacgtgctacgacgcgagcttcgcgcgcgtgttcgacgccgccggcgtcgacgtcctgctcgtcggcgattcgctcggcatggtgatccagggccacgcctcgacgctgcccgtcaaactggccgaaatggcgtatcacacgcgctgcgtcgcggccggaacgacgcgcgccttcatcgtcgccgacctgcctttcggcagctaccagccgtcgccggagcgcgcctacacggcggccgcgcgcctgatggcggccggcgcgcacatgatcaagctcgaaggcggtgcggtcatggtcgacacggtcgcgtttcttgccgcgcgcggcattccggtgtgcgcccacctcgggcttctgccgcagtcggtcaaccagctcggcggctaccgggtgcaggggcgcgaggacggcgacgccgcacagctcgtcgccgacgcccgcgcgctcgaggcagccggtgcgggactgatcgtgctcgaaatggtgcctgcggcgctggcgaagaccgtcaccgcggcgctgtcgatgccaaccatcggcatcggggccggtgccgactgcgcgggacaggtcctcgtgtcctacgacatgctcggcctctatccgcgcgcgccgaagttctcgaagaattttctcgccggcgccggcagcgtcgacgccgccgtgcgcgcctacgtcgcggcagtcaaggacggcagcttccccgccgccgaacacgcgttctga

SEQ ID NO: 100979 - protein, 262 aa, Thiobacillus denitrificans ATCC 25259
MPVTLSTLKALRQKGEKIAVLTCYDASFARVFDAAGVDVLLVGDSLGMVIQGHASTLPVKLAEMAYHTRCVAAGTTRAFIVADLPFGSYQPSPERAYTAAARLMAAGAHMIKLEGGAVMVDTVAFLAARGIPVCAHLGLLPQSVNQLGGYRVQGREDGDAAQLVADARALEAAGAGLIVLEMVPAALAKTVTAALSMPTIGIGAGADCAGQVLVSYDMLGLYPRAPKFSKNFLAGAGSVDAAVRAYVAAVKDGSFPAAEHAF

SEQ ID NO: 100980 - DNA, 834 bp, Rhodobacter sphaeroides 2.4.1
  CDS (1)..(834)
atgagcgtgaacagtcccgtccgcccggtcatggcggccgacatcctggcgcggaaggggggcgagcccatcgtctgcctgaccgcctacaccacgcccatggcgcggctggtggatgcgcactgcgacctcacgctggtgggcgacagcctcggcatggtggttcacggcctgcccaccacgctcggcgtgaccatggagatgatgatcctgcacgggcaggcggtggcgcgcggcacctcgcgctcgatgctggtggtcgacatgcccttcggcagctacgaggagagccccgcgcaggccttcgccaatgcgcgccgcctgatggccgagacgggctgcgccgcggtgaagctcgagggcggccagcacatggccgaaacgatccgcttcctcgtcgcgcgcggcgtgccggtcatggcccatatcgggctcacgccgcaggcggtgaatgcgctcggcggctacaaggtgcagggccgcggcgccgatgccgagcgggtgatggaggatgccatcgccgtggccgaggccggggccttctcggtcgtgctcgagaaggtgccggacggactgtcgcagcgcatcacccagcgcatcgcgatccccaccatcggcatcggggcctcggcccactgcgatgggcaggtgctggtgctcgacgacatgctggggctcttcgccgacttccggccgaagttcgtcaagcggtacggcgagctcggcgcctccgccgacgaggccatcgccacttatgcggccgaggtccgggcccggcgcttccccgcacccgaacatgtcttcgccgacgagctgaagggaaaggcgcagtga

SEQ ID NO: 100981 - protein, 277 aa, Rhodobacter sphaeroides 2.4.1
MSVNSPVRPVMAADILARKGGEPIVCLTAYTTPMARLVDAHCDLTLVGDSLGMVVHGLPTTLGVTMEMMILHGQAVARGTSRSMLVVDMPFGSYEESPAQAFANARRLMAETGCAAVKLEGGQHMAETIRFLVARGVPVMAHIGLTPQAVNALGGYKVQGRGADAERVMEDAIAVAEAGAFSVVLEKVPDGLSQRITQRIAIPTIGIGASAHCDGQVLVLDDMLGLFADFRPKFVKRYGELGASADEAIATYAAEVRARRFPAPEHVFADELKGKAQ

SEQ ID NO: 100982 - DNA, 825 bp, Magnetospirillum magnetotacticum MS-1
  CDS (1)..(825)
atgtcgcaggttgtccaaacccgtcgcctgcaggcggtcgatctgatcaagcgcaaggccgaagggcgcaagatcatcgcgctcaccgcctaccacgcgcatacggcgaacatcgtcgacgcctattgcgacttcgtcctcgtgggtgattccctcggcatggtgatgcacgggatggaatcgaccctgccggtgacgctggagatgatgatcctccaggcccaggcggtgatgcggggaacctcccgcgccctcgtcgtggtcgatatgccgttcggctcctatgaggcgagccgcgagcaggcctttctcaacgccgcccgcgtcctcaaggagacgggggccggagcggtcaagctggagggcggcgcccgcttcgccgagaccgtcgccttcctgaccgagcgcggcgtgccggtgatgggccatatcggcctcaccccccaatccgtgaacaccatgggcggcttcaaggtgcagggccacggggccggcgacgaggagcgcctgcgggcggatgcccgcgccatcagcgatgcgggcgccttctccatcgtcctcgaaggcattgtcgagccggtggcgcgggccatcgccggcgatcccgccatccgtgcggcgaccatcgggatcggcgcgaccgccgcctgcgacgggcagatcctcgtcctcgaggacatgctcggcctcagcgaccgggtgccgcgcttcgtcaaaagcttcggctccctgcgcacgcagatcgaggaagcggtgcgggcctatgcggacgaggtccgggccgggcgcttcccggcggaggatcacacctacccgccccggtga

SEQ ID NO: 100983 - protein, 274 aa, Magnetospirillum magnetotacticum MS-1
MSQVVQTRRLQAVDLIKRKAEGRKIIALTAYHAHTANIVDAYCDFVLVGDSLGMVMHGMESTLPVTLEMMILQAQAVMRGTSRALVVVDMPFGSYEASREQAFLNAARVLKETGAGAVKLEGGARFAETVAFLTERGVPVMGHIGLTPQSVNTMGGFKVQGHGAGDEERLRADARAISDAGAFSIVLEGIVEPVARAIAGDPAIRAATIGIGATAACDGQILVLEDMLGLSDRVPRFVKSFGSLRTQIEEAVRAYADEVRAGRFPAEDHTYPPR

SEQ ID NO: 100984 - DNA, 771 bp, Nostoc punctiforme PCC 73102
  CDS (1)..(771)
atggcaatcactacccagcaattaattcaatggaaacaacagggacgttcaattgtcgcgttgaccgcctgggattatgcgatcgctcaactcatcgatgcagctggtgtagacttaatccttgtgggcgactctatggcagtagttttagggtatgacacaacactgccgataactttggatgagatgatataccacgccaaatctgtgcgtcgtggggttaaacgcgcattagtggtggtagatttaccatttttgacgtatcaagaaagtcttcaacaagcgatgcactcagctgggcgggtactgaaggaaacgggcgctcaagcggtaaaattggagggtggctatccagcgatcgcagaaactattgctcgtttggtacaagctggaattccggtaatgggtcatgtaggtttgacaccacaatcggtacatcaactcggtttgcgacaacaagggaaaacccaagaagcgagtgagagaattttacttgaagcgatcgctctcgaacaagcaggtgtattttctatagttttagagcatatccccgcagatttggcaatgcagattacacaaaaattaagtattccgacaattggtatcggtgcgggaactcactgcgatggacaagttttagttacctcggatgtaatcggactggctgaaaaacatccaccgttcgccaaggtttacaccaacttgcgagagacgattaccaaggctgtgcaagattatgccgtggaagtgcgcgatcggaaatttccatag

SEQ ID NO: 100985 - protein, 256 aa, Nostoc punctiforme PCC 73102
MAITTQQLIQWKQQGRSIVALTAWDYAIAQLIDAAGVDLILVGDSMAVVLGYDTTLPITLDEMIYHAKSVRRGVKRALVVVDLPFLTYQESLQQAMHSAGRVLKETGAQAVKLEGGYPAIAETIARLVQAGIPVMGHVGLTPQSVHQLGLRQQGKTQEASERILLEAIALEQAGVFSIVLEHIPADLAMQITQKLSIPTIGIGAGTHCDGQVLVTSDVIGLAEKHPPFAKVYTNLRETITKAVQDYAVEVRDRKFP

SEQ ID NO: 100986 - DNA, 801 bp, Pseudomonas aeruginosa UCBPP-PA14
  CDS (1)..(801)
atgcctgatgtaaccctgaccaccctgcaagggttgaagcagagcggcgagaagatcgccatgctgacctgctacgacgccaccttcgcccacaccgccagccaggccggcgtggacgtgcttctggtcggagattcgctcggaatggtattgcagggtcacgacagcaccctgccggtcagcaacgaggaaatggcctatcacacggcctgcgtgaaacgcggtaacaaaggttccctgatcgtcaccgacctggccttcgaatccagccattccgtggcccagacccttgccgacgcggtccgcctgatgcaggccggcgcacacatggtcaagctggagggtggggcctggctggcggagccgatcgcccgcctggcacagatgggcgtgccggtctgcgcgcatctcggcctgaccccgcaggcggtcaacctgttcggcggcttcaaggtccagggccgccaggaaacccaggcgcgccagttgcgcgccgatgccatcgccctggagcaggccggcgccgccatgctgctgctggagtgcgtgcccagcgtgctggccgaagagatcacccaggcggtgaagatcccggtgatcgggattggcgccggtgcggcgaccgatggccaggtgctggtcatgcacgacatgctgggtctctcgctgaccggccgctcgcccaagttcgtcaaggatttcatgcaaggccaggagagcatcccagccgccatcgcggcctacgtccgcgccgtcaaggacgtgtccttccccgccgccgaacacggattcaacgcatga

SEQ ID NO: 100987 - protein, 266 aa, Pseudomonas aeruginosa UCBPP-PA14
MPDVTLTTLQGLKQSGEKIAMLTCYDATFAHTASQAGVDVLLVGDSLGMVLQGHDSTLPVSNEEMAYHTACVKRGNKGSLIVTDLAFESSHSVAQTLADAVRLMQAGAHMVKLEGGAWLAEPIARLAQMGVPVCAHLGLTPQAVNLFGGFKVQGRQETQARQLRADAIALEQAGAAMLLLECVPSVLAEEITQAVKIPVIGIGAGAATDGQVLVMHDMLGLSLTGRSPKFVKDFMQGQESIPAAIAAYVRAVKDVSFPAAEHGFNA

SEQ ID NO: 100988 - DNA, 726 bp, Psychrobacter sp. 273-4
  CDS (1)..(726)
atgtttgcgcgcatgatggaaaaagcacaaattgacacgattttaatcggtgatagtttgggtatggtggtgcagggtcatgattcgaccttgcctgttactgtcgatgatatggcttatcatactgccaatgtcgcccgtagcaataagcaagcgcttattttagcggatttaccctttatgagctatgtaacgctgccagaagctattgctaatagccgcaagctgatgcaagtaggcgcgcacgtgattaaaattgaaggtggtagtgagctttgcgagttggtcaccatgttggcgcaagcaggtacgccaacgtgtgtgcatttgggactaacgccacagtcggtgaatgtttttggtggttataaagtccagggtcgtggcgatgaagcaggtcaaaaactccttgacgatgcaaaagccgtggttaatgccggtgccgcacttttggtgctagagtgtgttcctgctgagcttgctaaagcggtaacggaagccgttgctgtgccagtgattggcattggcgcaggcgctgataccgatggtcaagtattggtcatgcacgatatgctcggtatggctcatggacgcacgccgcgttttgtccatgattttttaactgatgagcgcaacactgagcacagtatcgaaggcgcatttgccttgtatcagcagtcagtaaaggaaggtagcttcccaaaagagcagcaccagtttagctaa

SEQ ID NO: 100989 - protein, 241 aa, Psychrobacter sp. 273-4
MFARMMEKAQIDTILIGDSLGMVVQGHDSTLPVTVDDMAYHTANVARSNKQALILADLPFMSYVTLPEAIANSRKLMQVGAHVIKIEGGSELCELVTMLAQAGTPTCVHLGLTPQSVNVFGGYKVQGRGDEAGQKLLDDAKAVVNAGAALLVLECVPAELAKAVTEAVAVPVIGIGAGADTDGQVLVMHDMLGMAHGRTPRFVHDFLTDERNTEHSIEGAFALYQQSVKEGSFPKEQHQFS

SEQ ID NO: 100990 - DNA, 774 bp, Anabaena variabilis ATCC 29413
  CDS (1)..(774)
atgccagtcactacccagcaattaatccagtggaaacaacaaggacgctcaattgtggcgttgacggcttgggattatacgatcgcccaaattctcgatgctgctggtgtagacttaattctcgtgggtgactcgatggcggtaatgttgggttataaaaccacgctgccaattacattagaggagatgttacaccacgctaaagcagtttgtcgtggtgtgcagcgggctttagttgtggttgatttaccatttttgacttatcaagaaagtattccacaggcaatcaactcggctgggcgcatattaaaggaaacaggcgctcaggcagttaaattagaaggtggctatccggcaatggtagaaactattacccgtttggtacaagcggggataccagtgatgggtcatgtaggtttgacaccccaatcagttcatcaattggggttgcgtcaacaaggtaagacccaggaaacagctcagagaattttaaacgaagcgatcgcacttgaacaagcgggtgtattttctatagtgttagagcatatccccgcagatttggcaatgcagattacacaaaaacttagtattcccaccatcggtatcggtgcgggttcccattgcgacggtcaagttttagtgacttctgatgtattgggtttatcggaaagacaaccaccctttgctaaggtttatacgaatttgcgcgcaacaattactaaagctgtacaagattacgctgcggaagtacgcgatcgccagttcccagaatag

SEQ ID NO: 100991 - protein, 257 aa, Anabaena variabilis ATCC 29413
MPVTTQQLIQWKQQGRSIVALTAWDYTIAQILDAAGVDLILVGDSMAVMLGYKTTLPITLEEMLHHAKAVCRGVQRALVVVDLPFLTYQESIPQAINSAGRILKETGAQAVKLEGGYPAMVETITRLVQAGIPVMGHVGLTPQSVHQLGLRQQGKTQETAQRILNEAIALEQAGVFSIVLEHIPADLAMQITQKLSIPTIGIGAGSHCDGQVLVTSDVLGLSERQPPFAKVYTNLRATITKAVQDYAAEVRDRQFPE

SEQ ID NO: 100992 - DNA, 816 bp, Burkholderia cepacia R18194
  CDS (1)..(816)
atgacctatctccaggaatcgagccggcctgccgtcacggtgcccaagctgcaggcaatgcgcgacgccggcgagaagatcgcgatgctcacctgctacgacgcgagcttttccgcactgctcgaccgttcgggcgtcgacgtgctgctgatcggcgattcgctcggcaacgtgctgcaaggccacacgaccacgctgcccgtgtcgctcgacgacatcgcgtatcacaccgcctgtgttgcccgcgcgcagccgcgcgcgctgatcatggccgacctgccgttcggcacgtacggcacgccggccgaggcattcgcaagcagcgtcaagctgatgcgcgccggtgcgcagatggtcaagctcgaaggcggcgaatggctcgccgagacgatccgcttcctcgtcgagcgcgcggtgcccgtatgtgcgcacgtgggcctcacgcctcagtcggtccacgcgttcggcggcttcaaggtacagggcaagaccgaagccggcgccgcgcaactgctgcgcgacgcgcgcgcggtcgaagcggcgggtgcgcaggtcgtgctgctcgaagccgtgccgacgctgatcgggtccgaggtcacgcacatgctgcgcgtgccgacgatcggcatcggcgcgggcgccgactgctcgggccaggtgctcgtgctgcacgacatgctcggcgtgttccccggcaagcggccgcgcttcgtgaaggatttcatgcagggcgagccgaacatccaggcggccgtcgaagcttacgtgcgcgcggtcaaggacggttcgttccccggccccgagcattcgttctga

SEQ ID NO: 100993 - protein, 271 aa, Burkholderia cepacia R18194
MTYLQESSRPAVTVPKLQAMRDAGEKIAMLTCYDASFSALLDRSGVDVLLIGDSLGNVLQGHTTTLPVSLDDIAYHTACVARAQPRALIMADLPFGTYGTPAEAFASSVKLMRAGAQMVKLEGGEWLAETIRFLVERAVPVCAHVGLTPQSVHAFGGFKVQGKTEAGAAQLLRDARAVEAAGAQVVLLEAVPTLIGSEVTHMLRVPTIGIGAGADCSGQVLVLHDMLGVFPGKRPRFVKDFMQGEPNIQAAVEAYVRAVKDGSFPGPEHSF

SEQ ID NO: 100994 - DNA, 858 bp, Burkholderia cepacia R18194
  CDS (1)..(858)
atgagcgctcatacccgcaccacccgcaagaccgtcaccgcgatccgttcgaccaagggcatcggcagcctcgtgtcgctgaccgcgtattccgcgccgatggcgaagctggtcgacgaagtggccgacgtgatcatcgtcggcgactccgtcggcatggtgctgtacgggatgcccgatacgctgcgcgtcacgctcgacatgatgattgcacacggtgcggccgtcgtgcgcggcgccgcgcaggcatgtgtcgtcgtcgacttgccgttctcgacgtaccaggaatcgcccgcccaggcctatcgctccgccgcgcgcctgctcgccgaaaccggcgcgcagggcgtgaagctcgaaggcggcaccgagatggccgacgcgatccgcttcctgaccgagcgcggcatcccggtgatggcacacgtcggcctcatgccgcagcaggccaacgcgacgggcggcttccgcgcgcaggggatggacccgcgttccgccgcgcaggtgttcgatgccgcatgctcggctgaacaggccggcgcgttcagcgtcgtcatcgaaggcacggccgaagcgctcgcgcgccatatcaccgaaacgctgacgatcccgacgatcggcatcggtgcatcgcccgcatgcgacgggcaggtgctcgtgaccgaggacatgatcggcgcattcgatgcatacacgccgcgcttcgtgaagcgttatgccgatgcgaacgcagtaatgcgcgatgcgatccgccagtacgcgcacgacgtgcggcagggtgtgtttccggaacccgcgcattgtttcgggtatggcaagccgctgcaactcgtgggtgcggctgacgctgctgcgtga

SEQ ID NO: 100995 - protein, 285 aa, Burkholderia cepacia R18194
MSAHTRTTRKTVTAIRSTKGIGSLVSLTAYSAPMAKLVDEVADVIIVGDSVGMVLYGMPDTLRVTLDMMIAHGAAVVRGAAQACVVVDLPFSTYQESPAQAYRSAARLLAETGAQGVKLEGGTEMADAIRFLTERGIPVMAHVGLMPQQANATGGFRAQGMDPRSAAQVFDAACSAEQAGAFSVVIEGTAEALARHITETLTIPTIGIGASPACDGQVLVTEDMIGAFDAYTPRFVKRYADANAVMRDAIRQYAHDVRQGVFPEPAHCFGYGKPLQLVGAADAAA

SEQ ID NO: 100996 - DNA, 810 bp, Bacillus cereus G9241
  CDS (1)..(810): transl_table=11
atgaaagagcaaggtgagccgattacaatgctaacggcgtatgattatccatctgctaagttagcggaagaagctaaagttgatatgattctagttggagattcacttgggatggttgtgctcggatacgattcaacggtacctgtaacagtagaggatatgattcatcatacaaaagctgtacgccgaggagcgaaagagacgtttattgtaactgatatgccgtttatgtcgtatcatgtgtcgcctcaagatacgatggtgaatgcacgccgcatcgttcaagagagtggtgctcatgcactgaaggtagaaggtgcaggggaagtgttatcaacgattcattacttgacgaatgcgggaattcctgtcgtggcacacttaggcttaactcctcaatctgtaggagtactaggtgggtataaagtacaaggaaaagatgctgaaagtgcaaaaaaattaatagaagatgcgaagagatgtgaggaagctggtgcgatagcgcttgtattagaatgtgtgccaatgcagttagcggaattgatttcgaagcaactaacaattccaacgattggaattggagcagggaaaaaagtagatgggcaagtactcgtttatcatgatcttatctcatacggtgtaaatcgtgttccgaaattcgtgaagcaatatacgtctgttcaagaggagattgtgcgagggatttcacaatacgttactgaagtaaagacaggacaatttccagaagaaatacattcattcacaatgaaagaggaagaatgcttagctttatacgggggaaaacagtaa

SEQ ID NO: 100997 - protein, 269 aa, Bacillus cereus G9241
MKEQGEPITMLTAYDYPSAKLAEEAKVDMILVGDSLGMVVLGYDSTVPVTVEDMIHHTKAVRRGAKETFIVTDMPFMSYHVSPQDTMVNARRIVQESGAHALKVEGAGEVLSTIHYLTNAGIPVVAHLGLTPQSVGVLGGYKVQGKDAESAKKLIEDAKRCEEAGAIALVLECVPMQLAELISKQLTIPTIGIGAGKKVDGQVLVYHDLISYGVNRVPKFVKQYTSVQEEIVRGISQYVTEVKTGQFPEEIHSFTMKEEECLALYGGKQ

SEQ ID NO: 100998 - DNA, 885 bp, Rubrivivax gelatinosus PM1
  CDS (1)..(885)
atgtccgatgccgccgctgccccgcccgagcgcaagaagcgcaccatcaccgagatccgcgactcgaagaagagcggcgagaagatggtctacacctcggtgccggactacacctcggccaagtgggccgagctggccggcgtcgacgtggccgtggtcggcgacagcctggcgatggtcgcgcacgggcacagcagcaccgtgccggcgacgatggacatgatggtgatgcacgcgcaggcggtgcggcgcggcgcgccgcgcaccttcacgctcggctgcatgccctaccagagctacaacacggtggaccgcgcgctgctcaacgccacccgcttcatgcaggacggcggctgcgacgcggtcaagccgcagggcggcagatcgcaggcgcacatcctgaaggcattggtcgactcgggcatcccgaccgcctcgcacatcgggctcacaccgcacaccatcgcgatgttcggcggcttcaagatccagggccgcaccgccgaggcggcgatgaagatcctggaggacgcgttcgcgatccaggacgccggctgcttcatgctggagttcgaggcggtgccggcgaagatcgcgacgctgatctcgaagcagctcgagatccccaccatcggcatcggtgccggggccggctgcgatggccagatcctgctgtcctacgacctgctgggcgtgttcaccgacttcaagcccaagttcacgaagcgctatgccaacctgaccgaggtggcggtgcagggcctgaaggcttacgtcgacgaggtgaagaccggccgcttccccgacgacgaccacagctatggcgtcgacgaccgcgagtacgagcagttcatgaacctggtggagaagcggcggcacgtgtga

SEQ ID NO: 100999 - protein, 294 aa, Rubrivivax gelatinosus PM1
MSDAAAAPPERKKRTITEIRDSKKSGEKMVYTSVPDYTSAKWAELAGVDVAVVGDSLAMVAHGHSSTVPATMDMMVMHAQAVRRGAPRTFTLGCMPYQSYNTVDRALLNATRFMQDGGCDAVKPQGGRSQAHILKALVDSGIPTASHIGLTPHTIAMFGGFKIQGRTAEAAMKILEDAFAIQDAGCFMLEFEAVPAKIATLISKQLEIPTIGIGAGAGCDGQILLSYDLLGVFTDFKPKFTKRYANLTEVAVQGLKAYVDEVKTGRFPDDDHSYGVDDREYEQFMNLVEKRRHV

SEQ ID NO: 101000 - DNA, 840 bp, Rubrivivax gelatinosus PM1
  CDS (1)..(840)
atgagcagccactcctcgcccgccgacaccccgagtgcccgcaagcccgtcacgctgcacacgctgcgcgagatgcacgcgcgcggcgagaagatcgccatgatcacggcctacgacgccagcttcgccgcgctggtggacacggccggcgtcgactgcatcctggtcggcgattcgctggggatggtgctgaagggccagtcgagcacgctgtcggtcacgatggagcagatcgggtaccacacgcgcagcacctcgcgcggcacgaaggcggccttcctgatcgccgacatgcccttcggcagctaccaggaaaacccggtgcaggcgctgcgcaatgccggcacattgatggcggccggtgcgcagatggtcaagctcgagggcggcggctggacgccggagaccgtgaacttcctggtcgagcgcggcgtgccggtgtgcgcccacctcggcctcacgccgcagagcgtgcatgcgctcggcggctaccgcatccagggcaaggacgaggccggcgccgccacgctgcgccgccacgccaaggcgctggccgacgccggcgcggcgatgatggtgctggagctgatgccctccagggtggcccgcgaggtgcaggccgacaacccggggctgatgaccatcggcatcggtgccggggccggcaccgccggccaggtgctggtgctgcacgacatgctgggcgtgacgcgcggcaggctgccacgcttcgtgcgcaacttcatggacagcgccacgtcgatcgaggacgcggtgcgtcgctacgtcgccgcggtcaaggacggcagcttccccgacgagaccctgcacgcctactga

SEQ ID NO: 101001 - protein, 279 aa, Rubrivivax gelatinosus PM1
MSSHSSPADTPSARKPVTLHTLREMHARGEKIAMITAYDASFAALVDTAGVDCILVGDSLGMVLKGQSSTLSVTMEQIGYHTRSTSRGTKAAFLIADMPFGSYQENPVQALRNAGTLMAAGAQMVKLEGGGWTPETVNFLVERGVPVCAHLGLTPQSVHALGGYRIQGKDEAGAATLRRHAKALADAGAAMMVLELMPSRVAREVQADNPGLMTIGIGAGAGTAGQVLVLHDMLGVTRGRLPRFVRNFMDSATSIEDAVRRYVAAVKDGSFPDETLHAY

SEQ ID NO: 101002 - DNA, 837 bp, Rhodospirillum rubrum
  CDS (1)..(837)
atgagtgtcgtccagcctgccggccgacgtctgaccgttcgcgacatcgccagtcgcaaatcccccgccgccgagccggtggtctgccttaccgcctatacggcgccgatggcccgtctgctcgacccccatgtcgacctgctgctggttggcgattcccttggcatggtcatctatggcttgccgaccacccatggcgtgaccgtcgagatgatgatcgcccatggtcaggccgtggtgcggggctcgtcccatgccctggtggtggtcgatatgccctttggtagctatcaggaaagcccggcccaggccttccgcaacgccgcgcgcatcctcagcgagaccggcgccgccgccgtcaagcttgaaggcggccgcgagatggccgaaaccgtcgccttcctggtgcagcgcggcgtgccggtgatgggccatgtcggtctcaagccgcagatggtccatgcgatgggcgggttccgcgcccagggccgcgacgaggccgaggccgaggcggtggtcgccgaaacccgggccatcgccgaggccggggccttctcgatcgtcgtcgaaggcacctttgagcaggtggcggcgcgggcgactcgcgaggtttccgtgccgacgatcggcatcggcgcctcggccgattgcgatggccaggttctggtgatcgacgacgcgctcggtttgttcaccgatttcacccccaaattcgtcaagcgctatgccgatctggcgagcacggtttcggcggccgccgaagcctatgccgccgatgtcagggcccggcgctttcccgcccccgagcattgctttggcatccgcaaggtcggctga

SEQ ID NO: 101003 - protein, 278 aa, Rhodospirillum rubrum
MSVVQPAGRRLTVRDIASRKSPAAEPVVCLTAYTAPMARLLDPHVDLLLVGDSLGMVIYGLPTTHGVTVEMMIAHGQAVVRGSSHALVVVDMPFGSYQESPAQAFRNAARILSETGAAAVKLEGGREMAETVAFLVQRGVPVMGHVGLKPQMVHAMGGFRAQGRDEAEAEAVVAETRAIAEAGAFSIVVEGTFEQVAARATREVSVPTIGIGASADCDGQVLVIDDALGLFTDFTPKFVKRYADLASTVSAAAEAYAADVRARRFPAPEHCFGIRKVG

SEQ ID NO: 101004 - DNA, 816 bp, Burkholderia fungorum LB400
  CDS (1)..(816)
atgacctatttgcaggaagcgagccggaacgccgtcaccgtgccgaaactgcaggcaatgcgcgacgccggcgaaaaaatcgccatgctcacctgttacgacgcgagcttcgccgcgctgctggatcgcgcgggtgtcgacgtgctgttgatcggcgactcgctcggcaacgtgctgcaaggccagaccactaccctgcccgtgtcgcttgccgacatcgcttatcacacggctagtgtagcgcgcgcgcggcccgcggcgctgatcgtggccgacttgccgttcggcacttacggcacgccggaagatgctttcagaagctcggtcgagttgatgcgggccggcgcgcagatggtgaagctcgaaggcggcgaatggctcgcggacacggtgcgcttcctggtggagcgctcgattcccgtgtgcgcgcacgtcggcctgacgccgcaatccgtgcacgcattcggcggcttcaaggtgcaaggcaagaccgaggcgggcgcgacgcagttgctgcgcgactcgctcgccgtgcaggcggccggcgcgcaactgatcgtgatggaagcgattccgacgctgctcgccagcgacgccacgaagcaattgcgcattccgacgatcggcattggcgcgggtctggattgctcgggtcaggtgctggtgctgcacgacatgctaggcattttccccggcaaacggccgcgcttcgtcaaggatttcatgcaggggcagccgagtattctggcggccgtggaagcgtatgtcgccgcagtgaaggacggttcgtttcctggaccggagcacacgttctga

SEQ ID NO: 101005 - protein, 271 aa, Burkholderia fungorum LB400
MTYLQEASRNAVTVPKLQAMRDAGEKIAMLTCYDASFAALLDRAGVDVLLIGDSLGNVLQGQTTTLPVSLADIAYHTASVARARPAALIVADLPFGTYGTPEDAFRSSVELMRAGAQMVKLEGGEWLADTVRFLVERSIPVCAHVGLTPQSVHAFGGFKVQGKTEAGATQLLRDSLAVQAAGAQLIVMEAIPTLLASDATKQLRIPTIGIGAGLDCSGQVLVLHDMLGIFPGKRPRFVKDFMQGQPSILAAVEAYVAAVKDGSFPGPEHTF

SEQ ID NO: 101006 - DNA, 774 bp, Thermobifida fusca
  CDS (1)..(774)
ttggccgcagcgaaagagcgcggcgaacgctggccgatgctcaccgcctatgacgcgctgactgcccggattttcgacgaggcgggcattccggtgctgctggtgggtgactctgctgcgatggtggtgttcggctacgactccacgatcccggtcacccttgacgacatgatcccgttgacggccgcggtgtcgcgggcgacgaagcgggcgctggtggtggctgacctcccgttcggctcctaccaggccggtccggagcaggctttggagtcggcggcgcggctgatgaaggagggcggcgcccaggcggtcaagctggagggcggccaccgggtcatcgcccaggtggaggctttggtgtcggcgggtatcccggtgatgggccacatcgggttgacgccgcagtcggtgaatgtgctgggcggctaccgcgtgcagggccgcagcgaggaggcggccgaggcgctgctgtctgatgcgaaggagcttgagcgggcgggcgtgttctcggtggtgctggagtgcgtgcctgcgcgggtgggcgcggagatcacccggcagttgacggtgccgacgatcgggatcggcgcgggtccggacacggacgcccaggtgctggtgtggcaggacatggccgggttgtcgccgcgggtcgccaagttcgtcaagtcgtacgcgaatctggcggagcagttgcgggacgctgccacgagtttcgcggaggaagtggtggcgggcacgttcccggacgagcagcactcctacgcctag

SEQ ID NO: 101007 - protein, 257 aa, Thermobifida fusca
MAAAKERGERWPMLTAYDALTARIFDEAGIPVLLVGDSAAMVVFGYDSTIPVTLDDMIPLTAAVSRATKRALVVADLPFGSYQAGPEQALESAARLMKEGGAQAVKLEGGHRVIAQVEALVSAGIPVMGHIGLTPQSVNVLGGYRVQGRSEEAAEALLSDAKELERAGVFSVVLECVPARVGAEITRQLTVPTIGIGAGPDTDAQVLVWQDMAGLSPRVAKFVKSYANLAEQLRDAATSFAEEVVAGTFPDEQHSYA

SEQ ID NO: 101008 - DNA, 870 bp, Novosphingobium aromaticivorans DSM 12444
  CDS (1)..(870)
atgtccacgaccttccagctcgatacctcgacaagccgtgccaaccccaccccggcaccgatgaagcgcctgacgatccccgcgatccgccagcgcaagaaggacggcgtgacggcacaaccggtcgtgatgctcaccgcctataccgcccgtcaggcgcaattgctcgacgcccattgcgatctgctgctggtcggggattcccttggccaggtgatctatggcctgccttccagcgttccggtcacgctcgacatgatggcagcccatggcgcggcggtcgtgcgtggatcgtatcacgcggcggtcgtggtcgacatgccgttcggcagctacgaagcatcgccgcagcaggccttcgaaagcgcctcgcggctgctgaaggaaaccggttgcgcggcagtgaagctcgaagggggcgaggccatggccgaaacggtcgcgttcctcaccaaccggggcatcccggtcatgggccacgtcggcctcaccccgcaggcggtcaatgtgctgggcggctacaacgcgcgcggccgcagcgaggccgaagcggccaagatcgtcggagacgcacggtcgcttgccgatgccggtgccttcgccatcgtgatcgaaggcgtggtcgagcccatcgcgattgccatcacccaggccgtggcgtgcccgacaatcggcatcggcgcctcggctcaatgcgacgggcaggttctggtcaccgaagacatgctcggcatgttcgagcgcgttccgcggttcgtgaagatctacgaggatctcgccgggaccatctccggggctgcggcgcgttatgccgacgaagtgcgcgcgcgcaccttccccggtattgaacagacgtaccagcccaagtaa

SEQ ID NO: 101009 - protein, 289 aa, Novosphingobium aromaticivorans DSM 12444
MSTTFQLDTSTSRANPTPAPMKRLTIPAIRQRKKDGVTAQPVVMLTAYTARQAQLLDAHCDLLLVGDSLGQVIYGLPSSVPVTLDMMAAHGAAVVRGSYHAAVVVDMPFGSYEASPQQAFESASRLLKETGCAAVKLEGGEAMAETVAFLTNRGIPVMGHVGLTPQAVNVLGGYNARGRSEAEAAKIVGDARSLADAGAFAIVIEGVVEPIAIAITQAVACPTIGIGASAQCDGQVLVTEDMLGMFERVPRFVKIYEDLAGTISGAAARYADEVRARTFPGIEQTYQPK

SEQ ID NO: 101010 - DNA, 819 bp, Cytophaga hutchinsonii
  CDS (1)..(819)
atgtcaactgcaaaaagtgatattaaaaaagtaacaacacaccagcttcaggaaatgaagaaccgtggtgaaaaaatatccatgctcacagcctatgattattcgatggcaaaaattttagatgctgccggagttgatgttattttagttggtgactctgcttcaaatgtaatggcaggccatgaaacaacattgccgataacgcttgatcaaatgatctatcacgcatcttctgtgattcgtgctattaacagggcgttagttgttgttgatcttccttttggttcctatcagggaaattcatcagaagccttacgcagtgccatacgcattatgaaggagtctggtgcgcatgctgtgaaaatggaaggcggaattgaaattaaagaatctgtactgtgtatcattagtgctggtatacctgtgatggggcacttaggcttaatgcctcaatctatttataagtttggcacctatgtggtacgtgcacgtgaagaagaagaagcaaacaaacttattgctgatgcaaaaattttagaagaaagcggctgcttcggtttagtacttgaaaaaatacctgcctctctttcaaaaactgttacacatcaattacagattcctaccataggcattggtgccggccctgacgtagatggacaggtattggtcacacatgatctgttgggaattaataatgaattccacccgagattcctgcgtacctatgcgaacctgcaggccacaatcagcacggctgttacatcgtatattgatgatgtaaagtctaagaactttccgaacgaaaacgaatgttactag

SEQ ID NO: 101011 - protein, 272 aa, Cytophaga hutchinsonii
MSTAKSDIKKVTTHQLQEMKNRGEKISMLTAYDYSMAKILDAAGVDVILVGDSASNVMAGHETTLPITLDQMIYHASSVIRAINRALVVVDLPFGSYQGNSSEALRSAIRIMKESGAHAVKMEGGIEIKESVLCIISAGIPVMGHLGLMPQSIYKFGTYVVRAREEEEANKLIADAKILEESGCFGLVLEKIPASLSKTVTHQLQIPTIGIGAGPDVDGQVLVTHDLLGINNEFHPRFLRTYANLQATISTAVTSYIDDVKSKNFPNENECY

SEQ ID NO: 101012 - DNA, 756 bp, Microbulbifer degradans 2-40
  CDS (1)..(756)
atgaaagcggacaaagaaaaattcatcaccgttgcgctatacgatgcgccaatggcagccatggcacaaaagtgcggcgtagaagttgtactaattggcgatagcctaggtatgacggtactaggttacgacagcaccgtgcccgtcaccatggaacaaatgatctaccacatagaagcggtagcacgtggtaacagccgctcacttattattggcgacctgccatttatgacctatgccacggtagagcaaaccatgattaacgccacccgcgtcatgcaggcgggcgcgcatatggtaaaaatggaaggcggcgcttggctggtcgattcggtacgtatgctgtccgagcgcggcattcccgtttgcgcccaccttggccttaccccgcaatcggtaaataaatttggcggcttccgcgtgcaggggcgctccgaagagcaaggcgaacaaataatcgccgatgccctcgcgctagaagaagcgggtgcagacttactggtattggaatgtatacctgcggaactgggtgcaagagtgactcaagcgcttagcatccccaccataggtattggcgctggtattggcacagacgcacaggtactggtaatcaacgatattcttgggcttaccgagttcccgcccaaattttctaaaaacttcctactagaagccaaagatatacccggcgcactgcaaaagtacgcagcagacgttaaatccggtgtattccctggcccagagcagcagttttaa

SEQ ID NO: 101013 - protein, 251 aa, Microbulbifer degradans 2-40
MKADKEKFITVALYDAPMAAMAQKCGVEVVLIGDSLGMTVLGYDSTVPVTMEQMIYHIEAVARGNSRSLIIGDLPFMTYATVEQTMINATRVMQAGAHMVKMEGGAWLVDSVRMLSERGIPVCAHLGLTPQSVNKFGGFRVQGRSEEQGEQIIADALALEEAGADLLVLECIPAELGARVTQALSIPTIGIGAGIGTDAQVLVINDILGLTEFPPKFSKNFLLEAKDIPGALQKYAADVKSGVFPGPEQQF

SEQ ID NO: 101014 - DNA, 846 bp, Chloroflexus aurantiacus
  CDS (1)..(846)
atgcgcataaccattcgcgatattcagcagatgcgcgatcgcggcgagcgaatcccaatggtcaccgcgtatgactatacctcggctcagattgctgatcgcgccggaattccattgattctggtaggggattcgttaggcatggtcgtgctgggctacaattctaccgtaccggtgacgcttgacgacatgattcaccatacgcgcgccgtcgtgcgtggtacgcaaaaagccctggttatcggtgatctcccattccttacctacacatcaccagagcaggcgatgcagagtgccggacggatgttgcaggaagccggtgcgcaggccgtcaagctggaaggcggtgtgcatatcgctcctaccattgcccgcctggttcaggccgggattccggtgatggggcacattggctttacgccacaggcggttaaccagattgggttgcgcgtgcaagggcgacgggctgctgaggcgcaacgactgctcgccgatgcgctggccgtgcaagaagccggtgccttcgcgattgtgctggagctggtaccggcagagctggcccaggccattacggaacggttgcggattccgactatcgggatcggtgccggagccggctgtagcggtcaggtgcaggtctggcacgatatgctcggtctgtacagcgactttttaccccgtcacgcaaagcggtacgccgatctggcaacaattattgccgaggcgctgagtcagtacgccagtgatgtgcgtaatggtacgttccctggccctgaacatagcagtcggatggatccggcagagctagccgcagcgctggggagtcaagatcaggcgacggaatag

SEQ ID NO: 101015 - protein, 281 aa, Chloroflexus aurantiacus
MRITIRDIQQMRDRGERIPMVTAYDYTSAQIADRAGIPLILVGDSLGMVVLGYNSTVPVTLDDMIHHTRAVVRGTQKALVIGDLPFLTYTSPEQAMQSAGRMLQEAGAQAVKLEGGVHIAPTIARLVQAGIPVMGHIGFTPQAVNQIGLRVQGRRAAEAQRLLADALAVQEAGAFAIVLELVPAELAQAITERLRIPTIGIGAGAGCSGQVQVWHDMLGLYSDFLPRHAKRYADLATIIAEALSQYASDVRNGTFPGPEHSSRMDPAELAAALGSQDQATE

SEQ ID NO: 101016 - DNA, 813 bp, Campylobacter coli RM2228
  CDS (1)..(813): transl_table=11
atgattagttttttggaaaaaaaggccaaaaatgaaaaaataaccatggtaagtgcgtatgattatcatagtgcaagaattttagacaatagcgatatagatattatattggttggagattcattagccatgacggtacttggtatgcaagatactttaagtgttactatggatgaaatgttgatttttaccaaagctgtttctcgcggagctaaaaagtctttcgtacttgctgatatgccttttatgtcttatcaaagttcagatcgtgacgctatcttaaatgcctcaagatttatcaaagaaagccacgcaaatggggtaaaagtggaagggggtatagaaatcgcaagcaagattaaattgatttcccaatcaggaatacccgtcgttgctcacctaggtttaaccccacaagctgtaaatatgctaggtggctatagggttcaaggtaaagatttacaatcggcccaaaaaattatagatgatgcaaaagctgtgcaagatgcgggtgcttgtatgttggttttagaatgtgtgcctgtaaaactagcacaaaaaataagctctattttagaaattccaacaatcggcataggttcaggcaaatactgcgatggacaagttttagtttatcacgatcttttgggtttaaataaagattttaaagcaaaatttgtaaagcattttgataaaattgatcctcaagtaggagttgaaaaatatagagatgaagttaaaagcggtatttttccttcccaagagcacagctttgattatttagatgatgaattattagataaattatactaa

SEQ ID NO: 101017 - protein, 270 aa, Campylobacter coli RM2228
MISFLEKKAKNEKITMVSAYDYHSARILDNSDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSQEHSFDYLDDELLDKLY

SEQ ID NO: 101018 - DNA, 825 bp, Campylobacter upsaliensis RM3195
  CDS (1)..(825): transl_table=11
atgagaaaaagcattattaattttcaaaaacaaaaagaaaatcaagataaaatcaccatggtagcagcttacgattatcctagtgctaaggctttagatgaagctggggtggatgtgattttagtcggtgattctgtggctatgatgcttttaggacacgaagatacattaagtataagtgtagaagaaatgctcgtttttacaaaagctgtttctaaagcttcgcaaaatgcctttgttttagccgatatgccttttatgtcttatcaaagctcagtttatgacgccttacaaaatgccgctaaattgatgaaggaaggtcgtgcaaatggcgtgaaattagaaggagggagagaatttagtgcgtgcattaaagccttaaatcgtgcctccatccctgtcatcgctcacataggactaaccccacaaagtatcaatactatgggaggatatagggtgcaaggcaaaagcaaggaagccgctgagaaactcatagacgatgccaaagccgttcaagatgcgggtgctagtatggttttaatggaatgtgtaccaagcaaattagcgaaaaaaatcactcaaatcctagaagtgcctaccataggcataggagcaggaaagcactgcgatgggcaggttttggtatatcacgattttttagggattaatcaaagctttaaacccaaatttgtcaaacaatttgccaacctaaatccaaatgaaggtataaaagcctacattaatgccgttaaaagcggagaattcccaagtgaagaatatagcttttctttagaaaatgacgaatggattgaagaattatattaa

SEQ ID NO: 101019 - protein, 274 aa, Campylobacter upsaliensis RM3195
MRKSIINFQKQKENQDKITMVAAYDYPSAKALDEAGVDVILVGDSVAMMLLGHEDTLSISVEEMLVFTKAVSKASQNAFVLADMPFMSYQSSVYDALQNAAKLMKEGRANGVKLEGGREFSACIKALNRASIPVIAHIGLTPQSINTMGGYRVQGKSKEAAEKLIDDAKAVQDAGASMVLMECVPSKLAKKITQILEVPTIGIGAGKHCDGQVLVYHDFLGINQSFKPKFVKQFANLNPNEGIKAYINAVKSGEFPSEEYSFSLENDEWIEELY

SEQ ID NO: 101020 - DNA, 870 bp, Erythrobacter litoralis HTCC2594
  CDS (1)..(870): transl_table=11
atgtccacgaccttcaagctcgatacgagcacgagccgcgccaatcccacccccgctccgatgaagcggctgaccgtgccgaaaatccgcgcgcggaagaaagacggcaagaccgaagagccgctggtcatgctgacggcctacaccgcgcggcaggcgcagctgctcgatgcccattgcgacctgctgctggttggggattcgctggggcaggtgatctatggtctgccctccaccattcccgtcaccctgcggatgatggcggaccacgcagcggcggtcgtacgcgggagctatcactcggtggttgtggtcgacatgcctttcggatcctacgagcaatcgccgcagcaggccttcgagagcgccagcttcctgctcaaggaaagcggcgcagcggcggtcaagctcgaaggcggcgaagcgatggcggagacggtcgcatttctcaaccagcgaggcatcccggtgatgggccatgtcgggctgaccccgcaagcggtcaatgtcctcggcggctatgccgcgcgcggccgcaatgatgcggaggccgacaagatcgtcaccgacgccaaggcactcgacgatgccggggcctttgccatcgtcatcgaaggcgtgctggagccgatcgccgtcgccgccaccgaggccgttcgcgcgccgacgatcgggatcggtgcttcggcgcagtgcgatgggcaggtgctggtgacggaggacatgctgggcatgttcgaacgcgtcccgcgctttgtgaagaagtatggcgatatcgccgaaaccatcgaagcgacggccaagacctatgccgaggaagtccgcgcgagaagcttccccggaccagaacagctttaccagcccaaatag

SEQ ID NO: 101021 - protein, 289 aa, Erythrobacter litoralis HTCC2594
MSTTFKLDTSTSRANPTPAPMKRLTVPKIRARKKDGKTEEPLVMLTAYTARQAQLLDAHCDLLLVGDSLGQVIYGLPSTIPVTLRMMADHAAAVVRGSYHSVVVVDMPFGSYEQSPQQAFESASFLLKESGAAAVKLEGGEAMAETVAFLNQRGIPVMGHVGLTPQAVNVLGGYAARGRNDAEADKIVTDAKALDDAGAFAIVIEGVLEPIAVAATEAVRAPTIGIGASAQCDGQVLVTEDMLGMFERVPRFVKKYGDIAETIEATAKTYAEEVRARSFPGPEQLYQPK

SEQ ID NO: 101022 - DNA, 861 bp, Brevibacterium linens BL2
  CDS (1)..(861)
atgactccgccctatgggagcggccccgcatccactgctgctgccggtgcggctgcggcaccacctcggcgggtgcggactctggacctcatcaaagccaagacacagggccggcgctgggcgatgctgaccagctacgaccagtacacggccgcactgttcgagcaggccggcgtcgaggtgctgctggtcggcgattccgcggcgaacaatgtctacggccacgagaccacactgcccgtcaccgtcgatgagctcatcccgctggcgcgagcggtctccagtgccacctctcgggcgctgatcgtcgcagaccttcccttcggcagctatgagatctccgatgagcaggcggtcgcgacggccgtgcgcttcatgaaggaagccggcgtccacgcggtcaagctcgaagggggagtggccgtggcctcgaggatcaaggcgatcacgacggcaggcattccggtgatggcccacatcgggttcacgccccaggccgagcacaacctcggcgggtacaaggttcagggtcgtggggatgccggtgatgcgctgctggccgatgctcgtgccgtcgccgaggcgggggcattctctgtggtcatggagatggttccagccgggttggctgggcaggtgacggcggagatgacgatcccgactgtggggatcggtgccggtgccgactgcgacgcccaggtgctcgtctggcaggacatggccggtctgcggaccggcaaagcgccacggttcgtcaaacggtatgccgacctgcattcggtgctcagcgacgctgtcggtcgctacgtcgatgaggttaagagcggcgcattccccgagccggagcggagtttcgagtga

SEQ ID NO: 101023 - protein, 286 aa, Brevibacterium linens BL2
MTPPYGSGPASTAAAGAAAAPPRRVRTLDLIKAKTQGRRWAMLTSYDQYTAALFEQAGVEVLLVGDSAANNVYGHETTLPVTVDELIPLARAVSSATSRALIVADLPFGSYEISDEQAVATAVRFMKEAGVHAVKLEGGVAVASRIKAITTAGIPVMAHIGFTPQAEHNLGGYKVQGRGDAGDALLADARAVAEAGAFSVVMEMVPAGLAGQVTAEMTIPTVGIGAGADCDAQVLVWQDMAGLRTGKAPRFVKRYADLHSVLSDAVGRYVDEVKSGAFPEPERSFE

SEQ ID NO: 101024 - DNA, 813 bp, Bacillus anthracis str. A2012
  CDS (1)..(813)
atgaaagagcaaggtgagccgattacaatgctaacggcgtatgattatccttctgctaaattagcagaagaagctgaagttgatatgattctagttggagattctctcgggatggttgtgctcggctacgattcaacagtaccagtaacagtagaggatatgattcatcatacaaaagctgtacgccgcggagcgaaagagacgtttattgtaactgatatgccatttatgtcgtatcatgtgtcactgcaagatacgatggtgaatgcacgccgcatcgttcaagagagtggtgcccatgcactgaaggtagaaggtgcgggagaagtgatatcgactattcactatttgacgaatgcgggaattcctgtcgtggcgcacttaggtttaactcctcaatctgtaggagtgctaggtggatataaagtacaaggaaaagacgctgaaagtgcaaaaaaattaatagaagatgcgaagaaatgtgaggaagctggtgcaattgcactcgtgttagagtgtgtgccaatgcagttagcagaacttatttcagagcaattaacaattccaacaatcgggattggcgcaggacaaaaagtagatgggcaagtgcttgtttatcatgatcttatctcatatggggtaaatcgtgttccgaaatttgtgaagcaatatacgtccgttcaagaagaaattgtacgcgggatttctcaatatgttgctgaagtaaagacaaggcaatttcctgaagaaaaacattcgttcacaatgaaagaggaagaatgcttagcgttatacggaggaaaacaatcatga

SEQ ID NO: 101025 - protein, 270 aa, Bacillus anthracis str. A2012
MKEQGEPITMLTAYDYPSAKLAEEAEVDMILVGDSLGMVVLGYDSTVPVTVEDMIHHTKAVRRGAKETFIVTDMPFMSYHVSLQDTMVNARRIVQESGAHALKVEGAGEVISTIHYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVAEVKTRQFPEEKHSFTMKEEECLALYGGKQS

SEQ ID NO: 101026 - DNA, 822 bp, Deinococcus geothermalis DSM 11300
  CDS (1)..(822): transl_table=11
atgaaacgcagtgtccctgacctcatgaacgcgtccgaaccgctggtgatggtcaccgcctacgactatccgggcgcgcggcatgccgaggcggcgggtgtggacctcattctggtgggtgacagcctggggaacgtggtgctgggctacgactccacggcgcccgtgaccctagacgacatgattcaccacgcccgagcggtgcgccgcggcgcgccaaacacgttcctggtcgtggatctgcccttcggcacctatcacaccggggtcaccgatgcgatgcggaatgcggtgcgggtgattcagcagaccggcgcagacgccgtcaaactggaaggtgccacacccgaggtgctggacgtcgtgggcgtgcttgcgcgcaacggcattcccgtcatgggccacgtgggcctgatgccgcagacggccaccgcccagggtggtctaaaggtccagggccgggacgaggcgagcgcccgccgcaccctggaaggtgcgttggccctcgaagccgcgggagcattcagcgtggtgctggaagcgattccggcccgcctggcccggctgattaccgaacggctgcatgtgcccaccatcggtattggcgcgggtgtgcattgccgggggcaggtgctcgtctaccacgacctgctgggtctctacgagggcgatgaaaagaagctcgccaagcggtacgccgagctgggcaaggaggcgcgcgaggccatcgccgcttacgcccgtgaggtccgtgcccgcgagtttccgaccaaggaccagagcttcgtgatgaaggacgacgtgctggggaagctgtattga

SEQ ID NO: 101027 - protein, 273 aa, Deinococcus geothermalis DSM 11300
MKRSVPDLMNASEPLVMVTAYDYPGARHAEAAGVDLILVGDSLGNVVLGYDSTAPVTLDDMIHHARAVRRGAPNTFLVVDLPFGTYHTGVTDAMRNAVRVIQQTGADAVKLEGATPEVLDVVGVLARNGIPVMGHVGLMPQTATAQGGLKVQGRDEASARRTLEGALALEAAGAFSVVLEAIPARLARLITERLHVPTIGIGAGVHCRGQVLVYHDLLGLYEGDEKKLAKRYAELGKEAREAIAAYAREVRAREFPTKDQSFVMKDDVLGKLY

SEQ ID NO: 101028 - DNA, 918 bp, Anaeromyxobacter dehalogenans 2CP-C
  CDS (1)..(918): transl_table=11
atgtcgtcccatcccccgccacggaagcacgtcaacatccacgagctgcgccggatgaaggaagccggcgagcgcatcgccatggtcaccgcctacgacgcgaccgccgcgcggctggtcgccgccgccggggtggacgcggtgctggtgggcgactcgctgggcatggcggtgcagggccacgagtccacgctgccggtcacgctcgaccagatggtctaccactcggcgatggtccgccgcgggctcgcccgcggcgacggccgggcccacctcgtcgccgacatgagcttcggcagctaccaggccagcgccgacgaggcggtgaaggccgccatgcggctggtggcggagggcggcgccgaggccgtgaagctcgagggcggcgccgagttcggcgacgtgatccgccgcatcgtgcgcgccggcgtgccggtgatgggccacatcggcctgacgccgcagtcggtccacaagatgggcggctacgtggtgcaggggaaggactcggagaaggcgcagcagatcctgcgcgacgcccgggcgctcgaggcggccggctgctacgcgctggtgctggagtgcatcccctccgagctggcccgcatcgtcacctcgcagctgcgcatcccgaccatcggcatcggcgccggcccgcactgcgacggccaggtgctggtgctgaacgacctgctcggcctcgacgcctccttcacgccgaagttcgtgaagcgcttcggcgagctgggcgccgccgtcgagggcgcggtgggcgcatacgtcggcgaggtgaaggcccgcgcgttccccgacgacgcgcacagcttccactccgcctcggtccgcctcgtcccggtggagcgccacgccgaggaggcggaggaagagccgccggacgccatcggcgcccccatctag

SEQ ID NO: 101029 - protein, 305 aa, Anaeromyxobacter dehalogenans 2CP-C
MSSHPPPRKHVNIHELRRMKEAGERIAMVTAYDATAARLVAAAGVDAVLVGDSLGMAVQGHESTLPVTLDQMVYHSAMVRRGLARGDGRAHLVADMSFGSYQASADEAVKAAMRLVAEGGAEAVKLEGGAEFGDVIRRIVRAGVPVMGHIGLTPQSVHKMGGYVVQGKDSEKAQQILRDARALEAAGCYALVLECIPSELARIVTSQLRIPTIGIGAGPHCDGQVLVLNDLLGLDASFTPKFVKRFGELGAAVEGAVGAYVGEVKARAFPDDAHSFHSASVRLVPVERHAEEAEEEPPDAIGAPI

SEQ ID NO: 101030 - DNA, 906 bp, Arthrobacter sp. FB24
  CDS (1)..(906): transl_table=11
atggccacaagcaacagttccgattccagcatgtccgctgaagtacctgctccctacggcaacgggcccgccaatgcgcccgcaacgccgtcggacaccgccaaaaagcccgtggcacgaatccggacccaccacctgcagcaggccaaagacaaaggtgaacactttgccatgctgacagcttacgaacagtacacggcagagatcttcgacgaagcgggcatcgaggtgctcctcgtgggcgactccgcgtcgaacaacgtcttcggtaacgaaaccagccttcccgtcaccgtggacgagctccttccgctgtgccgggccgtggcgcggtcggccaaacgggcgcttgtggtcgcggaccttccgttcggaagctatgaggtttcagccgagcaggccgtggccaccggagtccgcttcctgaaggaaggactcgcccatgccgtgaagattgaaggcggcaagttctacgctgacaccgtccgggccatggtccaggccggcattccggtgatggcgcacatcggcttcaccccgcagagcgagcattccctgggcggctaccgggtccagggccggggcgatgatgcgcagaggctgatcgatgacgcggtcgcactcgccgaggccggcgccttcagcgtcctgatggaaatggttccggccgccacggctgcggccgttgacgccgccattgcagttcccaccgtgggcatcggcgcgggtaacaccacaaccggccaggtcctggtgtggcaggacatggcgggactacgcggcggcaaaatggccaaattcgtcaaacagtatgctgacctgcgaacgtcgctgagcaacgcggccaaggcctacggtgacgacgtccggacgggccagttccccggccccgagcattcgttctag

SEQ ID NO: 101031 - protein, 301 aa, Arthrobacter sp. FB24
MATSNSSDSSMSAEVPAPYGNGPANAPATPSDTAKKPVARIRTHHLQQAKDKGEHFAMLTAYEQYTAEIFDEAGIEVLLVGDSASNNVFGNETSLPVTVDELLPLCRAVARSAKRALVVADLPFGSYEVSAEQAVATGVRFLKEGLAHAVKIEGGKFYADTVRAMVQAGIPVMAHIGFTPQSEHSLGGYRVQGRGDDAQRLIDDAVALAEAGAFSVLMEMVPAATAAAVDAAIAVPTVGIGAGNTTTGQVLVWQDMAGLRGGKMAKFVKQYADLRTSLSNAAKAYGDDVRTGQFPGPEHSF

SEQ ID NO: 101032 - DNA, 837 bp, Azotobacter vinelandii AvOP
  CDS (1)..(837): transl_table=11
atgagtgatcggacaccgccaccctattcgccaacccagcccaaggcacgtgtacgcatcccgtacttgaaagagctgaaggctcaaggccggaagtgggcgatgctgaccgcctacgacatgtacaccgcggcgatctttgaagaagcgggcattcccgtactgctggtgggtgactcggcctcgaacaatgtgtacggcaacgaatccacgctgacggtgaccgtcgacgagttgattcccttggtgcgtgccgtcgccaaggcaacccatagaccactggtcattgcggatctccccttcggttcctaccaggcttcgccggagcagtgcttccacaccgccgttcgcttcatgaaggaggccggtgcccacgctgtcaaactggaaggtggaatcgagatgctgccccaggtacggaagctcgcgacctcggggattcccgtcatggcgcatatcggcttcacccctcaatacgagcaccagctcggcggctatcgcattcaggggcggggtgacgaggcgcagcgcttgatcgacgccgccctggccctcgaagcggctggggccttcgccctgctgatcgagatggttccgggcgacgtcgccgcggccatcagccgagccgtttccatacccaccgttggaatcggagcgggcaatcaatgcgatgcccaggttctcgtctggcaggacatggccggcctgcgcaccgggcgcctgccccgcttcgtcaagcggtacgccgatatgcgcgcggtgctggccgctgctgcacgggattttgccgccgatgtggaggccggcgcattccctggccaagagcacacgttctga

SEQ ID NO: 101033 - protein, 278 aa, Azotobacter vinelandii AvOP
MSDRTPPPYSPTQPKARVRIPYLKELKAQGRKWAMLTAYDMYTAAIFEEAGIPVLLVGDSASNNVYGNESTLTVTVDELIPLVRAVAKATHRPLVIADLPFGSYQASPEQCFHTAVRFMKEAGAHAVKLEGGIEMLPQVRKLATSGIPVMAHIGFTPQYEHQLGGYRIQGRGDEAQRLIDAALALEAAGAFALLIEMVPGDVAAAISRAVSIPTVGIGAGNQCDAQVLVWQDMAGLRTGRLPRFVKRYADMRAVLAAAARDFAADVEAGAFPGQEHTF

SEQ ID NO: 101034 - DNA, 801 bp, Azotobacter vinelandii AvOP
  CDS (1)..(801): transl_table=11
atgcccgacgtaaccctgaccactctgcaaggactcaagcagcgcggcgaaaagatcgtcatgctgacctgctatgacgccaccttcgcccagaccgccagccaggcaggcatcgaggtgctgctggtcggcgactccctcggcatggttctgcagggccacgacagcaccctgcccaccagcgtggccgagatggcctatcacaccacctgcgtcaggcgcggcaaccgcggcgcgctgatcgtcaccgatctgccgttcatgtcctatgcctcgctggaccaggctctggagagcagcgcccaggtcatgcgcgccggtgcccacatggtcaagctggagggcggcgcctggctgtgcgaaaccgtgacgcgcctggccgagaacggcatcccggcctgcgtgcatctgggcctgactccgcaatcggtgaacctgttcggcggctacaaggtgcagggccgcgacgaagggcgggcgcgccagttgcgtgccgatgccgaagccctggagcgggccggggcggccatgctgctgctggaatgcgtgcccagcccgctggcggaacagatcacccgtgcggcgggcgtgccggtcataggcatcggcgccggcgccgccaccgatggccaggtcctggtcatgcacgacatgctcgggctgtccctgaccgggcgcacgccgaagttcgtgaaagacttcatggccggccaggaaaacatccaggcggccttcgccgcgtacacgcatgcggtcaagcaaggcgaattccccacagccgaacatggattttcagcatga

SEQ ID NO: 101035 - protein, 266 aa, Azotobacter vinelandii AvOP
MPDVTLTTLQGLKQRGEKIVMLTCYDATFAQTASQAGIEVLLVGDSLGMVLQGHDSTLPTSVAEMAYHTTCVRRGNRGALIVTDLPFMSYASLDQALESSAQVMRAGAHMVKLEGGAWLCETVTRLAENGIPACVHLGLTPQSVNLFGGYKVQGRDEGRARQLRADAEALERAGAAMLLLECVPSPLAEQITRAAGVPVIGIGAGAATDGQVLVMHDMLGLSLTGRTPKFVKDFMAGQENIQAAFAAYTHAVKQGEFPTAEHGFSA

SEQ ID NO: 101036 - DNA, 1203 bp, Burkholderia vietnamiensis G4
  CDS (1)..(1203): transl_table=11
atggcagctgtaccgcgcgatcgccgcgcacgtcgacgtaccgcaggcgcccgcgcccgatctggtcgtctatctgcaggcgagccccgaggtgctgttctcgcgcatccagaagcgcggcctgccgatggagctgcagatcagcgacgcgtacctgcgcgcgctggtcgacgcctacaacgaattcttctatcactacgaccgcacgccggtactgacggtcgcggccgaacatctgaacccgctggattcccccgaagacctcgcgctgctgatcgagcgcatcgacacgatgcgcggccgcaaggaattcttcgtcaagggcgagtcgacgcgctgacgcgcgcaccgcccgccgttcctcccccattcgaaccggatttccccatgacctatctccaggaatcgagccggcctgcgatcacggtgccgaagctgcaggcaatgcgcgaagccggcgagaagatcgcgatgctgacctgctacgacgcgagcttcgccgcgctgctcgatcgcgccggcaccgacgtgctgctgatcggcgactcgctcggcaacgtgctgcaaggccacacgaccacgctgcccgtgtcgctcgacgacatcgcgtaccacaccgcgtgcgtcgcgcgcgtgcagccgcgcgcgctggtcgtcgccgatctgccgttcggcacctacggcacgcccgcggaagcgttcgcccattcggtcgcgctgatgcgcgcgggcgcgcagatggtcaagctcgaaggcggcgaatggctcgccgacacgatccgctttctcgtcgaacgctcggtgccggtgtgcgcgcatctcggcctcacgccgcagtcggtgcatgcgttcggcggcttcaaggttcagggccgcaccgaagccggcgccgcgcagttgctgcgcgacgcgcgcgcgatcgaggacgccggcgcgcagctcgtcgtgctcgaagcggtgccgacgctcgtggccgccgaagtcacgcacatgctgaagatcccgacgatcgggatcggcgcggggctcgattgctcgggccaggtgctggtgctgcacgacatgctgggcatcttccccggcaagcggccgcgcttcgtgaaagatttcatgcaaggccagccgagcatccaggccgccgtcgaagcgtacgtcagcgcggtgaaggagtgcacgttccccggccccgagcattcgttctga

SEQ ID NO: 101037 - protein, 400 aa, Burkholderia vietnamiensis G4
MAAVPRDRRARRRTAGARARSGRLSAGEPRGAVLAHPEARPADGAADQRRVPARAGRRLQRILLSLRPHAGTDGRGRTSEPAGFPRRPRAADRAHRHDARPQGILRQGRVDALTRAPPAVPPPFEPDFPMTYLQESSRPAITVPKLQAMREAGEKIAMLTCYDASFAALLDRAGTDVLLIGDSLGNVLQGHTTTLPVSLDDIAYHTACVARVQPRALVVADLPFGTYGTPAEAFAHSVALMRAGAQMVKLEGGEWLADTIRFLVERSVPVCAHLGLTPQSVHAFGGFKVQGRTEAGAAQLLRDARAIEDAGAQLVVLEAVPTLVAAEVTHMLKIPTIGIGAGLDCSGQVLVLHDMLGIFPGKRPRFVKDFMQGQPSIQAAVEAYVSAVKECTFPGPEHSF

SEQ ID NO: 101038 - DNA, 759 bp, Burkholderia mallei 10229
  CDS (1)..(759)
atgcgggaagccggcgagaagatcgcgatgctcaccagctacgacgcaagcttcgccgccctcctcgatcgcgcgaacgtcgacgtgcaactgatcggcgattcgctcggcaacgtgctgcagggccaggcgacgacgctgcccgtcacgctcgacgacatcgcgtatcacaccgcatgcgtcgcgcgcgcgcagccgcgcgggctcgtcgtcgcggacctgccgttcggcacctacggcacgcccgccgacgcattcgcgagcgcggtgaagctgatgcgcgcgggcgcgcagatggtcaagctcgaaggcggcgaatggctcgccgaaacggtgcgcttcctcgtcgagcgggccgtgcccgtgtgcgcgcacgtcggcctcacgccgcagtcggtgcacgcgttcggcggcttcaaggtgcaaggcaagacggaagcgggcgccgcgcaattgctgcgcgatgcgcgcgcggtcgaggaagccggcgcgcagctcatcgtgctcgaggcggtgcccacgctcgtcgcggccgaagtcacgcgcgagctgtcgatcccgacgatcggcatcggcgcgggcgccgaatgctcgggccaggtactcgtgctgcacgacatgctcggcgtgttccccggcaagcggccgcgcttcgtcaaggatttcatgcaggggcagccgagcatcttcgcggcggtcgaggcctacgtgcgcgcggtgaaggacggcagcttccccgggcccgagcattcgttctga

SEQ ID NO: 101039 - protein, 252 aa, Burkholderia mallei 10229
MREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 101040 - DNA, 816 bp, Burkholderia cenocepacia AU 1054
  CDS (1)..(816): transl_table=11
atgacctatctccaggaatcgagccggcctgccgtgacggtacccaagctgcaggcaatgcgcgacgccggcgagaagatcgcgatgctcacgtgctacgacgcgagcttttccgcgctgctcgatcgcgccggcaccgacgtgctgctgatcggcgattcgctcggcaacgtgctgcagggccacacgaccacgctgcccgtgtcgatcgacgacatcgcgtaccacaccgcctgtgtcgcacgggcgcagccgcgcgcgctcgtcgtcgccgatctgccgttcggcacgtacggcacgccggtcgacgcgttcgcgaacgcggtcaagctgatgcgcgcgggcgcgcagatggtcaagctcgaaggcggcgaatggctcgccgacacgatccgcttcctcgtcgaacgctcggtgcccgtctgtgcgcacctcggcctcacgccgcagtcggtgcatgcgttcggcggcttcaaggttcagggcaagaccgaagccggcgccgcgcaactgctgcgcgatgcgcgcgcgatcgaggatgccggcgcgcagctcgtcgtgctcgaagccgtgccgacgctcgtcgcggccgaagtcacgcacatgctgaagatcccgacgatcggcatcggcgccggcgtcgactgctcggggcaggtgctcgtgctgcacgacatgctcggcgtgttccccggcaagcggccgcgtttcgtgaaggatttcatgcaggggcagccgaacattcaggcggccgtcgaagcctacgtgagcgcggtgaaggatcgatcgttccccggccccgaacactcgttctga

SEQ ID NO: 101041 - protein, 271 aa, Burkholderia cenocepacia AU 1054
MTYLQESSRPAVTVPKLQAMRDAGEKIAMLTCYDASFSALLDRAGTDVLLIGDSLGNVLQGHTTTLPVSIDDIAYHTACVARAQPRALVVADLPFGTYGTPVDAFANAVKLMRAGAQMVKLEGGEWLADTIRFLVERSVPVCAHLGLTPQSVHAFGGFKVQGKTEAGAAQLLRDARAIEDAGAQLVVLEAVPTLVAAEVTHMLKIPTIGIGAGVDCSGQVLVLHDMLGVFPGKRPRFVKDFMQGQPNIQAAVEAYVSAVKDRSFPGPEHSF

SEQ ID NO: 101042 - DNA, 1866 bp, Burkholderia cenocepacia HI2424
  CDS (1)..(1866): transl_table=11
atgcgggcggcatcgagcgcaaacgtgcgctgctgtcgctcgaaggcgcagaactttcacgcggcgcgcatcatccgatgcagcaggcgctcgcgttctgatcgacgaagcgcgtcacgcgggcagcaccggccggcgcgcttcacgcttcgcatatgcgccgggcgtcatgcggaatttcgcctggaacagcgcgatgaacgacgacgtcgagtcgtaacccagttgtgcggccaccgtgccgatcggctcgcctgcatcgagcagcggcaacgacgcgagcagccgcacgccctgccgccattccgtgaacgacaaccccgtgtcctgccggaacagccgcgacagcgtgcgccgcgtcgcgccgacctgatggccccattcgtcgagactgcgcgtatcgcccggcgccgcatgcaacgcgcgcgcgattttcagcaggcgcggatcgcgcggcagcggcaccgtgagcggcgccggctgcatgcgcgcgatccggtccgcgatcaggcacacgagcgcaccgtcgggccccgcctcgtcgtaattcaccggcaactcgccggtcgcgatcaccagctcacgcagcagcggcgtcatgcagaggatcgtgcaatcgtcgttcacgtcgccgcgcgcgagggctgcgtcgagatacaggctgtggaacgcgacgcaatcgcgcgtcgacaccgcgtgcggcacgtgtggcggaatccacatcgcatagtgcggcggcagcagttgccggcccgacggcgtcgacacctcgagcacgccgctcgtcgcatacatcaactgcgcccacggatgactgtgcgcgtcgacgctcacgttgccgggaatgccgaacgcgcgcacgtacagcggcctcggcaggcgcgtcatcggcggcactgcgtaagggtcgccgggttgtcccgccagcaacataagacgtcctccgaaggtcattgcacgaacgcacgcgatgctaccgtggcggctccctttttcacacggcttccgcccatgagcgctcatacccgcatcacccgcaagaccgtcaccgcgatccgttcgaccaaaggcatcggcagcctcgtgtcgctgaccgcgtactccgcgccgatggcgaagctcgtcgatgaagtggccgacgtgatcatcgtcggcgactccgtcggcatggtgctgtacgggatgcccgatacgctgcgcgtcacgctcgacatgatgattgcacatggggcggccgtcgtgcgcggcgccgcgcaggcgtgcgtcgtcgttgacctgccgttctccacgttccaggaatcgcccgcgcaagcgtatcgctctgccgcgcggctgctcgccgaaaccggcgcgcaggccgtgaagctcgaaggcggctgcgagatgaccgacaccatccgcttcctgaccgatcgcggcattccggtgatggcgcatgtcggcctcatgccgcagcaggccaacgcggcgggcggcttccgcgcgcagggcatggacccgcgttcggccgcgcaggtgttcgacgccgcgtgtgcggccgagcgggccggcgcgttcagcgtcgtcatcgaaggcaccgccgaagcgctcgcgcgccacctgaccgaaacgctgacgatcccgacgatcggcatcggcgcatcgcccgcgtgcgacgggcaagtgctcgtgaccgaggacatgatcggcgcgttcgatgcgtacacgccgcgcttcgtgaagcgctacgcggatgcgaacgcggtgatgcgcgacgcgatccgccagtacgctcacgacgtgcggcagcgcgtgtttcccgagcccgcgcattgcttcggatacggcaagccgctgcaactggcggacgcggccaccgccgcgtga

SEQ ID NO: 101043 - protein, 621 aa, Burkholderia cenocepacia HI2424
MRAASSANVRCCRSKAQNFHAARIIRCSRRSRSDRRSASRGQHRPARFTLRICAGRHAEFRLEQRDERRRRVVTQLCGHRADRLACIEQRQRREQPHALPPFRERQPRVLPEQPRQRAPRRADLMAPFVETARIARRRMQRARDFQQARIARQRHRERRRLHARDPVRDQAHERTVGPRLVVIHRQLAGRDHQLTQQRRHAEDRAIVVHVAAREGCVEIQAVERDAIARRHRVRHVWRNPHRIVRRQQLPARRRRHLEHAARRIHQLRPRMTVRVDAHVAGNAERAHVQRPRQARHRRHCVRVAGLSRQQHKTSSEGHCTNARDATVAAPFFTRLPPMSAHTRITRKTVTAIRSTKGIGSLVSLTAYSAPMAKLVDEVADVIIVGDSVGMVLYGMPDTLRVTLDMMIAHGAAVVRGAAQACVVVDLPFSTFQESPAQAYRSAARLLAETGAQAVKLEGGCEMTDTIRFLTDRGIPVMAHVGLMPQQANAAGGFRAQGMDPRSAAQVFDAACAAERAGAFSVVIEGTAEALARHLTETLTIPTIGIGASPACDGQVLVTEDMIGAFDAYTPRFVKRYADANAVMRDAIRQYAHDVRQRVFPEPAHCFGYGKPLQLADAATAA

SEQ ID NO: 101044 - DNA, 759 bp, Burkholderia pseudomallei 1655
  CDS (1)..(759)
atgcgggaagccggcgagaagatcgcgatgctcaccagctacgacgcaagcttcgccgccctcctcgatcgcgcgaacgtcgacgtgcaactgatcggcgattcgctcggcaacgtgctgcagggccaggcgacgacgctgcccgtcacgctcgacgacatcgcgtatcacaccgcatgcgtcgcgcgcgcgcagccgcgcgggctcgtcgtcgcggacctgccgttcggcacctacggcacgcccgccgacgcattcgcgagcgcggtgaagctgatgcgcgcgggcgcgcagatggtcaagctcgaaggcggcgaatggctcgccgaaacggtgcgcttcctcgtcgagcgggccgtgcccgtgtgcgcgcacgtcggcctcacgccgcagtcggtgcacgcgttcggcggcttcaaggtgcaaggcaagacggaagcgggcgccgcgcaattgctgcgcgatgcgcacgcggtcgaggaagccggcgcgcagctcatcgtgctcgaggcggtgcccacgctcgtcgcggccgaagtcacgcgcgagctgtcgatcccgacgatcggcatcggcgcgggcgccgaatgctcgggccaggtactcgtgctgcacgacatgctcggcgtgttccccggcaagcggccgcgcttcgtcaaggatttcatgcaggggcagccgagcatcttcgcagcggtcgaggcctacgtgcgcgcggtgaaggacggcagcttccccgggcccgagcattcgttctga

SEQ ID NO: 101045 - protein, 252 aa, Burkholderia pseudomallei 1655
MREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDAHAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 101046 - DNA, 792 bp, Chromohalobacter salexigens DSM 3043
  CDS (1)..(792): transl_table=11
atgaaaaccgtcaccttgagccgtctcaatgccttcaagcatgcccaagagccgttcagctgcctgacggcctacgatgcctcgttcgcccagcatgccgatgcagccggcatcgatgtcctgctggtcggcgactcgttgggcatggtgcttcagggccatgccagcacgcttcccgtgacgctcgacgacatcctctatcacacgcgctgcgtggcgcgcggcaagcaacgcagcctgttgatggtcgacttgcccttcatgagcaacgccgacaccggccaattgctgcgtgacgccggtgccttgatgcgggccggcgccgagctggtcaagatcgaaggcgcggggtggatgcacgagggagtccgcgagctcacgcggcgcggcgtgccggtgtgcgcgcatctcggcctgacgccacagagcgtgcatcagttcggcggctacaaggtacaaggccgcgagcaggacgatgcccagcgcatcatcgacgatgcccgcctgctggtcgaggccggtgcctcggtgatcctgctggaatgcgtgcccgccgcactcggccgcgccgtgcgcgacgccgtggacgttcccgtgatcggtatcggcgccggccccgaggtggatgggcagatcctggtcatgcacgacgtgatcggcgtgacgcatggacgtcctccacgcttcgccaagaattttctggcgggtcgtgacagcatccaggcggcgttcgaagcctaccgcgatgccgtcaagacgcgtcaatttcccgccgaggagcattgtttctga

SEQ ID NO: 101047 - protein, 263 aa, Chromohalobacter salexigens DSM 3043
MKTVTLSRLNAFKHAQEPFSCLTAYDASFAQHADAAGIDVLLVGDSLGMVLQGHASTLPVTLDDILYHTRCVARGKQRSLLMVDLPFMSNADTGQLLRDAGALMRAGAELVKIEGAGWMHEGVRELTRRGVPVCAHLGLTPQSVHQFGGYKVQGREQDDAQRIIDDARLLVEAGASVILLECVPAALGRAVRDAVDVPVIGIGAGPEVDGQILVMHDVIGVTHGRPPRFAKNFLAGRDSIQAAFEAYRDAVKTRQFPAEEHCF

SEQ ID NO: 101048 - DNA, 903 bp, Polaromonas sp. JS666
  CDS (1)..(903): transl_table=11
atgactccagcgaacgctcctgccccgtccccggcaacgccatcggccaccccttatggcacgctgccgcccgccgccacaccgtcggcgcgcaagccgctgagcctgccgcgcctgcgcgagatgcatgcgcagggtgaaaaaatcaccatgctgaccgcctacgacgcaaccttcgcggccgtagccgacgcggccggcgtggaatgcatcctggtcggcgactcgctcggcatggtctgccagggcctgacgagcaccgtgggcgtgacgctggaaaccatgcgccaccacactgagtgcgtggccaacggcctgcgccgctcgcacgccacggcctggctgatcggtgacctgccctttggcacctaccacgagtcgaaagaacaggccctgcgcaacgccgtggcgctgatgcaggccggcgcgcacatggtgaagctcgaaggcggcggctggacggccgataccgtgcgctttctggtcgagcgcggcattcccgtctgcgcccacctgggcctgacgccgcaaaccgtgcatgccctgggcggttaccgcgtgcagggcaaaaccgaggaagccgccgccacgctcaaacgcgaggcccatgaactgcaggacgccggtgcggccatgctggtgctggaaatggtgcctgcggccttgtcggccgcgctcacccaggcactgacgcactgccccaccatcgggattggtgcgggcaatggcacggccggccaggtgctggtgctgcatgacatgctgggcatgaacctgggcaagatgcccaaatttgtacgaaacttcatggacggagcgcccagtgtgcgtggcgccatggaggcttatgtccgcgccgtcaaagacggcagcttcccggtcaatgccacccacgcgtggtaa

SEQ ID NO: 101049 - protein, 300 aa, Polaromonas sp. JS666
MTPANAPAPSPATPSATPYGTLPPAATPSARKPLSLPRLREMHAQGEKITMLTAYDATFAAVADAAGVECILVGDSLGMVCQGLTSTVGVTLETMRHHTECVANGLRRSHATAWLIGDLPFGTYHESKEQALRNAVALMQAGAHMVKLEGGGWTADTVRFLVERGIPVCAHLGLTPQTVHALGGYRVQGKTEEAAATLKREAHELQDAGAAMLVLEMVPAALSAALTQALTHCPTIGIGAGNGTAGQVLVLHDMLGMNLGKMPKFVRNFMDGAPSVRGAMEAYVRAVKDGSFPVNATHAW

SEQ ID NO: 101050 - DNA, 954 bp, Clostridium thermocellum ATCC 27405
  CDS (1)..(954): transl_table=11
atgaatcaaaaatatagtttgcggccttattgtcaaatatcagtcaatcctgtcggattgacttttttgattttggaatccaagacggaagaaggtatgattatgaacgacaaatttacaacggcaagctttttggaatcaaaaaaacaaggtagaaaaattacaatgcttacagcctatgactacccaacggctaaaattttggatgaagcaggagtggactcaatactggtcggggattctcttggaatggtagtcctgggatatgaggatactacgcgggtgacgatggatgacatggttcatcacacaaaagctgttgtgcggggagtaaaaagggcaatggttgttgcagacatgccgtttttatcctaccatacaggaaaaaacgacagtgtaagaaatgccggaagacttgtgtccgaagggggctgcaaggctgtaaaacttgaaggcggcgaggatataattgaaaacgtgaaggccatcatcagtgccggaatacccgtagtcggacatcttggatatacaccccagtcaataaatgttttcggaggacacaaggctcagggaaaaactattgacacagcaaagaaaatataccgggatgcacttttgttgcaaaaagcaggggtttttgccgtggttttggagtgtgtgccgtataaacttgcggcttttatttcaaagagattggatatacccacaataggaattgggtccggtccggactgtgacggacaggttcttgtcatacatgatttgacaggtatgtttaaggattttactccaaagcatgttaaaaagtacgctgagattggagaaactgtatccacggcggtaaaaagctatatagacgaagtgaaaaacggagtatttccaacagaaaaaaattcttttaaagtggatgattggattattgatgagcttgataaagttaggtttgacatttag

SEQ ID NO: 101051 - protein, 317 aa, Clostridium thermocellum ATCC 27405
MNQKYSLRPYCQISVNPVGLTFLILESKTEEGMIMNDKFTTASFLESKKQGRKITMLTAYDYPTAKILDEAGVDSILVGDSLGMVVLGYEDTTRVTMDDMVHHTKAVVRGVKRAMVVADMPFLSYHTGKNDSVRNAGRLVSEGGCKAVKLEGGEDIIENVKAIISAGIPVVGHLGYTPQSINVFGGHKAQGKTIDTAKKIYRDALLLQKAGVFAVVLECVPYKLAAFISKRLDIPTIGIGSGPDCDGQVLVIHDLTGMFKDFTPKHVKKYAEIGETVSTAVKSYIDEVKNGVFPTEKNSFKVDDWIIDELDKVRFDI

SEQ ID NO: 101052 - DNA, 834 bp, Chlorobium limicola DSM 245
  CDS (1)..(834): transl_table=11
atgaaccgtggcaaccagcagaaatcagcccatgtgaccacccgaagactcctcgatatgaaggaaaaaggggaaaaaatatcggtgctgaccgcctatgatttcacaacagcgagaattctcgacagggccggtgttgacgtcattcttgttggcgattctgcaagcaatgttttttccggccacaacacgaccctccctatcaccattgacgagatgatctaccatgcgaaggccgtggttcggggcgttcaggccgaaacaagccgcgccatggtggttatcgatatgccgttcatgagctatcagctgtcgagcgaagaggctttgcgcaacgccggtaaaatcatgaaagagcatgagtgtgatgctgtgaagatggagggaggaaggattgttgccgatacggtcaaaagaataaccgatgtaggtattccggtgatgggacatctgggtcttatgccccagtctatttataaatacggcagctacagggtacgggcacaggaagggcgcgaagccgagcaactgctcgaagatgcaaaattgatcgagcaggccggagcgttcgccgttgtgcttgagaaaataccttcaaaacttgctgaagaggttaccgcacaattgactattcctaccatcggaatcggcgcaggctcgtcctgcgacggtcaggtgcttgtgatcaacgatattctcggacttaaccgggagttccgtccccgttttgtgcgtcgctatgccgaactggacgccattatcgatggggcggtcaggcagtatgtcgatgatgtgaaatcaggcaattttccttctcctgatgaaagttattag

SEQ ID NO: 101053 - protein, 277 aa, Chlorobium limicola DSM 245
MNRGNQQKSAHVTTRRLLDMKEKGEKISVLTAYDFTTARILDRAGVDVILVGDSASNVFSGHNTTLPITIDEMIYHAKAVVRGVQAETSRAMVVIDMPFMSYQLSSEEALRNAGKIMKEHECDAVKMEGGRIVADTVKRITDVGIPVMGHLGLMPQSIYKYGSYRVRAQEGREAEQLLEDAKLIEQAGAFAVVLEKIPSKLAEEVTAQLTIPTIGIGAGSSCDGQVLVINDILGLNREFRPRFVRRYAELDAIIDGAVRQYVDDVKSGNFPSPDESY

SEQ ID NO: 101054 - DNA, 789 bp, Crocosphaera watsonii WH 8501
  CDS (1)..(789): transl_table=11
atgggactaacgacgcaacaattaatctcttggaaacaacaaggccgtccaattgtagccttaacggcttgggattacgcctttgctcaattattggacaaagccggtgttgatattattttggtgggtgattctttggctatggtagctttgggctatgaaaccaccctaccagttactctggatgagatgttatatcacgcggccgctgttcgtcggggagtcaaacgggctttggtggtgtgtgatttaccttttctaagttaccaagaaagcatcagtcaagctattcatgccgccggaagggttttaaaagaaacaggggtacaaggggttaaactcgaaggtggacaccctgcctccctagaaactgttgctcgtttgagtgatattgggattccagtgatgggccatgtagggttaacccctcagtcggtgcatcgtttgggttatcgtcaacagggaaacaccgaggctgaggctgaacgtattttatcggaagcgatcgctttatcggaagcgggggcttttgctgttgttttagaacatattccagctaacctcgcgagaataattactacaaagttacctattcctactattggtattggtgccggaggcgactgtgatgggcaggttttggtaacagcagatttattgggactctcggagaaaaaaccgccttttgctaaatcttatctcaatttaagagaaatagttattggagcggttaatgatttttcccaagaagttcgagagagaaagtttcctgagagtgatcaattatag

SEQ ID NO: 101055 - protein, 262 aa, Crocosphaera watsonii WH 8501
MGLTTQQLISWKQQGRPIVALTAWDYAFAQLLDKAGVDIILVGDSLAMVALGYETTLPVTLDEMLYHAAAVRRGVKRALVVCDLPFLSYQESISQAIHAAGRVLKETGVQGVKLEGGHPASLETVARLSDIGIPVMGHVGLTPQSVHRLGYRQQGNTEAEAERILSEAIALSEAGAFAVVLEHIPANLARIITTKLPIPTIGIGAGGDCDGQVLVTADLLGLSEKKPPFAKSYLNLREIVIGAVNDFSQEVRERKFPESDQL

SEQ ID NO: 101056 - DNA, 834 bp, Chlorobium phaeobacteroides DSM 266
  CDS (1)..(834): transl_table=11
atgaacaccagtaaccagcataaagcaggacatgttactacaagaaagctgctggatatgaagcagcagggagaaaaaatatcggtattgactgcctatgattataccatggcaaggattcttgatcgagccggtattgatgttattcttgtgggggattcggcaagcaatgttttttccggtcatgccactacgcttcccattacgattgaggagatgatctatcacgcaaaggctgttgtcaggggtgtgcacgacgagagtgggcgggcgatggtcgtcgttgatatgccgttcatgagctatcagatttcaggtgatgaggctttgcgcaatgcgggaaagatcatgaaggagcatgggtgtgatgctctcaagctggagggaggcaagatcattgccgataccgtcaagcgaattaccgacgtcgggattccggtgatgggtcatcttggtcttatgccgcagtccatctataagtatggaagctacaaggtcagggctcaggaggaacaggaggctgaacagcttcttcaagatgcccgattgcttgaagaggcgggtgctttcgctgttgttcttgaaaagatcccctcagcgcttgctgcagaggttacccttatgctcactattccgactatcggcatcggagccggatcgcattgtgatggacaggttctggtagtcaatgatattcttggtctcaatcgtgagtttcatcctcgttttgttcggcagtacgctaatttaaataacgttatcgatcgtgcggtacaacagtatgttgatgatgtcaagcagggaggttttcccgctgatgatgagagttactga

SEQ ID NO: 101057 - protein, 277 aa, Chlorobium phaeobacteroides DSM 266
MNTSNQHKAGHVTTRKLLDMKQQGEKISVLTAYDYTMARILDRAGIDVILVGDSASNVFSGHATTLPITIEEMIYHAKAVVRGVHDESGRAMVVVDMPFMSYQISGDEALRNAGKIMKEHGCDALKLEGGKIIADTVKRITDVGIPVMGHLGLMPQSIYKYGSYKVRAQEEQEAEQLLQDARLLEEAGAFAVVLEKIPSALAAEVTLMLTIPTIGIGAGSHCDGQVLVVNDILGLNREFHPRFVRQYANLNNVIDRAVQQYVDDVKQGGFPADDESY

SEQ ID NO: 101058 - DNA, 834 bp, Chlorobium phaeobacteroides BS1
  CDS (1)..(834): transl_table=11
atgaagagagacagcgggcagaaacttccacatgttacgacgcggcggcttcttgatatgaaggaacagggagaaaagatcgccatgcttacagcatatgattatacgacagccagaattcttgatcgctcgggcgtcgatgtcattcttgtgggagactcggtcagcaatgtgttttccggtcacaatacgacacttccgattactattgaagagatgatctaccatgcaaaggcggttgttaggggagtgcaggctgaaaccagccggtcgatggttgtcattgatatgcctttcatgagctatcagctttcaagtgaagaggcgttgcgtaacgcggggaaaatcatgaaggacaacgagtgcgatgccgttaaaatggaaggaggaaaggttgttgtcgatacagttaaacggataaccgatgtcggcattcccgtaatggggcacctcgggctgattccgcagtcaatatacaagtttggcagttacaaggtgcgggcccgtgagcagaaggaggctgaagagttgctgcgggacgcggttcttctcgagcaggccggagcctttgcgctggtacttgaaaaaattcccgccgaccttgccgcagaagtaacccgaacagttggtattccgacaataggtatcggtgccggttccttttgtgacggtcaggttcttgtcatcaatgacatgcttggactgaacacggagtttcatcctcgttttgtcagaagatatgctgatcttgacggcgtgattttcgatgcggtgaccgggtatgtcgatgatgtccggaacgggcagttcccggctgaggatgaaagctattaa

SEQ ID NO: 101059 - protein, 277 aa, Chlorobium phaeobacteroides BS1
MKRDSGQKLPHVTTRRLLDMKEQGEKIAMLTAYDYTTARILDRSGVDVILVGDSVSNVFSGHNTTLPITIEEMIYHAKAVVRGVQAETSRSMVVIDMPFMSYQLSSEEALRNAGKIMKDNECDAVKMEGGKVVVDTVKRITDVGIPVMGHLGLIPQSIYKFGSYKVRAREQKEAEELLRDAVLLEQAGAFALVLEKIPADLAAEVTRTVGIPTIGIGAGSFCDGQVLVINDMLGLNTEFHPRFVRRYADLDGVIFDAVTGYVDDVRNGQFPAEDESY

SEQ ID NO: 101060 - DNA, 804 bp, Geobacter metallireducens GS-15
  CDS (1)..(804): transl_table=11
gtgaaccgcaagaagacaattattgacatccagaagatgaaggcagccggcgagaagataaccgtcctcaccagctatgattacccctttacccgcgtaatggatgaatgcggcattgacatgatcctcatcggcgattccgtgggcgttgtcttcagtgggtatgacaacaccctgccggtcacgatggacgagatgatctatcacacccgggcggtggtgcgggcccggcccaaggccctggttgtggccgacatgccgttcctctcctaccagaccgacctgcgggacgcccgtctcaatgccggccgtctcgtgaaggatgggggggcggaagccgtcaagctggaaggtgggagccatgtggccgataccatccgcgccattgtcgacatggatattccggttatggcccatatcggtctcaccccccagtcgattcaccggatgggggggtacaaggtccaggggaaaaaggaagagcagtcccagcggcttctggatgatgccaaggccattgaagaagccggcgcctttgccgtggttctggaggggatcccgctgaaactggcggaaaagatcaccgaagagctttccattcccacaatcggcattggcgcggggccccactgcgacggtcaggtgcttgtgatccatgacatcctgggactgtgcgagaaatactctccaaagttcgtgaaacgttacggggacgccaatgcgctgataaccagcgcggtttcctcatacatcgccgaagtgaagaaaggagaattccccgacgaggggcattcattcagctga

SEQ ID NO: 101061 - protein, 267 aa, Geobacter metallireducens GS-15
MNRKKTIIDIQKMKAAGEKITVLTSYDYPFTRVMDECGIDMILIGDSVGVVFSGYDNTLPVTMDEMIYHTRAVVRARPKALVVADMPFLSYQTDLRDARLNAGRLVKDGGAEAVKLEGGSHVADTIRAIVDMDIPVMAHIGLTPQSIHRMGGYKVQGKKEEQSQRLLDDAKAIEEAGAFAVVLEGIPLKLAEKITEELSIPTIGIGAGPHCDGQVLVIHDILGLCEKYSPKFVKRYGDANALITSAVSSYIAEVKKGEFPDEGHSFS

SEQ ID NO: 101062 - DNA, 840 bp, Exiguobacterium sp. 255-15
  CDS (1)..(840): transl_table=11
atgcatacgatgacacctttactaaaaaaacaacaggcgggcgaaaaactcgtcatgctcacagcgtacgattatccgtccgcaaaattagcggaagccggacacgtcgatttgctgctggtcggggattcgctcgggaatgtcattctcggatatgattcgacgattgccgtgacagtagacgatatggtccatcacgcaaaagctgtccgtcgcggagcaccggcaacctttatggtcgttgacatgccgtttgccagctatcacggttcgtttgaccggacgcttgaggcggcagcccgtatcttccaggaaagcggagcagacgccttgaaactcgaaggggccggagacatcctgacaacgattcgtcgtctgacggaggccggtatgccttgtgttgcccacttggggctgacaccacaatctgtcggagtgctcgaaggatttaaagttcaggggaaatcgcttgcagcagcggaacagttgattgccgacagtttggccgcagaacaagcgggagcgaagatgcttgttcttgagtgtgtaccgcatccgctggcgaaacgtgttcaggaactcttaacgattccggtaatcggaattggggcaggtgccgatgttgccggacaagtattggtctaccatgatatcttgacgtacggtgtcggacggttgccaaaattcgttaaagcatatgccgactggaacacatccggtacggaagcgatcgcccgttacgtcgaagacgtcaaaaacgggacgttccctgaactcgcccactcgttcctgatggatgaagaactgatcggggcgttatatggaggatttaaagaatga

SEQ ID NO: 101063 - protein, 279 aa, Exiguobacterium sp. 255-15
MHTMTPLLKKQQAGEKLVMLTAYDYPSAKLAEAGHVDLLLVGDSLGNVILGYDSTIAVTVDDMVHHAKAVRRGAPATFMVVDMPFASYHGSFDRTLEAAARIFQESGADALKLEGAGDILTTIRRLTEAGMPCVAHLGLTPQSVGVLEGFKVQGKSLAAAEQLIADSLAAEQAGAKMLVLECVPHPLAKRVQELLTIPVIGIGAGADVAGQVLVYHDILTYGVGRLPKFVKAYADWNTSGTEAIARYVEDVKNGTFPELAHSFLMDEELIGALYGGFKE

SEQ ID NO: 101064 - DNA, 891 bp, Frankia sp. CcI3
  CDS (1)..(891): transl_table=11
atggatgcttcagacacacccacccacccggcgccccacccggcggacccggcggcgacgccctacggcgcgccgaccacgccgccgcggccactccggtcccgtttcacagtgcgcgacgtcgccgcggcgaagaaccggggcgagaagtggtcgatgctgaccgcgtacgacgccaccaccgccgccgtcttcgacgaggcggagatccccgtcctgctggtcggggactcggccgccaacgtcgtctacggctacgacacgaccgtgccgatcaccgtcgatgagctgctgccgctggtccgggcggtggtccgcggagcaccgcacgcgatggtcgtcgccgatctgcccttcgggtcgtaccagggggggcctgccgaggcactggcgagcgctacccgcttcctcaaggagggcggggcgcacgcggtgaaactcgagggcggttcccgggtggtccgggcggtggacgccctggtcggcgccggcatccccgttatcgggcatctggggctgaccccgcagagcatccacaccatcgggggctaccgggtccagggccgcgacgaggccggcgagatcctgctggccgacgcgctggcgctcgaggcggccggcgcgttcgcggtcgtgctcgaggtggttcccgccgatctggccacccgggtgacgaaggagttgcgcatcgccaccgtgggtatcggagccggctcgggatgcgatgcccaggtgctggtctggcaggacatggccgggctgagcggcggccgcacgccacggttcgtcaagcggtacgcggatctgcgcacgattctcgcggacgccgcccgagcctaccgcgcggacgtccgggacggcaggtacccgacgatcgagcacagctactga

SEQ ID NO: 101065 - protein, 296 aa, Frankia sp. CcI3
MDASDTPTHPAPHPADPAATPYGAPTTPPRPLRSRFTVRDVAAAKNRGEKWSMLTAYDATTAAVFDEAEIPVLLVGDSAANVVYGYDTTVPITVDELLPLVRAVVRGAPHAMVVADLPFGSYQGGPAEALASATRFLKEGGAHAVKLEGGSRVVRAVDALVGAGIPVIGHLGLTPQSIHTIGGYRVQGRDEAGEILLADALALEAAGAFAVVLEVVPADLATRVTKELRIATVGIGAGSGCDAQVLVWQDMAGLSGGRTPRFVKRYADLRTILADAARAYRADVRDGRYPTIEHSY

SEQ ID NO: 101066 - DNA, 801 bp, Desulfuromonas acetoxidans DSM 684
  CDS (1)..(801): transl_table=11
atgaggaaacaaaccaccgtactcgatgttcagaacatgtacgccaaaggggacaagatcaccgtattaacggcctatgactaccccttcgcccggatgatggatcaggccggaatcgacatgattctggtcggcgattccgtcggcagtgtcttctccggctatgacaccaccttgccggtcactatggaagagatgatttatcacaccaaagcggtgatgcgcggcagccagggtgccctggtcattgccgacatgccgtttttatcgtatcaggtggatgtgcgcgacgcctgtttgaatgccggacgtctggtcaaggatgccggagcccacgccgttaagcttgaaggcggtgaaaacgtcgctgacaccatccgtgccatcgttaacatggacattccggtggtcgcccacatcggcctgacgccgcagtcaattcaccgcatgggcggttatcgtgtccagggccgcaaagaggaacaggcccggcaactgattgccgatgccaaagccgtggctgaagccggtgcctttgccgtggtgctcgaagggattcctgccgatctggctaaagagattactgaaagtatcgatatcccgaccatcggcattggtgccggggtacattgctccggtcaggtgctggtgattcacgatattctcggtttgtgcgaaaaatactcgcccaagtttgtcaaagtttatgctgatctggctccgctcatcaaagaagccatgaccagctacatcgatgaagtgcgtgccggaacatttcctggcgacgaacacagtttttag

SEQ ID NO: 101067 - protein, 266 aa, Desulfuromonas acetoxidans DSM 684
MRKQTTVLDVQNMYAKGDKITVLTAYDYPFARMMDQAGIDMILVGDSVGSVFSGYDTTLPVTMEEMIYHTKAVMRGSQGALVIADMPFLSYQVDVRDACLNAGRLVKDAGAHAVKLEGGENVADTIRAIVNMDIPVVAHIGLTPQSIHRMGGYRVQGRKEEQARQLIADAKAVAEAGAFAVVLEGIPADLAKEITESIDIPTIGIGAGVHCSGQVLVIHDILGLCEKYSPKFVKVYADLAPLIKEAMTSYIDEVRAGTFPGDEHSF

SEQ ID NO: 101068 - DNA, 921 bp, Desulfitobacterium hafniense DCB-2
  CDS (1)..(921): transl_table=11
gtgttttgtgtggttccttctgacaagggggaacttttttgttgctctgttttgtcttctctcctgaaaaaaggaggaaaaacgttgaaaacaacaaaagacttctgggtgatgaaaaatgagggaaaaaagattgtcatgattaccgcctacgattacccctcagccaagcaggccgaacaagcgggtgcggacataattctagtgggggattctctgggcaatgtggtgctgggctacgactctacggtttatgtcaccatggaagacatgatccatcatgggaaagcagctaagcgcggggctcccaatacgtttatcgtggcggacatgccttttatgagctgccatctgtccatcagggatactttgctcaatggagcaaggcttattcaggagacgggggcccaggctgtaaaggtggaaggtgcggatgaaatgatccctcatatcaaagctcttgtccgcgcggggatacctgtagtctctcatcttggtctgacacctcagactgctgcagttctcggtggttttaaagttcagggtaaagatggggaagccgcccgcaaaatgctggaggatgtgaaggaatgccaggaggcaggggcctttgccctggtcctggagtgtattcctaagcagctggcccaggaaatttctacgaccttgacaattcccaccattggcatcggcgcaggtgttcataccgatggacaagtgctcgtctaccatgacatactcacctatggggtgaaccgggctcccaagtttgtcaaagcttatgccaatgctgatcaactcatgctcaaaggattgcaggactatgcggatgaggtaagaagtatgaatttccccgatgatgagcacagctttaccatgaaggaagaggaattaaaaaccttgtatggaggcaggggctaa

SEQ ID NO: 101069 - protein, 306 aa, Desulfitobacterium hafniense DCB-2
MFCVVPSDKGELFCCSVLSSLLKKGGKTLKTTKDFWVMKNEGKKIVMITAYDYPSAKQAEQAGADIILVGDSLGNVVLGYDSTVYVTMEDMIHHGKAAKRGAPNTFIVADMPFMSCHLSIRDTLLNGARLIQETGAQAVKVEGADEMIPHIKALVRAGIPVVSHLGLTPQTAAVLGGFKVQGKDGEAARKMLEDVKECQEAGAFALVLECIPKQLAQEISTTLTIPTIGIGAGVHTDGQVLVYHDILTYGVNRAPKFVKAYANADQLMLKGLQDYADEVRSMNFPDDEHSFTMKEEELKTLYGGRG

SEQ ID NO: 101070 - DNA, 789 bp, Methylobacillus flagellatus KT
  CDS (1)..(789): transl_table=11
atgaacctcctgacactgcagcaaatgaaggagcgcggcgaaaaaatcgctgtactcaccagctacgatgcgagctttgcagcgctcagcgacaaggcaggcgtcgacgtactgctggtcggcgattcgctgggcatgaccatgcaaggccatgccaacaccctggcggtatcgctgcgcgacatggaataccatacccggtgcgttgccaacggcacacagcatgccttcatcgttaccgacatgccgttcggcagcttccagaaaacccctgagcaggcattcgagaatgccgtcctgctcatggcagcaggtgcgcagatggtcaaggttgaaggtggcgccatcatgctggaaaccgtgcgcttcttggtagagcgcggcatccctgtctgtgggcacctcgggttgaccccgcaatcagtgcaccagtttggcggctacagagtccaagcccgggatgaagccgccgcacgtcaactgctagacgatgccaaggcgctggccgccgccggggcaggcatgttggtactggaaatggtgcccgcagcactcgcggccgcggtaagccaggccgtgcatatccccgtgatcggcatcggcgcgggcaaatactgcgacggccaagtattggtgctgcaggacatgctgggcatttacgcaggcaagtcgccgcgcttcgttcgcaacttcatgcaaggcgccggcagcatagagcaggccatttgcgattatgttgccgcagtgaaagcacaaaccttccccggcattgaacacactttcgagtaa

SEQ ID NO: 101071 - protein, 262 aa, Methylobacillus flagellatus KT
MNLLTLQQMKERGEKIAVLTSYDASFAALSDKAGVDVLLVGDSLGMTMQGHANTLAVSLRDMEYHTRCVANGTQHAFIVTDMPFGSFQKTPEQAFENAVLLMAAGAQMVKVEGGAIMLETVRFLVERGIPVCGHLGLTPQSVHQFGGYRVQARDEAAARQLLDDAKALAAAGAGMLVLEMVPAALAAAVSQAVHIPVIGIGAGKYCDGQVLVLQDMLGIYAGKSPRFVRNFMQGAGSIEQAICDYVAAVKAQTFPGIEHTFE

SEQ ID NO: 101072 - DNA, 942 bp, Frankia sp. EAN1pec
  CDS (1)..(942): transl_table=11
atgacttcatcgatcggcaagccccgctcatccagcggccccgccacgcccggaacggagccggcggcgacgctctacggcgcgccgaccacgccccgaaccggtggccaggcgcccgccacaccgaccaccatccggcccgccagccacagccggaccacagtccgcgacatccgcgcagccaaggaccgcggccagcggtgggccatgctcaccgcctacgacgtgatcaccgccgggatcttcgacgaggccggcatcccggtcctcctcgtcggggactccgcggcaaacaccgtctacggctacgagaccaccgtcccgatcaccgtggacgagctggtcccgctggtccgcgcggtggtgcgcggcgcgccacacgcgatggtcgtcgccgacctgccgttcggctcctaccaggcgagccccgagcaggcgctgacgaccgcgacccgcttcctcaaggagggcggggcgcacgcggtcaagctcgagggcggcgcgcgggtgctgccccaggtcggggcgctggtggccgccggcatcccggtgatgggccacctcggcctgaccccgcagagcgtccacgccttcggcggctaccgggtacagggccgcgacggcgccggtgaggtcctgctcgccgacgcactgggcctgcaggaggcgggcgcgttcgccgtcgtgctggaggtcgtccccgccgacctggccgcccgggtgaccaaggagctgctgatctccacggtggggatcggcgccggcgccgactgcgacgcgcaggtcctcgtctggcaggacatggccggcctgaccggcggccaggcgccccgcttcgtcaagcggttcgccgacctgcgcacggcgctcaccgacgccgcggccgcgttccgtgacgaggtgtcgggcggcctctacccgactgtcgagcacagctactga

SEQ ID NO: 101073 - protein, 313 aa, Frankia sp. EAN1pec
MTSSIGKPRSSSGPATPGTEPAATLYGAPTTPRTGGQAPATPTTIRPASHSRTTVRDIRAAKDRGQRWAMLTAYDVITAGIFDEAGIPVLLVGDSAANTVYGYETTVPITVDELVPLVRAVVRGAPHAMVVADLPFGSYQASPEQALTTATRFLKEGGAHAVKLEGGARVLPQVGALVAAGIPVMGHLGLTPQSVHAFGGYRVQGRDGAGEVLLADALGLQEAGAFAVVLEVVPADLAARVTKELLISTVGIGAGADCDAQVLVWQDMAGLTGGQAPRFVKRFADLRTALTDAAAAFRDEVSGGLYPTVEHSY

SEQ ID NO: 101074 - DNA, 810 bp, Moorella thermoacetica ATCC 39073
  CDS (1)..(810): transl_table=11
atggcgcaacgctccagggtaaccctgccccagctccaggccatgaaggagcggggcgagaggattaccatggtaactgcctacgactacccatcctctttactggccgatagggccggtatggatatgatcctggtgggggattccctgggaatggtagtcctgggctattcaagcactgtacctgtaactatggacgagatgatccaccacaccaaagcagtggtgcgggccaatcctgctgccctggtggtggccgatctgcccttcctatcctaccagaccagcgtacccgatgccgtctataacgccggccggttgatcaaggagggcggagccgacgccgtaaaactggaagggggacaggccgtggtgcctacggtccgggccatagtgaacgccggaatcccggttatgggacacctgggtctgacaccccagtcggctgtccagctgggtggtttccgggtccagggacggagcgaggccgaaggggagaagattgccgccgatgcggctgccctggtggaggcaggggtttttgccctggtcctggagtgtgtcccggccgacctggcccgccggataacggccgctttaccggtgccgaccatcggcattggcgccgggccggattgtgacggccaggtgcttgtttaccacgacctcctgggcctctttgaccgttttcgccccaaattcgtcaaacagtacgccaatctcgctgaagcgacagtcgccgccctggaaaaataccgggacgaggtgcgccagggtaaattcccggatcaggagcacagctttaagtaa

SEQ ID NO: 101075 - protein, 269 aa, Moorella thermoacetica ATCC 39073
MAQRSRVTLPQLQAMKERGERITMVTAYDYPSSLLADRAGMDMILVGDSLGMVVLGYSSTVPVTMDEMIHHTKAVVRANPAALVVADLPFLSYQTSVPDAVYNAGRLIKEGGADAVKLEGGQAVVPTVRAIVNAGIPVMGHLGLTPQSAVQLGGFRVQGRSEAEGEKIAADAAALVEAGVFALVLECVPADLARRITAALPVPTIGIGAGPDCDGQVLVYHDLLGLFDRFRPKFVKQYANLAEATVAALEKYRDEVRQGKFPDQEHSFK

SEQ ID NO: 101076 - DNA, 864 bp, Sphingopyxis alaskensis RB2256
  CDS (1)..(864): transl_table=11
atgtctacgctccccaaaacgctcaccctcgacacctccacgagccgcgcaaatccgacgccgcagccgatgaagcgcctgacggttccgcgcatccgccagcgcaaggggggcgaaccgatcgtgatgctcaccgcctatacggtgcgcatggcgcagttgctcgacccgcattgcgacatgctgctggtgggcgattcgctcgcgcaggtgatctatggcctgccgcacaccgtcggggtgacgatggagatgatggcgctgcacggcgccgccgtggtgcgcggcagttaccatgccgcggtgatcgtcgacatgcccttcggcagctatgagggcagcccgcagcaggcctttgacaacgccgcgcgactgctcaaggaaaccggcgccgcggcggtcaaggtcgagggtggcaaggtgcttgctccgacgatcgagttcctgacccagcgcggcattccggtgatggggcatgtcgggctgaccccgcaggcggtgaacatccttggcggttatggcgtgcgcggcaagagcgaggaggaagcgcgctcgatcgtcgaggatgcggttgcggtcgcccaggccggcgccttttcgatcgtcatcgagggcgtactcgaatcgatcgcgatcgaaatcaccaacaaggtcgcatgtccgacgatcggcatcggcgcatcggcgcagtgcgatggccaggtgctcgtcaccgacgacatgctgggcatgttcgagcgtgtacccaagttcgtcaaacgctatcgggacatggcgggcgtcgtcagcggcgccgtgcaggattatgcggacgaagtcaggtcccgttcattcccgaccgaggatcagatctacgcgggctga

SEQ ID NO: 101077 - protein, 287 aa, Sphingopyxis alaskensis RB2256
MSTLPKTLTLDTSTSRANPTPQPMKRLTVPRIRQRKGGEPIVMLTAYTVRMAQLLDPHCDMLLVGDSLAQVIYGLPHTVGVTMEMMALHGAAVVRGSYHAAVIVDMPFGSYEGSPQQAFDNAARLLKETGAAAVKVEGGKVLAPTIEFLTQRGIPVMGHVGLTPQAVNILGGYGVRGKSEEEARSIVEDAVAVAQAGAFSIVIEGVLESIAIEITNKVACPTIGIGASAQCDGQVLVTDDMLGMFERVPKFVKRYRDMAGVVSGAVQDYADEVRSRSFPTEDQIYAG

SEQ ID NO: 101078 - DNA, 795 bp, Shewanella baltica OS155
  CDS (1)..(795): transl_table=11
atgtctaaaattactagctcaaccctgttgaaatacaaacaggaaggtagaaaattcacggcactgacagcctatgatgccagttttgccagcgcgttcgatagcgaaggtgtagatgtgctgctcgtcggcgattctctaggaatggttctccaaggccatgacgataccctgccagtctctacggcggatatcgcttaccatactcgctgtgtccgtcgcggtatcgaacgtgccctgctgatcgccgatatgccctttatgagttacgccacaccagaacaagctatggttaatgccactgagttaatgcaggctggcgcgaacatggtaaaagtcgaaggtggccactggttactcgaaacggtcactaagctaaccgaacgcggtattcccgtgtgtgctcacttagggctaacgcctcagtcagtccatgtgtttggtggttttaaagtgcaaggccgcgacgccgaaaatgcccagcgcatcctcgacgaagcaaaagcattagaagcagccggtgctcaactattggttgtggaatgcattccagcgccactcgcagcggcgatcactcaagccttaacaattccagttattgggattggcgcgggcgcatcgaccgatggccaaattttggttatgcatgatgtgttaggtatttcaagtggttatattccacgtttctcgaaaaactacctaaaacaaaccggtgaaattcgttctgccgtgcgtgcttatatcgacgaagttgcccaaggaacattccctggcgaagaacacacttttaactaa

SEQ ID NO: 101079 - protein, 264 aa, Shewanella baltica OS155
MSKITSSTLLKYKQEGRKFTALTAYDASFASAFDSEGVDVLLVGDSLGMVLQGHDDTLPVSTADIAYHTRCVRRGIERALLIADMPFMSYATPEQAMVNATELMQAGANMVKVEGGHWLLETVTKLTERGIPVCAHLGLTPQSVHVFGGFKVQGRDAENAQRILDEAKALEAAGAQLLVVECIPAPLAAAITQALTIPVIGIGAGASTDGQILVMHDVLGISSGYIPRFSKNYLKQTGEIRSAVRAYIDEVAQGTFPGEEHTFN

SEQ ID NO: 101080 - DNA, 843 bp, Shewanella baltica OS155
  CDS (1)..(843): transl_table=11
atgagcatcgacatgaataaaaaccgggttacgcccgttaccttacagaaaatgaaaggtaaaacgcccatagttgccctcaccgcctatgaaaaaccgatggcggaacttatcgatccccatgttgatatgattatcgtcggcgactccgtcggcatggtggtttatgggcaagactctacgctaggggttaccttagaaatgatgattaaccatggtcttgctgtcactcgcggcgcagcacatgcctgcgtcattatagatatgccctttgggagttatcaagaatcgcctctgcaagcctttagacatgccagccaagtattaatacgtactggcgcgcaggcggtaaaactcgagggtggcgcagagatgctcgacaccactcgctttttaacccagcgaggcatccctgtgatgccacacataggattgatgccacaacacgtcaatcaattaggtggatttaaaacccaagcaagggatgcaacggccatcgaagcgctcgttcgtttagcgaaagactttgagcaagctggcgcttttagcatactgattgaaggcacatccgaactcgcggcgcgcacagtaacggcagaagtctcaatccccgtaatcggcattggcgcctcacccgcctgcgatggtcaagtgctcgtgactgaggacattttaggcttattttctgactacacgcctaaatttgccaaacgctatatcgacctaagccccttaatcactcacgcctgcgccgaatacgccagagaagtgagaagcgctgaatttccaacaacagagcattgttttggcctcagccaaacgaccaagattacagcagattaa

SEQ ID NO: 101081 - protein, 280 aa, Shewanella baltica OS155
MSIDMNKNRVTPVTLQKMKGKTPIVALTAYEKPMAELIDPHVDMIIVGDSVGMVVYGQDSTLGVTLEMMINHGLAVTRGAAHACVIIDMPFGSYQESPLQAFRHASQVLIRTGAQAVKLEGGAEMLDTTRFLTQRGIPVMPHIGLMPQHVNQLGGFKTQARDATAIEALVRLAKDFEQAGAFSILIEGTSELAARTVTAEVSIPVIGIGASPACDGQVLVTEDILGLFSDYTPKFAKRYIDLSPLITHACAEYAREVRSAEFPTTEHCFGLSQTTKITAD

SEQ ID NO: 101082 - DNA, 840 bp, Shewanella amazonensis SB2B
  CDS (1)..(840): transl_table=11
ttggcttataactccacttcacactcgctggtagagaaacgcattatgtccaaagtcaccacctcaaccctgatgaagtttaaacaggaagggaaaaagttcaccgcgctgaccgcttatgatgccagttttgccgccgcttttgacagtgagggcgttgatgtcctgctggtgggcgactcactgggcatggtactgcaggggcacgaggataccttgccggttactgtgcaagacattgcctatcacacccgctgtgtgcgtcgcggtatttcccgcgcactgctgatagccgatctgccctttatgagttacgccaccgtggagcagaccatgaccacggccaccgccctgatgcaggccggtgccaacatggtgaaactggaaggcggtgaatggctgctggaaagcgtgaaaaagctcaccgagcgtggcgtgcccgtgtgtgcccacatcggcctgacgcctcagtctgtgcacgtgtttggtggctttaaggtacagggccgcgatgccgacaacgcccagcgtatcttgaatgaagccaaggcactggaagccgcaggcgcccagctgctggtaattgaatgtattccggcgtcgctggcaaaggccattaccgaggccctgagcattcctgtgattggtattggtgccggcaaagacaccgatggccagattttggtaatgcacgatgtgcttggcatctccagcggctatattccgcgcttctccaagaattacctcaagcagaccggtgagatccgcgctgcggtacgcgcctttattgacgaagtggccgatggcagcttccctggcccagaacatacctttaattga

SEQ ID NO: 101083 - protein, 279 aa, Shewanella amazonensis SB2B
MAYNSTSHSLVEKRIMSKVTTSTLMKFKQEGKKFTALTAYDASFAAAFDSEGVDVLLVGDSLGMVLQGHEDTLPVTVQDIAYHTRCVRRGISRALLIADLPFMSYATVEQTMTTATALMQAGANMVKLEGGEWLLESVKKLTERGVPVCAHIGLTPQSVHVFGGFKVQGRDADNAQRILNEAKALEAAGAQLLVIECIPASLAKAITEALSIPVIGIGAGKDTDGQILVMHDVLGISSGYIPRFSKNYLKQTGEIRAAVRAFIDEVADGSFPGPEHTFN

SEQ ID NO: 101084 - DNA, 834 bp, Pelodictyon phaeoclathratiforme BU-1
  CDS (1)..(834): transl_table=11
atgaacaaaagtgcccaacaaaaatcggctcatgttaccacccgaaggctgctcgatatgaagcataacggggagaagatctccatgcttacggcttatgattacaccatggcgagaattcttgatcgtgctggtcttgatgttcttctggtcggcgattccgcaagcaatgtttttgccggccatagtacaacgttgccgattacgattgaagagatggtctatcacgcgaaggctgttgtcaggggagtgcacgacgaaagcggtcgggcaatggtggtcgttgatatgccgttcatgagctatcagatttcaggtgatgaggctttgcgcaatgcgggaaagatcatgaaggagcatgggtgtgatgctctcaagctggagggaggcaagatcattgccgataccgtcaagcggattaccgacgtcgggattcccgtcatgggccatctcggtctgatgccgcaatctatatacaagtatgggagttacaaggtcagggccaaggaaggggtggaagcagagcagctccttgaggatgcaaaaattatcgaagaggcgggagcgtttgccattgtactcgaaaaaattccatctgtgcttgcagccgaagtgacccgctcactgactattcctaccataggcatcggcgccggggttgcatgtgatggccaggtgcttgtcatcaacgatattcttggtctcaaccgcgagttccatccccgttttgtccgccaatacgccgatttgaatacggttattgaacacgccgccaagcaatacgtcgaagacgtccgccagtcaaatttcccctcccccgacgaaagttattaa

SEQ ID NO: 101085 - protein, 277 aa, Pelodictyon phaeoclathratiforme BU-1
MNKSAQQKSAHVTTRRLLDMKHNGEKISMLTAYDYTMARILDRAGLDVLLVGDSASNVFAGHSTTLPITIEEMVYHAKAVVRGVHDESGRAMVVVDMPFMSYQISGDEALRNAGKIMKEHGCDALKLEGGKIIADTVKRITDVGIPVMGHLGLMPQSIYKYGSYKVRAKEGVEAEQLLEDAKIIEEAGAFAIVLEKIPSVLAAEVTRSLTIPTIGIGAGVACDGQVLVINDILGLNREFHPRFVRQYADLNTVIEHAAKQYVEDVRQSNFPSPDESY

SEQ ID NO: 101086 - DNA, 834 bp, Prosthecochloris aestuarii DSM 271
  CDS (1)..(834): transl_table=11
atgaataagcagagcacgcaaaaactgccccacgtcacaacacgacgtcttcatgatatgaaatcagaaggtgagaaaatttcaatgctcactgcatatgattatacaacggccagaattcttgatcgcgccggtgtcgatgttattcttgttggtgattcggcaagcaatgtttttgccggtcacaatacgacgctgcctattaccatcgatcagatgatctaccatgcaagagctgttgtcaggggagttcaggctgaaaccagcagagcgatggttgtgatcgatatgccgttcatgagttatcagctctcgagcgaagaggctttgcgcaatgcgggtaagatcatgaaggagaatgagtgtgatgctgtcaaaatcgaagggggaaacgttattgtcgatacggtaaagaggataaccgatgtcggtatcccggtcatgggacacctgggcctgattccgcagtcgatctataagttcggaagctataaggtgcgtgcacgagaagaacaggaggccgaagagcttcttcgtgatgcgaaactgcttgaagaggcaggggcctttgctcttgttcttgaaaaaattccggcggaccttgccgcagaggtgaccgcttcgatctcgattccaacgataggtatcggtgcggggggggcgtgcgatggtcaggttctggttatcaacgatatgcttggtttgagtaccgaatttcatccccgcttcgttcgcaggtatgctgaactcgatcgtgttatattcgatgccgtcagccgctatgtcgatgatgtccggggcgggacgtttccgggggaagatgaaagctactga

SEQ ID NO: 101087 - protein, 277 aa, Prosthecochloris aestuarii DSM 271
MNKQSTQKLPHVTTRRLHDMKSEGEKISMLTAYDYTTARILDRAGVDVILVGDSASNVFAGHNTTLPITIDQMIYHARAVVRGVQAETSRAMVVIDMPFMSYQLSSEEALRNAGKIMKENECDAVKIEGGNVIVDTVKRITDVGIPVMGHLGLIPQSIYKFGSYKVRAREEQEAEELLRDAKLLEEAGAFALVLEKIPADLAAEVTASISIPTIGIGAGGACDGQVLVINDMLGLSTEFHPRFVRRYAELDRVIFDAVSRYVDDVRGGTFPGEDESY

SEQ ID NO: 101088 - DNA, 822 bp, Ralstonia metallidurans CH34
  CDS (1)..(822): transl_table=11
atgagttacctcctcgatccctcccgcaagaccgtcaccatccccaaactgcaggccatgcgtgaagccggcgaaaagatcgccatgctcaccgcctacgattccagcttctccgcgctgctcgatctctgcggcgtggaagtgatcctggtcggcgattcgctcggcaacgtgatgcagggccagcagaccacgctgcccgtcacgctcgagcacatggtctatcacaccgaatgcgtgtcgcgcggcaaccagaccgcgctgctcgtatccgacctgccgttcggcacgtatcccacccccgagaaggccttcgaaagcgccgccgcgctgatgcgtgctggcgcgcagatggtcaagctcgaaggcggagactggctggcgccgacggtgaagttcctggtcgagcgcagcattccggtatgcgcgcatatcgggctgacaccgcaatcggtacacgcgctcggcggcttcaaggtgcagggcaagaccgacgagagcgccgcgcagctgaagcgtgacgcgctggcgctgcagcaagccggcgcgcagctgatcgtcatggaggccgtgccggccaagctcgccgccgaagtgacggcgcaactctccatcccgaccatcggtatcggcgctggtgtcgattgctcgggccaggtgctggtgctgcaggacatgatcaacatctacccgggccgcaaggccaagttcgtacgcaacttcatggagggacagccctcgatcgaagcggcgatccgcgcctatgtggctgctgtgaaggacggcagcttcccggccgtcgagcacacgttctcggcctga

SEQ ID NO: 101089 - protein, 273 aa, Ralstonia metallidurans CH34
MSYLLDPSRKTVTIPKLQAMREAGEKIAMLTAYDSSFSALLDLCGVEVILVGDSLGNVMQGQQTTLPVTLEHMVYHTECVSRGNQTALLVSDLPFGTYPTPEKAFESAAALMRAGAQMVKLEGGDWLAPTVKFLVERSIPVCAHIGLTPQSVHALGGFKVQGKTDESAAQLKRDALALQQAGAQLIVMEAVPAKLAAEVTAQLSIPTIGIGAGVDCSGQVLVLQDMINIYPGRKAKFVRNFMEGQPSIEAAIRAYVAAVKDGSFPAVEHTFSA

SEQ ID NO: 101090 - DNA, 807 bp, Magnetococcus sp. MC-1
  CDS (1)..(807): transl_table=11
atgaaaaaacgcgtgcgggtaccggatctggtacgcatgaaacagcagggcgagcccattgtggccctgaccgcctatgattacaccctggcccgcttggtggacgccgccgatgtggatctggtactggtaggggattcgctgggtatggtggtacaggggcacgaaaccaccctgcccgtcaccctggatgagatgatctatcacacccgcgccgttgcgcggggttgccaacgcgccttggtggtgctggatatgccctttggctcgacccaaaacggcccagagcgcacctttgaacaggccgcacgggctatgaaagagagcggtgccgccgccattaagctggagggggggcaggctatggccgccacggtggcctatttgactgaacgcgccatccccgtcattggccatttgggactcaccccccaatcggtccacgcctttggtggctttaagatccaggggcgtgaccaagccgccgcccagcgcatcgccgacgacgccctcgccctacaacaggccggggcaggagccattattctggagggcatacctgcggcactggcccaacaggtaagccaatccctgaccattcccaccattggtatcggtgccggggtggggtgcgatgggcaggttttggttatctatgatatgctgggactgtatggcgatctggcccccaaatttgtcaaacgctatcttgatggggtacccgtcatagggggtgccattggggcctatgtgcaagaggtccgcaaccgccaattccccaccccagaccatagctttgagaagtag

SEQ ID NO: 101091 - protein, 268 aa, Magnetococcus sp. MC-1
MKKRVRVPDLVRMKQQGEPIVALTAYDYTLARLVDAADVDLVLVGDSLGMVVQGHETTLPVTLDEMIYHTRAVARGCQRALVVLDMPFGSTQNGPERTFEQAARAMKESGAAAIKLEGGQAMAATVAYLTERAIPVIGHLGLTPQSVHAFGGFKIQGRDQAAAQRIADDALALQQAGAGAIILEGIPAALAQQVSQSLTIPTIGIGAGVGCDGQVLVIYDMLGLYGDLAPKFVKRYLDGVPVIGGAIGAYVQEVRNRQFPTPDHSFEK

SEQ ID NO: 101092 - DNA, 846 bp, Mesorhizobium sp. BNC1
  CDS (1)..(846): transl_table=11
atgagtgcaaccggaggagcgaaatccttcaccccgccggacatcgccaaggccaaaggcaaggcgccgatcgtttgtctcactgcctacacgacgcccattgcgcgccttctcgatccgcattgcgacgtggttctcgtgggcgacagcgtgggcatggtgatgcacgggctgccctccacgctgggcgtgacgctggacatgatgatcatgcatgggaaagcggtgcgccgaggcctggaaagggccttgatggtcgtcgacatgcccttcggcagctatgaggaagggccggaacaggcttttcgcaatgcagcacgcgtgatggcggagaccggctgcgcggctgtcaagctcgaaggcggagagagcatggccgagacgatccgcttcctgaccggccgtggcataccggtgatggcccatgtgggtctgacgccacaggccgtgaacgctttcggcggttatcaggtccaaggacggggcgaagacggcgaccgcgtgatgcgtgacgcgcaagcagtggccaaggccggcgccttctccgtggtcctggaaaaggtgcccgagccgctcgcccgccggatcaccaaggaaatccctatccccaccatcggcatcggggcttcccccgcctgcgacgggcaggttttggtggtagacgacatgctcgggatgttcaccgatttccgcccgaaattcgtcaagcgctatgcggaactggcggaagccgccgaggccggaatcgccgcctatgcaaaagatgtgcggcagcgccgttttccggcgccggaacatgtattcagcgatatgcccaagccggtgaagggaggcgaggcagcgtga

SEQ ID NO: 101093 - protein, 281 aa, Mesorhizobium sp. BNC1
MSATGGAKSFTPPDIAKAKGKAPIVCLTAYTTPIARLLDPHCDVVLVGDSVGMVMHGLPSTLGVTLDMMIMHGKAVRRGLERALMVVDMPFGSYEEGPEQAFRNAARVMAETGCAAVKLEGGESMAETIRFLTGRGIPVMAHVGLTPQAVNAFGGYQVQGRGEDGDRVMRDAQAVAKAGAFSVVLEKVPEPLARRITKEIPIPTIGIGASPACDGQVLVVDDMLGMFTDFRPKFVKRYAELAEAAEAGIAAYAKDVRQRRFPAPEHVFSDMPKPVKGGEAA

SEQ ID NO: 101094 - DNA, 831 bp, Kineococcus radiotolerans SRS30216
  CDS (1)..(831): transl_table=11
atgacctacgccaccgagccgccgccccccgtcccgggccggcgccgcacccgcgtccaccacttccagcagtggaaggacgcgggcgagaagtgggcgatgctcaccagctacgacgcgatgaccgcggccgtcttcgacgaggccggcatcccggcgctgctggtcggggactcggccgccaacaccgtcttcgggatgccgacgacgctgccggtgaccctcgaccacctgctgccgctggtgcgggccgtggtggccggcgcgccgcacgcgttcgtcgtcgccgacctgcccttcgggtcctacgaggtctccgacgacctcgccgtcgcctccgcggtgcgggtcatgaaggagggcggcgcgcacgcggtgaagttcgagggcggggcccggcgggcgggccgggtccgggccgtcgtcgaggcgggcatccccgtcatggcccacatcggcttcaccccgcagtccgagcacgccctcggcggctaccgggtgcagggccgcggcgaggcgggcgagcaggtcctggccgacgcccgggcgctggccgaggccggcgcgttcgcggtgctcatggagatggtccccgccgacgtcgccgcgcaggtcacccgcaccctggccgtgcccaccgtcggcatcggggcgggctccgggaccgacgggcaggtcctggtgtggcaggacttcgcggggctgtccgagcggacggcgaagttcgtcaagcggttcgccgacgtgcgcaccgccctctccgacgcggcgcgccagtacgccgaggaggtccgcggcgggtccttcccggggcccgagcactccttctga

SEQ ID NO: 101095 - protein, 276 aa, Kineococcus radiotolerans SRS30216
MTYATEPPPPVPGRRRTRVHHFQQWKDAGEKWAMLTSYDAMTAAVFDEAGIPALLVGDSAANTVFGMPTTLPVTLDHLLPLVRAVVAGAPHAFVVADLPFGSYEVSDDLAVASAVRVMKEGGAHAVKFEGGARRAGRVRAVVEAGIPVMAHIGFTPQSEHALGGYRVQGRGEAGEQVLADARALAEAGAFAVLMEMVPADVAAQVTRTLAVPTVGIGAGSGTDGQVLVWQDFAGLSERTAKFVKRFADVRTALSDAARQYAEEVRGGSFPGPEHSF

SEQ ID NO: 101096 - DNA, 843 bp, Silicibacter sp. TM1040
  CDS (1)..(843): transl_table=11
atgagcgcatcatcgcaaaaaacggccctaacggccgaagacatccgggccatgaaagggcggaccccgattgtcagcctcacggcttataccacaccgatggcgcagctgatggatgaacattgcgattttgtactggtcggggacagcgtcggcatggtgttgcatgggctgccgtcgacgcttggggtcacgatggagatgatgatcctgcacggtgctgccgtcgctcgcggcctgaagcgcgcgatgatggtgatcgacatgcccttcggaagctacgaacaatcgccagcgcaggcctttgcgaatgccgcccgtctgatggcggaaaccggtgcggcggctgtcaaactcgaaggcggcgaagagatggccgacaccatccgctttctcgtgaaacgcggtattcccgtgatggcgcatatcgggctcacgccgcagtcgatcaacacgctgggcggctacaaggtgcagggccgcgacgacgctgccaaaccccttatcgccgatgcccgcgcggttgctgaggccggggcctttgcggtggttctggaaaaagtcccggcaagccttgccgatcaagtgactgagatcgtcgacattcccaccatcggcatcggggcctctgcgggctgtgatggccaggtgctggtggtggatgacatgcttggcttttttggcgccttcaagccgaagttcgtcaaacgctacgccgagcttggccccgccgccgaagaagcaatcgcagactacgcctccgaggtccgcgcgcggcgttttcccagtgcagaacacacctttgcggaccacgcgccgcaaaaagcccctcaacaagactga

SEQ ID NO: 101097 - protein, 280 aa, Silicibacter sp. TM1040
MSASSQKTALTAEDIRAMKGRTPIVSLTAYTTPMAQLMDEHCDFVLVGDSVGMVLHGLPSTLGVTMEMMILHGAAVARGLKRAMMVIDMPFGSYEQSPAQAFANAARLMAETGAAAVKLEGGEEMADTIRFLVKRGIPVMAHIGLTPQSINTLGGYKVQGRDDAAKPLIADARAVAEAGAFAVVLEKVPASLADQVTEIVDIPTIGIGASAGCDGQVLVVDDMLGFFGAFKPKFVKRYAELGPAAEEAIADYASEVRARRFPSAEHTFADHAPQKAPQQD

SEQ ID NO: 101098 - DNA, 828 bp, Nitrobacter hamburgensis X14
  CDS (1)..(828): transl_table=11
atgtcggtccagtcggcgatcaggcgcaggacagcacccgacattcgcgctcgcaagaacggcgatccgatcgtgatgctgacctcgtatcacgcccataccgcggcgctggtcgaccgccattgcgacgtcattctggtcggcgacagcctcggcaacgtgatgcacggtttcgagaccacggtgccggtcacgctggacatgatgatcctgcagggccgcgcggtgatgcgcgggtcgcaacaggcgctggtcgtggtggatatgccgttcggctcctacgaggcctcgaaggagcaggcttttcattccgccgcacgcattctcaaggagacgctctgtggcgcggtgaaactcgaaggcggcgtgaagatggcggagaccatcgcgtttctcaccgcgcgcggcgttcccgtgatggggcatgtcggcctgacgccgcaatccatcaacacgctgggctcgtttcgcgcgcagggacgcgaggagggaacgtggcggccgatcgaggacgatgcgcgtgccgtggcggaggccggcgcattctcgatggtgatcgaggcggtcgcagagcccttggcgcgcaagattacggaaagcgtggcgatcccgaccatcggcatcggcgccagccccgcttgtgacggccaggtgttggtgctggaggacatgctcgggttgtcgccgcgcgcgccgaaattcgtccggcgctatggcgaactcggccccatgatcgaggccgcgatcgaaggctatgcgcgcgatgtgcgtagccgcgcctttcccggcccggaacacgtttatgcgatgaagccgaaggccagctag

SEQ ID NO: 101099 - protein, 275 aa, Nitrobacter hamburgensis X14
MSVQSAIRRRTAPDIRARKNGDPIVMLTSYHAHTAALVDRHCDVILVGDSLGNVMHGFETTVPVTLDMMILQGRAVMRGSQQALVVVDMPFGSYEASKEQAFHSAARILKETLCGAVKLEGGVKMAETIAFLTARGVPVMGHVGLTPQSINTLGSFRAQGREEGTWRPIEDDARAVAEAGAFSMVIEAVAEPLARKITESVAIPTIGIGASPACDGQVLVLEDMLGLSPRAPKFVRRYGELGPMIEAAIEGYARDVRSRAFPGPEHVYAMKPKAS

SEQ ID NO: 101100 - DNA, 831 bp, Paracoccus denitrificans PD1222
  CDS (1)..(831): transl_table=11
atgagcgcgacccctgatcgcaagggccagcttggccccggtgacatccgtgcccgcaagggcggcgaacccgtggtttgcctgaccgcctataccacgcccatggcccggctggtcgatgcgcattgcgacatcgctctggtcggcgacagcctgggcatggtgctgcatggcctgccctcgaccatcggcgtcagcatggagatgatgatcctgcacggcaaggcggtggcgcggggctgctcgcgcgcctgcatcgtggtggacatgcccttcggcagctatgaagaggggccggagcaggcgttccgcaacgccgcgcggctgatggccgagaccggctgccaggcggtcaagctggagggcgggcgccacatggccgagacggtggccttcctggtcgcacgcggcattccggtgatgggccatgtcgggctgacgccgcaatcggtcaatacgctgggcggctacaaggtgcagggccgcggccatcacgaggccgaccgcatcgccgccgatgccgcggcgctggcggatgccggcgcctttgccgtggtgctggaaaagctgcccgaggcgctggggcggcgcatcacgcaagagatcgccgtgccgaccatcggcatcggcgccggcctcgattgcgacgggcaggtgctggtggtcgacgacatgctggggctgttctcggatttccggccgaaattcgtcaagcgctatgccgagctgggccaggatgccgatgccgccatcgccgcttatgccgccgaggtccgcgcccgccgctttcccggtcccgagcatgtcttcggcgagggcaagcccgcatga

SEQ ID NO: 101101 - protein, 276 aa, Paracoccus denitrificans PD1222
MSATPDRKGQLGPGDIRARKGGEPVVCLTAYTTPMARLVDAHCDIALVGDSLGMVLHGLPSTIGVSMEMMILHGKAVARGCSRACIVVDMPFGSYEEGPEQAFRNAARLMAETGCQAVKLEGGRHMAETVAFLVARGIPVMGHVGLTPQSVNTLGGYKVQGRGHHEADRIAADAAALADAGAFAVVLEKLPEALGRRITQEIAVPTIGIGAGLDCDGQVLVVDDMLGLFSDFRPKFVKRYAELGQDADAAIAAYAAEVRARRFPGPEHVFGEGKPA

SEQ ID NO: 101102 - DNA, 795 bp, Shewanella denitrificans OS-217
  CDS (1)..(795): transl_table=11
atgtcaaaagtcactagctctaccctgttgaaatttaagcaagaaggcactaaattcacctcgataacggcatatgacgcaagctttgctgccgcctttgacagcgaagggatagacgccattttggtgggagactctttaggcatggtactccaaggccatgatgacaccttacctgtgaccacagctgacgtggcatatcacacagcttgcgtgcgccgggggatcagccgtgcactgctcatcgccgacatgccttttatgagctatgctaccccagagcaagccatgaccaatgccaccaccttaatgcaagcgggtgccaatatggtcaaacttgaagggggtcattggctactcgaaactgtcaccatgctgacccaaagagggatccctgtctgtggtcacttaggcttaacgccacaatctgtgcatgtatttggcggctttaagatgcaaggtaaagacgagaaaaatgcccagcgcatcttagatgaagccttagccttgcaagatgcgggggctcagttgttagtacttgaatgcatcccagcagccttagccaaaaccattactcaagccgtggctattccagtaataggcataggtgcaggggccgataccgacggtcaaatcttggtgatgcatgatgtgctagggatcaccagcggctatattcccaaattttcgaaaaactatctaaagcaaactggtgaaatccgttcagccatcaaggcttatattgatgaagtcgccgccggcgatttccccagtgaagaacacaccttagtgtaa

SEQ ID NO: 101103 - protein, 264 aa, Shewanella denitrificans OS-217
MSKVTSSTLLKFKQEGTKFTSITAYDASFAAAFDSEGIDAILVGDSLGMVLQGHDDTLPVTTADVAYHTACVRRGISRALLIADMPFMSYATPEQAMTNATTLMQAGANMVKLEGGHWLLETVTMLTQRGIPVCGHLGLTPQSVHVFGGFKMQGKDEKNAQRILDEALALQDAGAQLLVLECIPAALAKTITQAVAIPVIGIGAGADTDGQILVMHDVLGITSGYIPKFSKNYLKQTGEIRSAIKAYIDEVAAGDFPSEEHTLV

SEQ ID NO: 101104 - DNA, 795 bp, Shewanella frigidimarina NCIMB 400
  CDS (1)..(795): transl_table=11
atgtcaaaagtcaccagttcgaccctgatcaagttcaaacaagaaggtaaaaagttcaccgcattaacggcttatgacgctagttttgccggcgcatttgacagtgaaggtgtggatgtacttttagtgggtgattcactcggtatggtgcttcaaggccataacgataccctaccagtaaccattgccgatattgcttaccataccgcttgtgttaaacgtggtgttgcgcgcgcattactcatcgcagacatgccgtttatgagttatagcaccccagagcaaaccatgaataacgcggcaatattaatgcaggcaggtgccagcatggtcaaattagaaggtggacattggctacttgaaagcgtaaaaatgttaaccgaacgtggtattccagtttgtgctcacctaggattaacaccacagtcggtgaacgtttttggcggatttaaagtgcaaggtcgcgatgccgataacgcgcaacgcattctagatgaagctaaagcattgcaagctgctggtgcgcaattattagtggttgagtgtattccagccccactggctaaagccattactgaagcactaaccattccagttattggtatcggcgctggtgctgacaccgatggtcaaatacttgttatgcatgatgtgttaggcatttcgagtggctacattccccgtttttcaaaaaactacctcaaacaaaccggcgaaattcgctcggctatcagagcctatattgatgaagttgctaacggcacattccctgctgaagaacatacctttaattag

SEQ ID NO: 101105 - protein, 264 aa, Shewanella frigidimarina NCIMB 400
MSKVTSSTLIKFKQEGKKFTALTAYDASFAGAFDSEGVDVLLVGDSLGMVLQGHNDTLPVTIADIAYHTACVKRGVARALLIADMPFMSYSTPEQTMNNAAILMQAGASMVKLEGGHWLLESVKMLTERGIPVCAHLGLTPQSVNVFGGFKVQGRDADNAQRILDEAKALQAAGAQLLVVECIPAPLAKAITEALTIPVIGIGAGADTDGQILVMHDVLGISSGYIPRFSKNYLKQTGEIRSAIRAYIDEVANGTFPAEEHTFN

SEQ ID NO: 101106 - DNA, 792 bp, Thiomicrospira denitrificans ATCC 33889
  CDS (1)..(792): transl_table=11
atggcaaaaaaaatgacaataacatctattaaaaaaagcaaaggggtacaccctttagttatgataactgcttatgatgctctttttgcaagacttttagagccaagtgcagatatgattttagtaggcgatagtttaaatatgagctttgctggaagagatgatactctaagtgcaacactctctcagatgatatatcatacaaatgccgttgcaaaaggggcaaaaaatagttttataatttgtgatatgccttttggaacttatacaaacagagatgatgctcttaaaaatagtattaaagtttttcaagaatcaagcgctgatgcccttaagatagagggtggagaggataaggcagagataattagccatctctgctcaaatggaatcgctgtgtgcgggcatattggactcttaccacaagcttttagaagtgagggcgggtacaaagtaaaaggaaaaacagatgaggagagaattcaactcataagagatgctaaagccatagagaaggctggcgctttttgtatggtaatagagggagtaaaggctgatgttgccgctcaagttgctgcaagtgtaaaaatcccagttataggaattggcgctggcagagatgtggatggacaagttcttgtattttctgacatgttgggactatttgaagagtttactccaaagtttgtaaaaaaatatctagatggtgcatctttggttaaagaggcattaaaaagttatgccgatgaggttaaaacaagagcgtttcctcaagatatccacacctactaa

SEQ ID NO: 101107 - protein, 263 aa, Thiomicrospira denitrificans ATCC 33889
MAKKMTITSIKKSKGVHPLVMITAYDALFARLLEPSADMILVGDSLNMSFAGRDDTLSATLSQMIYHTNAVAKGAKNSFIICDMPFGTYTNRDDALKNSIKVFQESSADALKIEGGEDKAEIISHLCSNGIAVCGHIGLLPQAFRSEGGYKVKGKTDEERIQLIRDAKAIEKAGAFCMVIEGVKADVAAQVAASVKIPVIGIGAGRDVDGQVLVFSDMLGLFEEFTPKFVKKYLDGASLVKEALKSYADEVKTRAFPQDIHTY

SEQ ID NO: 101108 - DNA, 819 bp, Xylella fastidiosa Dixon
  CDS (1)..(819): transl_table=11
atgagcatatataccaatagcaaaccttggacggtgcctgctttggcggaggccaagcgaaacggttctaaaatcgtgatgttgactgcttatgatgctgggtttgctcgtattcttgacgcaaacggcgtagacctagtccttgttggcgattcgttgggaatggtggtacagggccatgactcgactcttccggtgagtgtgcatgacatggtgtaccacactgcgtgtgtggctcggggggtacgtcaggcaatgcttgtggttgatttgccatttcaggctgatgcgtcgccggaacgtgcgctagaggctgccactgcattactgcgagtgggggcacagatgatcaaaatcgaaggtgctgggcacaagcttgaggtgattagttacttggttgagcgtgagattccggtgtgttcgcacttggggctgactccgcaatcggtactgcgtttgggaggttataaggtgcaaggacgtggtgaggaggctgggggccgtttgcgtgccgaggcacgtgcggcggtggaggctggtgctactcttttgctattggagtgtgtgccgtcgcagttggcagcgcagattactaccgatgtatcggtgccgacgattggtattggtgccggtgctggttgtgatggccaagtgctggtgctgcatgatctccttggtctagacagcggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 101109 - protein, 272 aa, Xylella fastidiosa Dixon
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATALLRVGAQMIKIEGAGHKLEVISYLVEREIPVCSHLGLTPQSVLRLGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 101110 - DNA, 801 bp, Psychrobacter cryohalolentis K5
  CDS (1)..(801): transl_table=11
atgacaacgttatctactttaaataagtttaaaaaagacggtaccaaatttacttgtctgacctgttatgacgccatgtttgcgcgcatgatggaaaaagcgcagattgatacgattttaatcggtgatagcttgggtatggtggtgcagggtcatgattcaactttgcctgttacggtcgatgatatggcttaccacactgctaatatcgcccgtagcaataaacaggcgcttattttagcggacttaccctttatgagttatgtgacgctgcctgaggccgttgttaatagccgcaagctgatgcaggcaggcgctcatgtgattaaaattgagggtggttgtgagctttgcgagttgattacaacattggcgcaagcaggtacgccaacgtgcgtgcatttaggcttaacaccgcagtcggtaaacgtttttggcggttataaagtccaaggtcgcggcaatgaagcaggtcaaaaactccttgatgatgcaaaagctgtggttgacgctggtgcagcgcttttggtactagaatgcgtccctgctgagcttgctaaagcagtaacggaagccgttgctgtgccagtgataggcatcggggcaggcgccgataccgatggtcaagtattggtcatgcacgatatgctcggtatggttcatggtcgcgcgccgcgttttatccatgattttttgactgatgagcgtaacactgagcacagtatcgaaggcgcatttgccttgtatcagcagtcagtaaaggaaggtagttttccaacagagcagcaccagtttagctaa

SEQ ID NO: 101111 - protein, 266 aa, Psychrobacter cryohalolentis K5
MTTLSTLNKFKKDGTKFTCLTCYDAMFARMMEKAQIDTILIGDSLGMVVQGHDSTLPVTVDDMAYHTANIARSNKQALILADLPFMSYVTLPEAVVNSRKLMQAGAHVIKIEGGCELCELITTLAQAGTPTCVHLGLTPQSVNVFGGYKVQGRGNEAGQKLLDDAKAVVDAGAALLVLECVPAELAKAVTEAVAVPVIGIGAGADTDGQVLVMHDMLGMVHGRAPRFIHDFLTDERNTEHSIEGAFALYQQSVKEGSFPTEQHQFS

SEQ ID NO: 101112 - DNA, 888 bp, Nocardioides sp. JS614
  CDS (1)..(888): transl_table=11
atgacgtcagggagagccatgagccccgaggagacggcgccgtacggcaccggtccggcccgtgcggagagcgcgccggacgcacccgcaccgatcaagcggatccgcacccaccacctgcgcgagatgaagcagcgcggcgagaagttcgcgatgctcaccgcctacgagcagtacgccgcgcagaccttcgacgaggccggcatcgaggtgctgctggtcggcgacagcgcgtcgaacaacgtgttcgcgaacgagacgtcgctgccggtgaccgtcgacgagctgatcccgctggcgcgggccgtcagccggtcggtacgccgggcactggtggtcgccgacctgccgttcggctcctaccaggcctccccggagcaggcctacctgaccgccgtgcggttcatgaaggaggcgaacgcgcacgcggtcaagctcgagggcgggatcgagatggccccccaggtccgcaagctcaccgagggcggcatcccggtgatggcccacatcggcttcaccccccagtccgagcacaacctgggtggctaccgggtccagggccgcggcgaggcggcggcccgggtcgtcgcggaggcggtggcgatggagcaggccggtgccttcgccgtcgtgatggagatggtccccggcgacgtcgccgcggaggtgaccaagtcggtgtcgatccccacgatcgggatcggcgccgggctcgactgcgacgggcaggtgctggtctggcaggacgccttcggcctgcgcaccggccggatgccgcgcttcgtcaagcagtacgccgacctgcacggcgtactcctccaggccgcccgcgactacgccgccgacgtcaaggccggcaccttccccggccccgagcacaccttctga

SEQ ID NO: 101113 - protein, 295 aa, Nocardioides sp. JS614
MTSGRAMSPEETAPYGTGPARAESAPDAPAPIKRIRTHHLREMKQRGEKFAMLTAYEQYAAQTFDEAGIEVLLVGDSASNNVFANETSLPVTVDELIPLARAVSRSVRRALVVADLPFGSYQASPEQAYLTAVRFMKEANAHAVKLEGGIEMAPQVRKLTEGGIPVMAHIGFTPQSEHNLGGYRVQGRGEAAARVVAEAVAMEQAGAFAVVMEMVPGDVAAEVTKSVSIPTIGIGAGLDCDGQVLVWQDAFGLRTGRMPRFVKQYADLHGVLLQAARDYAADVKAGTFPGPEHTF

SEQ ID NO: 101114 - DNA, 834 bp, Prosthecochloris vibrioformis DSM 265
  CDS (1)..(834): transl_table=11
atgaaagagaacgcagagcagaaatcgggacatgtgaccacaagacggctgcttgacatgaagcagaacggagaaaagattgcagtgctgaccggctatgactataccattgcgcggattctcgaccgggccggcattgatgtgattcttgtcggtgattcggccagcaatgtgttttcgggtcacacgaccacgcttcccattaccgtcgatgagatgatctatcatgccagggcagttgtgaaaggtgtgcagtctgctacaagccgggcgatggttgttgttgacatgcctttcatgagttatcagctttcggaagaggaggctctgcgcaatgcgggcagaataatgaaggaacatgagtgcgatgccgtcaaaatggagggaggaagctccattgccgcaaccgtcaggagaatcaccgatgcaggtattcctgttatgggtcatctggggctcatgcctcagtccatctacaagtatggcagttacaaggtgcgggcgcaggagggggcggaagccgaagagctgatgaaggatgctcgcctgcttgaagagtcgggggcttttgccgtggtggttgaaaaaatcccttcggcccttgccggagaaattgccagatcgctgaccattcctgtcattggaattggagccggtgtagagtgtgacgggcaggtgctcgtcattaatgacatgctcggcctcaacagggagtttcatccaaggtttgtgcgccagtatgccgatttgaacacgattatagaagatgccgtcggccggtatcttgaggatgtgcggagcggagatttcccttcgcctgaagagagttattga

SEQ ID NO: 101115 - protein, 277 aa, Prosthecochloris vibrioformis DSM 265
MKENAEQKSGHVTTRRLLDMKQNGEKIAVLTGYDYTIARILDRAGIDVILVGDSASNVFSGHTTTLPITVDEMIYHARAVVKGVQSATSRAMVVVDMPFMSYQLSEEEALRNAGRIMKEHECDAVKMEGGSSIAATVRRITDAGIPVMGHLGLMPQSIYKYGSYKVRAQEGAEAEELMKDARLLEESGAFAVVVEKIPSALAGEIARSLTIPVIGIGAGVECDGQVLVINDMLGLNREFHPRFVRQYADLNTIIEDAVGRYLEDVRSGDFPSPEESY

SEQ ID NO: 101116 - DNA, 831 bp, Syntrophomonas wolfei str. Goettingen
  CDS (1)..(831): transl_table=11
atggcaagagtaacggtttcagttttaaaggataaaaagaaacgcaaggaaaaaataagcatgctcactgcttatgactattccctggcgggaatggtggatgaagccggtatcgacatgatactggtaggcgactctctgggcaatgtggtattgggttatgataacaccctggccgttaccatggatgatatgattcaccacagcaaaacggtggtgagggccagcaaaaacgccatggtggttggagacatgccttttctctcctaccatatatcgaaaaaggaagccgtgcgcaacgccggcaggttcatacaggaagccggttgctcggcggtaaaactggaaggcggcagtgaaagagtggatacagttaaagccatactggacgcccagattccggttatgggacacatcggactgaccccgcaatcggtgcaccagtttggcggctttaaagttcagggcaaagatctggaaaccgccaaaaagctggtggaagatgcccgagctctggaccaggctggagtctattgcatcgttttagaatgtgttcccagcgaactggcccgccgggttactgaagaaatatccgtacccaccatcggcatcggtgccggcccatattgcgatgggcaggttctggtgattaacgatatgctggggatgttccggggatttacccccaagtttgtccggaaatttgccaacctggaaccattgataatggaagcattgaagaactacaaagccgaagtggaagccggaaccttcccggcggaggaacactgcttcaccatcaaggaggaagttttggatagactctactaa

SEQ ID NO: 101117 - protein, 276 aa, Syntrophomonas wolfei str. Goettingen
MARVTVSVLKDKKKRKEKISMLTAYDYSLAGMVDEAGIDMILVGDSLGNVVLGYDNTLAVTMDDMIHHSKTVVRASKNAMVVGDMPFLSYHISKKEAVRNAGRFIQEAGCSAVKLEGGSERVDTVKAILDAQIPVMGHIGLTPQSVHQFGGFKVQGKDLETAKKLVEDARALDQAGVYCIVLECVPSELARRVTEEISVPTIGIGAGPYCDGQVLVINDMLGMFRGFTPKFVRKFANLEPLIMEALKNYKAEVEAGTFPAEEHCFTIKEEVLDRLY

SEQ ID NO: 101118 - DNA, 849 bp, Syntrophobacter fumaroxidans MPOB
  CDS (1)..(849): transl_table=11
atgaagaatcgagtgactgttcccgagatcattgcttccaaaggcaaacgcaaactctccgaactgactgcgtacgactatcccactgccctgtgggcggatcagagcggcatcgacatgctgctcgtcggcgactccctggccatggtcgttctgggccacgacgataccctttcggtgggaatgaccgaaatgctccaccacacgagtgcggtcgcccgcggcgcaaagcgcgccctggtgatcggcgacatgccgttcatgtcttaccaggtcagtgtggaggaagccctgtacaacgcgggtctttttctgaaagaagcgaaggcccaggcggtcaagcttgaaggcgggaggagagtggcgccccaggtgaaggccatggttgaagccggtatcccggtgcagggccacctcgggctcacgccgcagagctccgcccagttcggcggtttcaagattcagggaaagacggccgaagcggccaagattctcatcgaagacgcacagatccttgccgaggcaggatgtttcagcatcgttctggaaggcattccctccaatgttgccgccatggtcacggaagccatacccgtacccaccatcggcatcggtgcgggacccgattgcgacggccaggtcctggtgatccatgatgtgctcggtttgtatgaccgcttcgtgcccaaattcgtcaagaagtatgcccaacttggcttgacgatcaaagaggcgttgacaaaataccgcgaagaagtggaaaacgggacgtttccgggccccgaacacgaattcggcatggccgaactggaagcgaaaaaactgagcggactggaagacaagaaatag

SEQ ID NO: 101119 - protein, 282 aa, Syntrophobacter fumaroxidans MPOB
MKNRVTVPEIIASKGKRKLSELTAYDYPTALWADQSGIDMLLVGDSLAMVVLGHDDTLSVGMTEMLHHTSAVARGAKRALVIGDMPFMSYQVSVEEALYNAGLFLKEAKAQAVKLEGGRRVAPQVKAMVEAGIPVQGHLGLTPQSSAQFGGFKIQGKTAEAAKILIEDAQILAEAGCFSIVLEGIPSNVAAMVTEAIPVPTIGIGAGPDCDGQVLVIHDVLGLYDRFVPKFVKKYAQLGLTIKEALTKYREEVENGTFPGPEHEFGMAELEAKKLSGLEDKK

SEQ ID NO: 101120 - DNA, 810 bp, Nitrosomonas eutropha C71
  CDS (1)..(810): transl_table=11
atggatcggccggttacaaaacgtataacggttttgacactgcagaatatttaccgggagaaggggaaaatagcggccctgacctgttatgacgcaacgtttgctgcggtactggaaaacgcaggagttgatattctgctggtgggggattcgcttggaaacgtgatacaaggtcaggccagtactttgccggttacactggatgaaatgatctaccacgtttgctgtgtagagcgcggtactcacagcgtatttatcctggctgacatgccgtttggcacgttccaggtgtctccacaggaagcattcaggaatgcagttcggttaatggctgccggtgcgcagatggttaaggttgaagggggaaggcatatggcagaaaccatagaatttttgacctgtcgtggcattccggtatgtgcccatatcgggttaatacctcagtctgtccaccagttaggcggctacaaaattcaagggaaaacacctgatggtgccagacaattgctggaggatgcactgctattgcaaaaggcaggggcggccatgctcgtgatggagttgatcccggctgcactgggagaggaaattacccggtcactatccatcccgactatcggcattggtgctggtgcagtatgttcgggacaggtcttggtgttgcacgatatgttaggcatcagtagtggtactttgccgcgttttgtcaaaaatttcatggcaggcgcagatagtattcaggtggcagtcaggaattatgtgaaagcagtcaaaaccggagaatttcctgcgcatgaacatatgttctga

SEQ ID NO: 101121 - protein, 269 aa, Nitrosomonas eutropha C71
MDRPVTKRITVLTLQNIYREKGKIAALTCYDATFAAVLENAGVDILLVGDSLGNVIQGQASTLPVTLDEMIYHVCCVERGTHSVFILADMPFGTFQVSPQEAFRNAVRLMAAGAQMVKVEGGRHMAETIEFLTCRGIPVCAHIGLIPQSVHQLGGYKIQGKTPDGARQLLEDALLLQKAGAAMLVMELIPAALGEEITRSLSIPTIGIGAGAVCSGQVLVLHDMLGISSGTLPRFVKNFMAGADSIQVAVRNYVKAVKTGEFPAHEHMF

SEQ ID NO: 101122 - DNA, 792 bp, Trichodesmium erythraeum IMS101
  CDS (1)..(792): transl_table=11
atggcagttacaactaaacaattaattcaatggaaacaaaaaggtcgcccaatagtagctctgacagcttatgattatacgatcgctcaacttttagacaatgctggagtagatttaattctggtgggagattctctgggaatggtaactttaggttatgaaacaactttaccagtgactcttgaggaaatgattcatcatgctaaagcagtacgacgagctgtaaaacaagctttaatggtggtagatttaccatttttaacttatcaggaaagtccccaacaagctatacattcagcaggaagaatactaaaagaaacaggagctcaagctgtcaaactagaaagtggtaatgaagcgatcgctcaaactgttaagaaactaacgtcaataggtattcctgtgatgggtcatattggcctaattccccaatctgtacatcaatttggaggttatcctcaacaaggcaacgctcctgatgctagtgcgcgtattttaacagaagctctagctttggcagaagctggtgcttttgccctagttctagaacatattaaagcagatttagctaaagagattacagaaaaagtttctattcctactattggtattggtgcaggtgcctattgtgatggtcagatattagtgattaatgatgttttagggctttcccattggcagccaccttttgctaaaccttatgttaacttgcgagagactattactcaagcagttaaagaatatagtttagaagtaaagaaaagaaaatttcctcaaccaccatcaccatag

SEQ ID NO: 101123 - protein, 263 aa, Trichodesmium erythraeum IMS101
MAVTTKQLIQWKQKGRPIVALTAYDYTIAQLLDNAGVDLILVGDSLGMVTLGYETTLPVTLEEMIHHAKAVRRAVKQALMVVDLPFLTYQESPQQAIHSAGRILKETGAQAVKLESGNEAIAQTVKKLTSIGIPVMGHIGLIPQSVHQFGGYPQQGNAPDASARILTEALALAEAGAFALVLEHIKADLAKEITEKVSIPTIGIGAGAYCDGQILVINDVLGLSHWQPPFAKPYVNLRETITQAVKEYSLEVKKRKFPQPPSP

SEQ ID NO: 101124 - DNA, 810 bp, Pelobacter propionicus DSM 2379
  CDS (1)..(810): transl_table=11
atgagcgatatgcgaaaaaaagtgaccataccggacatactcaagatgaagcaggagcggcggcgcatcaccatgatgaccgcctacgactacccctttgcgcggttggtggacagcggcggcgttgatgccatcctggtgggggactccctgggagttgtcttctccggtcatgacaacacgttgagcgtcaccatggatgagatgatctaccacaccagggccgtcgcccgcgccaagccgcaggcagtgctggtgaccgacatgcctttcatgtcctaccaggtgagcgtcgaagaggcctgtcgcaactgcggcaggatgatccaggaggggggcgcccaggcggtcaagatcgaggggggcatgaacatgtcccacgtgatccgggcggtgacctccatcgacatcccggtcatggggcacatcggcctgacaccccagtccatccatcgcatggggggctacagggtacagggtcgcaaggaacaggcggagcggatcatggaggatgccctggcggttcaggctgccggagcgttttccatcgtgctggagggtattccctcctccctggcggccagcatcaccgcggagctctccatccccaccatcggcatcggcgccggccccgactgcgacggccaggtgctggtgatccacgacattctggggctgtgtgagaagtattcacccaagttcgtcaaacgctacgctgaactggctccggtcatcaccgatgccgtcaacaggtatgtggaggaggttcgctcaggcgccttccccaccgaggaacactccttcaattga

SEQ ID NO: 101125 - protein, 269 aa, Pelobacter propionicus DSM 2379
MSDMRKKVTIPDILKMKQERRRITMMTAYDYPFARLVDSGGVDAILVGDSLGVVFSGHDNTLSVTMDEMIYHTRAVARAKPQAVLVTDMPFMSYQVSVEEACRNCGRMIQEGGAQAVKIEGGMNMSHVIRAVTSIDIPVMGHIGLTPQSIHRMGGYRVQGRKEQAERIMEDALAVQAAGAFSIVLEGIPSSLAASITAELSIPTIGIGAGPDCDGQVLVIHDILGLCEKYSPKFVKRYAELAPVITDAVNRYVEEVRSGAFPTEEHSFN

SEQ ID NO: 101126 - DNA, 819 bp, Xylella fastidiosa Ann-1
  CDS (1)..(819): transl_table=11
atgagcatatataccaatagcaaaccttggacggtgcctgctttggcggaggccaagcgaaacggttctaaaatcgtgatgttgactgcttatgatgctgggtttgctcgtattcttgacgcaaacggcgtagacctagttcttgttggcgattcgttgggaatggtggtacagggccatgactcgactcttccggtgagtgtgcatgacatggtgtaccacactgcgtgtgtggctcggggggtacgtcaggcaatgcttgtggttgatttgccatttcaggctgatgcgtcgccggaacgtgcgctagaggctgccactgcattactgcgagtgggggcacagatgatcaaaatcgaaggtgccgggcacaagcttgaggtgattagttacttggttgagcgtgagattccggtgtgttcacacttggggctgactccgcaatcggtactgcgttttggaggttataaggtgcaaggacgtggtgaggaggctggggggcgtttgcgtgccgaggcacgtgcggcggtggaggctggggctactctcttgctattggagtgtgtgccgtcgcagttggcagcgcagatcactaccgatgtatcggtgccgacgattggtatcggtgccggtgctggttgtgatggtcaagtgctggtgctgcatgatctccttggtctagacagcggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 101127 - protein, 272 aa, Xylella fastidiosa Ann-1
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATALLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 101128 - DNA, 855 bp, Burkholderia ambifaria AMMD
  CDS (1)..(855): transl_table=11
atgagcgctcatacccgcatcacccgcaagaccgtcaccgcgatccgctcgaccaaagggatcggcagcctcgtgtcgctgaccgcgtattccgcgccaatggcaaaactcgtccacgacgtggccgacgtgatcatcgtcggcgactccgtcggcatggtgctgtacgggatgcccgatacgctgcgcgtcacgctcgacatgatgattgcacacggcgcggccgtcgtgcgcggcgccgcgcaggcgtgcgttgtcgtcgacctgccgttctccacgttccaggaatcgcccgcgcaggcgtaccgctccgccgcgcggctgctcgccgaaaccggcgcgcaggccgtgaagctcgaaggcggctgcgagatgaccgatacgatccgcttcctgaccgagcgcggcattccggtgatggcgcatgtcggcctcatgccgcagcaggccaacgcggcgggcggctttcgcgcgcaggggatggacccgctttcggccgcgcaggtgttcgacgccgcgtgtgctgccgaacgggccggcgcgttcagcgtcgtgatcgaaggcactgccgaggcgctcgcgcgccacctgaccggaacgctgacgatcccgacgatcggcatcggcgcatcgcccgcgtgcgacgggcaagtgctcgtgaccgaggacatgatcggcgcgttcgatgcgtacacgccgcgcttcgtgaagcgttacgcggatgcgaatgcggtgatgcgcgacgcgatccgccagtacgcgcatgacgtgcggcaccgcgtgtttccggagcccgcgcattgcttcggatacgggaagccgctgcaactggccgatgcgggcgcaacggtgtga

SEQ ID NO: 101129 - protein, 284 aa, Burkholderia ambifaria AMMD
MSAHTRITRKTVTAIRSTKGIGSLVSLTAYSAPMAKLVHDVADVIIVGDSVGMVLYGMPDTLRVTLDMMIAHGAAVVRGAAQACVVVDLPFSTFQESPAQAYRSAARLLAETGAQAVKLEGGCEMTDTIRFLTERGIPVMAHVGLMPQQANAAGGFRAQGMDPLSAAQVFDAACAAERAGAFSVVIEGTAEALARHLTGTLTIPTIGIGASPACDGQVLVTEDMIGAFDAYTPRFVKRYADANAVMRDAIRQYAHDVRHRVFPEPAHCFGYGKPLQLADAGATV

SEQ ID NO: 101130 - DNA, 816 bp, Burkholderia ambifaria AMMD
  CDS (1)..(816): transl_table=11
atgacctatctccaggaatcgagccggcctgccgtcacggtgccgaagctgcaggcaatgcgcgatgccggcgagaagatcgcgatgctcacctgctacgacgcgagctttgccgcgctgctcgaccgctcgggcgtcgacgtgctgctgatcggcgattcgctcggcaacgtactgcagggccacacgaccacgctacccgtgtcgctcgacgacatcgcgtaccacaccgcctgtgtcgcgcgtgcgcagccgcgcgcactgatcatcgccgacctgccgttcggcacctacggcacgccggccgaggcattcgcgagcgccgtgaagctgatgcgcgccggtgcgcagatgatcaagctcgaaggcggcgagtggctcgccgaaacgatccgcttcctcgtcgagcgtgcggtgcccgtgtgtgcgcacgtcggcctcacgccgcagtcggtgcacgcgttcggcggcttcaaggtacagggcaagaccgaggccggcgccgcgcaactgctgcgcgacgcgcgcgcggtcgaggatgccggtgcgcaactcgtcgtgctcgaagcggtgccgacgctcgtcgcatccgaagtcacgcacatgctcaagattccgacgatcggcatcggcgcaggcaccgattgctcgggccaggtgctcgtgctgcacgacatgctcggcattttccccggcaagcgtccgcgcttcgtgaaggacttcatgcagggccagccaaccatccaggcggccgtcgaagcctatgtgcgcgcggtgaaggacagttcgttccccggcccggaacattcgttctga

SEQ ID NO: 101131 - protein, 271 aa, Burkholderia ambifaria AMMD
MTYLQESSRPAVTVPKLQAMRDAGEKIAMLTCYDASFAALLDRSGVDVLLIGDSLGNVLQGHTTTLPVSLDDIAYHTACVARAQPRALIIADLPFGTYGTPAEAFASAVKLMRAGAQMIKLEGGEWLAETIRFLVERAVPVCAHVGLTPQSVHAFGGFKVQGKTEAGAAQLLRDARAVEDAGAQLVVLEAVPTLVASEVTHMLKIPTIGIGAGTDCSGQVLVLHDMLGIFPGKRPRFVKDFMQGQPTIQAAVEAYVRAVKDSSFPGPEHSF

SEQ ID NO: 101132 - DNA, 885 bp, Rhodoferax ferrireducens DSM 15236
  CDS (1)..(885): transl_table=11
atgagcgcgagtgctgagtccaccaacgccacaccgtacggcacgctgccgccaaccgccgcggcatcggcacgcaagcccatcagcctgccgcgcctgctggaaatgcacgcgcggggcgagaaactcaccatgctcaccgcctacgacgccacttttgccgcagtggccgacgcggccggcgtggagtgcatcctggtgggcgactcactcggcatggtgtgccagggcctctccagcaccatgggcgtcaccctgcaagccatgtgttatcacatcgaaagcgtggcgcgtggcctgcgccgcgcgcaagccacggcctggctgattggcgacctgccctacggcagctaccacgaatcgcgcgagcaagccctgcgcagcgctgccgccctgatgcaggccggctcgcacatggtcaagctggagggcgggggctggaccgccgataccgtgcggtttttggtggaacgcggcatcccggtgtgcgctcatctgggcctgacaccgcaaaccgtgcatgcgctgggcggctaccgggtgcagggcaagacgcaggagtctgccgccctcatgaaacgccaggcccatgaactgcaagatgccggcgccgccctgctggtgctggaaatggtgcccgctgcgctggccgccgagctcacccgggaactcacccactgcgcgaccatcggcatcggcgccggcaaagacaccgccggccaggtgctggtgctgcatgacatgctgggcatcaacctgggcaagatgcccaagttcgtgcgcaacttcatgaccggcgcaccgggtgtgaaagaagccatgcaagcgtatgtggcggccgtgaagaacggcagcttccccgacaacacgcaacacgcctggtaa

SEQ ID NO: 101133 - protein, 294 aa, Rhodoferax ferrireducens DSM 15236
MSASAESTNATPYGTLPPTAAASARKPISLPRLLEMHARGEKLTMLTAYDATFAAVADAAGVECILVGDSLGMVCQGLSSTMGVTLQAMCYHIESVARGLRRAQATAWLIGDLPYGSYHESREQALRSAAALMQAGSHMVKLEGGGWTADTVRFLVERGIPVCAHLGLTPQTVHALGGYRVQGKTQESAALMKRQAHELQDAGAALLVLEMVPAALAAELTRELTHCATIGIGAGKDTAGQVLVLHDMLGINLGKMPKFVRNFMTGAPGVKEAMQAYVAAVKNGSFPDNTQHAW

SEQ ID NO: 101134 - DNA, 804 bp, uncultured proteobacterium RedeBAC7D11
  CDS (1)..(804)
atgaataaaagtatcaccattgaagattttagaaatcataaaaagaaaaaaactaaatttgcttgtttaactgcatatgatgcatctttatctgaattaatgtctaaagcaggggtagagttgattttagttggggactctctagggatggttgtgcaaggccatgattctacaatacctgtttctatggaggatcttttgtatcatcttagatgtgttaagagaggaaatataggaagtcacataatggcagacatgccatttatgagttatgcaacagaaaaccttgcttatgacaatgcaatgcgcttgatgcaagctggagcaaattctgtaaaagttgaaggaggcgaatggattcttaaaacaactgaacttttgtctcaaagaggtattccagtatgtgctcatttaggtctcactcctcagtcaatcaataggcttgggggatattatgtgcagggcagagatctagaagacaaaaatagaattttgtctgaagctaagcaacttgaaaatgctggggcggaaattattttgttggaatgcgtcccagcgagtctagctgaagagatatcttctagccttaaaattccaacaataggaattggggcaggctcagctacggatggtcaaataatggtttgctatgatgcaattggggcttacatctgggatgaccagcctcaacccaaatttgtaaaaaatttcatgaatgaatctaattcaatttttgaagcgtttgaaaaatatgtttcagaagtcaaaagttctaaattcccatctgctgatcattctttttaa

SEQ ID NO: 101135 - protein, 267 aa, uncultured proteobacterium RedeBAC7D11
MNKSITIEDFRNHKKKKTKFACLTAYDASLSELMSKAGVELILVGDSLGMVVQGHDSTIPVSMEDLLYHLRCVKRGNIGSHIMADMPFMSYATENLAYDNAMRLMQAGANSVKVEGGEWILKTTELLSQRGIPVCAHLGLTPQSINRLGGYYVQGRDLEDKNRILSEAKQLENAGAEIILLECVPASLAEEISSSLKIPTIGIGAGSATDGQIMVCYDAIGAYIWDDQPQPKFVKNFMNESNSIFEAFEKYVSEVKSSKFPSADHSF

SEQ ID NO: 101136 - DNA, 948 bp, uncultured bacterium
  CDS (1)..(948)
atggcaagcttggatgctagccccaacgcgcgcagggcgcttgaagaatttcccgcgcaggcaccggcatgtcggcctagaatcgcgccaactttggcacccgacccgccccacatgagttcagcgacccctgccgccttgcccgcccgcaagcccatgaacctgcaccgcctgcgcgagatgcatgcgcagggtgaaaaaatcaccatgctgacctgctacgagtcgtccatgacccgtgtgatggacgatgctggcgttgacgccatcctgatcggcgattcgctgggcatggtggtgcaaggccagcccagcacggtgcccgtgacgctcgacgagatcgcgtaccacacgcgctgcgtggtgcgcggcaaccgcaacgtttggatcgtcagcgacctgcccttcggcacctaccaggaaaaccgcgagcaggccttgcgttccagcgtggccctgatgcaggccggcgcgcacatggtcaagctggaaggtggcggctggacggccgagaccgtgcacttcctgaccgagcgaggcatccccgtctgcgcccacctgggcctgacgccgcagagcgtgcacgcgctgggcggctaccgcatccagggccgcgatgccgccggcgccgaaaccctgcgccgccacgccaaggaactggcccaggccggcgccgccatggccgtgctggaactgatgccatcggatgtggccgccgatgtgcaagccgacaacccgggcctgatcaccattggcatcggtgccggccaacgcacggccggccaggtgctggtgatgcacgacatgctgcacatcacgcgcggcaagctgccacgcttcgtgcgcaacttcatggccgagggcggctcgatcgaagacgccatccgccgcttcgtggtgagcgtcaaggacggcagcttccctgacgaagccctccacggttattga

SEQ ID NO: 101137 - protein, 315 aa, uncultured bacterium
MASLDASPNARRALEEFPAQAPACRPRIAPTLAPDPPHMSSATPAALPARKPMNLHRLREMHAQGEKITMLTCYESSMTRVMDDAGVDAILIGDSLGMVVQGQPSTVPVTLDEIAYHTRCVVRGNRNVWIVSDLPFGTYQENREQALRSSVALMQAGAHMVKLEGGGWTAETVHFLTERGIPVCAHLGLTPQSVHALGGYRIQGRDAAGAETLRRHAKELAQAGAAMAVLELMPSDVAADVQADNPGLITIGIGAGQRTAGQVLVMHDMLHITRGKLPRFVRNFMAEGGSIEDAIRRFVVSVKDGSFPDEALHGY

SEQ ID NO: 101138 - DNA, 801 bp, Pseudomonas fluorescens
  CDS (1)..(801): r means g or a
atgccagctattaccctgaccacgctgcaaggtctcaagcaaaaaggtgagaaaatcaccatgctgacctgctatgacgcaactttcgcccacgcctgcaatgaggccggtgtcgaagtgttgctggtgggcgattccctcggcatggtgctgcaaggtcacgacagcacgctgccggtgaccaccgccgagatggcctaccatgtggccgccgtcaaacgcggtaacaccgatgcactgattctcgccgacctgccattcatggcctacgccacccttgaacaaaccatgaccaacagcgccatgctgatgcaggccggtgcccacatggtcaaggtcgagggcgcgttgtggctggccgattcgattcggttgctggccgagcggggtatcccagtgtgcgcgcacatgggactgaccccacaatcggtcaatatcctcggtggctacaaggtccagggccgcaatgagaaccaggcgcggcagatgcgcgccgatgcgattgcgctggagcaggctggcgcggcgatgttgctgctcgaatgcgtgcccarcgagttggcggaagaaatcacccaggcggtgaagatcccggtgatcgggatcggcgccggccacgccaccgacggccaggtgctggtgctgcacgacatgctcgggctgtcgatcaccggtcgcgtgcccaagttcgtgaaggacttcatggcagggcaaacgtccatccagggcgccctgagtgcctatgtcgctgaggtcaaggccgcgaccttccctggcgtcgaacacgggttttctgcatga

SEQ ID NO: 101139 - protein, 266 aa, Pseudomonas fluorescens
  misc_feature (185)..(185): Xaa can be Asn or Ser
MPAITLTTLQGLKQKGEKITMLTCYDATFAHACNEAGVEVLLVGDSLGMVLQGHDSTLPVTTAEMAYHVAAVKRGNTDALILADLPFMAYATLEQTMTNSAMLMQAGAHMVKVEGALWLADSIRLLAERGIPVCAHMGLTPQSVNILGGYKVQGRNENQARQMRADAIALEQAGAAMLLLECVPXELAEEITQAVKIPVIGIGAGHATDGQVLVLHDMLGLSITGRVPKFVKDFMAGQTSIQGALSAYVAEVKAATFPGVEHGFSA

SEQ ID NO: 101140 - DNA, 834 bp, Heliobacillus mobilis
  CDS (1)..(834): transl_table=11
atgaagaaaaagatcaccttacctcagtttaaggtacgaaaagaacaaggaaaaaagttccgcatggtcaccgcctatgattatccctttgcccagttagtcgatgagagcgaagtggaagtcatccttgttggtgactctctcggcatggttgttttaggctatgacagcacagtacctgttaccttggaggaaatgatccatcactgccgacctgtggtgaaaggagccccccatactctcgtcgtggcggacatgccctttggcacctacaatatatctaaggaagatgcgatccgtaacgccaaccggatgctgaaggagagcggtatcgaagcggtaaaactggaaggtggcaaaaaggttgcccctattgtagaagctatcgtcgatgccggtattcctgtgatgggacatattggactgacacctcaaacggcagctcaactcggcggctttaaagtacagggaaaaactgaagaggctgcgcaacagttgttggaagatgccttagccctggaaaaagccggcgcttttagtctcgttatcgaatgcgtacctgccgatgtggccagaaggatcacagaagctttgtccatcccgacaatcggcatcggcgcaggaccgtactgtgacggtcaggtgctcgtcattcaagatatgctgggtatgtttgatcgctttactccgaagttcgtcaagaaatacgccaatatcggaccgactatcaaggaagctcttaacacttatgcccaggaagtatccgatggaaccttccccgggccggaatatagctttggcatggattcgaacgaattgaagcgtttatattag

SEQ ID NO: 101141 - protein, 277 aa, Heliobacillus mobilis
MKKKITLPQFKVRKEQGKKFRMVTAYDYPFAQLVDESEVEVILVGDSLGMVVLGYDSTVPVTLEEMIHHCRPVVKGAPHTLVVADMPFGTYNISKEDAIRNANRMLKESGIEAVKLEGGKKVAPIVEAIVDAGIPVMGHIGLTPQTAAQLGGFKVQGKTEEAAQQLLEDALALEKAGAFSLVIECVPADVARRITEALSIPTIGIGAGPYCDGQVLVIQDMLGMFDRFTPKFVKKYANIGPTIKEALNTYAQEVSDGTFPGPEYSFGMDSNELKRLY

SEQ ID NO: 101142 - DNA, 810 bp, Rhizobium leguminosarum bv
  CDS (1)..(810): transl_table=11
attcagaagcgcctgacaccagcgcgcatttcagccatgaagggcggcaagccgatcgtctgcctgaccgcctatacgacgcccatggcgcggctgcttgacgaacattgcgacctcttgctggtcggggattcgctcggcatggtgctctatggcatggagtccaccatcggcgtcacgctcgacatgatgatcgcccacggcaaggcggtgatgcgcggcgtcgacaaggcctgcgtcgttgtcgacatgccgttcggcacctaccaggaatcgaaggagatcgccttccgcaacgctgtccgcatcctgcaggaaaccggctgcgatgccatcaagctcgagggcggcgaggagatggccgataccatcgcctttctgaccaagcgcggggtcccggtcatggggcatatcggtctgatgccgcagcaggtccaaaccgctggcggctatcgttcggtcggtcattccgaacacgagacgtcgaagatccggcgcgacgctcatgccatcggcggctctggcgcctttgccgtcgtcatcgatggcacggtggagccgctcgcccgcgaggtgaccggcgccatgcacatcccgaccatcggtatcggcgcctcctccgcctgcgacggtcaggttctggtctccgacgacattctggggctcttcaacgatttcatcccgcgtttcgtcaagcgctacgacgaactcggcaagaggatgtcggcacgccgccgccgcttagtgccgggaggtccggtcgcgacagtcttccggcagcggagcacacctttcaaacggcggtcctga

SEQ ID NO: 101143 - protein, 269 aa, Rhizobium leguminosarum bv
IQKRLTPARISAMKGGKPIVCLTAYTTPMARLLDEHCDLLLVGDSLGMVLYGMESTIGVTLDMMIAHGKAVMRGVDKACVVVDMPFGTYQESKEIAFRNAVRILQETGCDAIKLEGGEEMADTIAFLTKRGVPVMGHIGLMPQQVQTAGGYRSVGHSEHETSKIRRDAHAIGGSGAFAVVIDGTVEPLAREVTGAMHIPTIGIGASSACDGQVLVSDDILGLFNDFIPRFVKRYDELGKRMSARRRRLVPGGPVATVFRQRSTPFKRRS

SEQ ID NO: 101144 - DNA, 822 bp, Pseudomonas aeruginosa
  CDS (1)..(822): transl_table=11
atgagcagtcatcgcccgcaacatcgcctgtccgttcccgatatccagcgccgcaagggtgccggcagcctggtggcgctgaccgcctacagcacgcccatggcccgcctcctcgatccgcatgccgacctgctgctggtcggcgattcgctgggcatggtgctctatggcatgcccagcaccctgggagtgagcctggagatgatggtcgcccacaccctggcggtgatgcgcggcagtcggcgcgcctgcgtggtggccgacttgccgttcgccagctaccaggaatcgccccgacaggcgttccgcaacgccgcacgcctgctggccgacagcggcgcccaggcggtgaagctggaaggcggtgaggaaatggaagaaaccgtggacttcctggtacgccgtggcataccggtgctcgcccatatcggcctgatgccgcagcaggtcaacgccatgggcggcttcaaggcccaggggcgtgacccggaaagcgcagaacgggtacgccgcgacggcctcgccatgcagcgcggcggcgccttcgcggtggtcatcgaaggcgtaggcgagccgctggcccgtcgccttagcgaagaactggcgatcccctgcatcggtatcggcgcctcgccggcctgcgacggccaggtactggtcagcgaggacctgctcgggctaagcggcgaacaggtaccgcgcttcgtcgaacgctacgcgcgcctcgaccgggaaatcgacgaggcggcccggcgcttcgccgaggacgtgcgcgaacggcgcttccccgaggccaggcattgcttcgccatgcgcgagtga

SEQ ID NO: 101145 - protein, 273 aa, Pseudomonas aeruginosa
MSSHRPQHRLSVPDIQRRKGAGSLVALTAYSTPMARLLDPHADLLLVGDSLGMVLYGMPSTLGVSLEMMVAHTLAVMRGSRRACVVADLPFASYQESPRQAFRNAARLLADSGAQAVKLEGGEEMEETVDFLVRRGIPVLAHIGLMPQQVNAMGGFKAQGRDPESAERVRRDGLAMQRGGAFAVVIEGVGEPLARRLSEELAIPCIGIGASPACDGQVLVSEDLLGLSGEQVPRFVERYARLDREIDEAARRFAEDVRERRFPEARHCFAMRE

SEQ ID NO: 101146 - DNA, 822 bp, Bradyrhizobium japonicum
  CDS (1)..(822): transl_table=11
atgtccgtccaatccgccatcaggcgcaagaccgcgcccgacctccgcattcgcaagaatggcgagccgatcgtgatgctgacctcctatcacgcgcacaccgccgcgctggtcgacaggcactgcgatgcgatcctggttggcgattcccttggcaatgtcatgcatggcttcgagaccacggtgcccgtgacgcttgagatgatgatcctgcagggctgcgcggtgatgcgcggctccagccaggcgctcgtcgtcgtcgacatgccgttcggttcctacgaaggctcgaaggagcaggccttccagtcggcggtgcggatcatgaaggaaacgctgtgcggcgcggtcaagctcgagggcggcgcgcggatggcggagacggtggcgtttctctccgagcgcggcattcccgtgatgggccatatcgggctgacgccacagtcgatcaacacgcttggctcgttccgcgcacagggccgcgaggaggcgaactgggctccgatcgagaatgacgccagggcgatcgcagaggcgggggccttctctatcgtgatcgaggcggtcgccgagccgctggcgcgcaagatcacgcaatcgatcgcagttcctaccatcggcattggcgcgagcgcagcctgcgacggccagattttggtgctggaagatatgctcggcttgtcgccgcggtcgccgaaattcgtgcgccgctatggcaatctcgggccggcgatcgaggaagccatcgcgggctatgcgcgcgacgtgaagagccgggccttcccgggcccggagcatgtctacgacatgaagaagagctga

SEQ ID NO: 101147 - protein, 273 aa, Bradyrhizobium japonicum
MSVQSAIRRKTAPDLRIRKNGEPIVMLTSYHAHTAALVDRHCDAILVGDSLGNVMHGFETTVPVTLEMMILQGCAVMRGSSQALVVVDMPFGSYEGSKEQAFQSAVRIMKETLCGAVKLEGGARMAETVAFLSERGIPVMGHIGLTPQSINTLGSFRAQGREEANWAPIENDARAIAEAGAFSIVIEAVAEPLARKITQSIAVPTIGIGASAACDGQILVLEDMLGLSPRSPKFVRRYGNLGPAIEEAIAGYARDVKSRAFPGPEHVYDMKKS

SEQ ID NO: 101148 - DNA, 801 bp, Pseudomonas aeruginosa
  CDS (1)..(801): transl_table=11
atgcctgatgtaaccctgaccaccctgcaagggttgaagcagagcggcgagaagatcgccatgctgacctgctacgacgccaccttcgcccacaccgccagccaggccggcgtggacgtgcttctggtcggagattcgctcggaatggtattgcagggtcacgacagcaccctgccggtcagcaacgaggaaatggcctatcacacggcctgcgtgaaacgcggtaacaaaggttccctgatcgtcaccgacctggccttcgaatccagccattccgtggcccagacccttgccgacgcggtccgcctgatgcaggccggcgcacacatggtcaagctggagggtggggtctggctggcggagccgatcgcccgcctggcacagatgggcgtgccggtctgcgcgcatctcggcctgaccccgcaggcggtcaacctgttcggcggcttcaaggtccagggccgccaggaaacccaggcgcgccagttgcgcgccgatgccatcgccctggagcaggccggcgccgccatgctgctgctggagtgcgtgcccagcgtgctggccgaagagatcacccaggcggtgaagatcccggtgatcgggattggcgccggtgcggcgaccgatggccaggtgctggtcatgcacgacatgctcggtctctcgctgaccggccgctcgcccaagttcgtcaaggatttcatgcaaggccaggagagcatcccggccgccatcgcggcctatgtccgcgccgtcaaggacgtgtccttccccgccgccgaacacggattcaacgcatga

SEQ ID NO: 101149 - protein, 266 aa, Pseudomonas aeruginosa
MPDVTLTTLQGLKQSGEKIAMLTCYDATFAHTASQAGVDVLLVGDSLGMVLQGHDSTLPVSNEEMAYHTACVKRGNKGSLIVTDLAFESSHSVAQTLADAVRLMQAGAHMVKLEGGVWLAEPIARLAQMGVPVCAHLGLTPQAVNLFGGFKVQGRQETQARQLRADAIALEQAGAAMLLLECVPSVLAEEITQAVKIPVIGIGAGAATDGQVLVMHDMLGLSLTGRSPKFVKDFMQGQESIPAAIAAYVRAVKDVSFPAAEHGFNA

SEQ ID NO: 101150 - DNA, 825 bp, Aeropyrum pernix
  CDS (1)..(825): transl_table=11
atgccaggggataaggttacagctaggaggatattgaagatgaaggggtcgaggccgatagtggctgtgaccgcctacgactacccgacagcctggatagcggatgaggcgggggtggacgttatactggtcggcgacagcctggggatggtagtcctgggctacccctcaaccctccaggtaacgctggatgatatggttagacacaccgcagctgttgcgagagcggccaagaggcctttgatagtggccgacatgcccttcggcagctacgagcccagctcaagcgccgctgtagagagtgccgtggctctcgcgagagtgggggcagaggctgtgaagctcgagggcggtagcgagtacgccgacagggtgaaggccatagtagacgccgggataccggtgatgggccacctcggcctaaccccccagagggccatgaggataggaggctacaggcccagggcccgggggagggatgaggcccgcaggctgctcctagacgcagagtccctcgtcgaggcgggcgtcttcagcatagtgctggagttcgtatccgaggaggcagcagaaatggttaccaggagggtgccggtgccgacgatatgcataggcagcggtaggaggtgtgacggccagataatagtgttccacgatatagtaggcctctcacgacacacaccacccttcgccaaaaagtatgtcgacgccaggaggataatggtggaggctgtcacaagatacgccgaagacgtgagaaacggcaggttcccaggcgaggagcacgtagttcacgcaaaagagcccctcgaagatataagttga

SEQ ID NO: 101151 - protein, 274 aa, Aeropyrum pernix
MPGDKVTARRILKMKGSRPIVAVTAYDYPTAWIADEAGVDVILVGDSLGMVVLGYPSTLQVTLDDMVRHTAAVARAAKRPLIVADMPFGSYEPSSSAAVESAVALARVGAEAVKLEGGSEYADRVKAIVDAGIPVMGHLGLTPQRAMRIGGYRPRARGRDEARRLLLDAESLVEAGVFSIVLEFVSEEAAEMVTRRVPVPTICIGSGRRCDGQIIVFHDIVGLSRHTPPFAKKYVDARRIMVEAVTRYAEDVRNGRFPGEEHVVHAKEPLEDIS

SEQ ID NO: 101152 - DNA, 840 bp, Agrobacterium tumefaciens
  CDS (1)..(840): transl_table=11
atgagcgcccatgcaaaacaaaagcggctgacgacggcctccatccggcagatgaagggcgaggcacgcatcgtctgcctcaccgcctatacgacgccgattgcccggctgctggatccgcattgtgaccttttgctggtgggggattccctcggcatggtgctttacggcatggagacgactgttggtgtgacgctggacatgatgatcgcccatggccgcgccgtcatgcgcggcgtcgaacatgcctgcgtcatcgtcgatcttcccttcggcacctatcaggaatccaaggaacaggccttccgcaacgccgtgcggctgatgcaggagaccggctgcgatggcgtgaagctggaaggcggcgaagaaatggccgagaccatcgcctttctggtggcgcgtggcattcccgtcttcggccatgtcgggctgatgccgcaactcgtccacactgccggtggcttccgctcgctcggccattcggatgcggaaacgcaaaagatctggcgcgatggtattgcggtcgatcaggcgggcgctttcgccatcgtcgtggaaggcaccgtcgaaccacttgcccgcgagttgacggagaagctcgccgccccgaccgtcggcatcggtgcatcgccggcctgtgacgggcaggtgctggtgtccgacgacatgcttggcctgttttcagacttcaaaccgaaattcgtcaaacggtatgccgatctcggcacggctgctacgcaagcggcggcggcttatgccgatgaggtgcgctccggtgcatttccggggccggagcatacgtttcaagtgcgtaagccgtcgccttcggggaagtga

SEQ ID NO: 101153 - protein, 279 aa, Agrobacterium tumefaciens
MSAHAKQKRLTTASIRQMKGEARIVCLTAYTTPIARLLDPHCDLLLVGDSLGMVLYGMETTVGVTLDMMIAHGRAVMRGVEHACVIVDLPFGTYQESKEQAFRNAVRLMQETGCDGVKLEGGEEMAETIAFLVARGIPVFGHVGLMPQLVHTAGGFRSLGHSDAETQKIWRDGIAVDQAGAFAIVVEGTVEPLARELTEKLAAPTVGIGASPACDGQVLVSDDMLGLFSDFKPKFVKRYADLGTAATQAAAAYADEVRSGAFPGPEHTFQVRKPSPSGK

SEQ ID NO: 101154 - DNA, 774 bp, Anabaena sp
  CDS (1)..(774): transl_table=11
atgccagtcactacccagcaattaattcagtggaaacaacaaggtcgttcaattgtggcgttgaccgcttgggattatacgatcgctcaaattctggacggtgctggtgtagacttaatcctcgtgggtgactcgatggcggtaatgttgggctataaaacaacgctgccaattacattagaggagatgctacaccacgctaaagcagtttgccgtggtgtgcaacgggctttagttgtggttgatctaccatttttgacttatcaagagagtatcccacaagcaattaactcggctgggcgcatattaaaggaaacaggcgctcaagcagttaagttggaaggtggctatccggcaatggtagacactattaatcgtttggtacaagctggtataccagttatgggtcatgtaggtttgacaccccaatcagttcatcaattggggttacgtcaacaaggtaagacacaggaaacagcccaaagaattttaaacgaagcgatcgcacttgaacaagcgggtgtattctccatagttttagagcatatacccgcagatttggcaatgcagattacacaaaaagttaatattcccacgattggtattggtgcgggttcccattgcgacggtcaagttttagttacttctgatgtattgggtttatcagaaagacaaccacccttcgccaaggtttatacgaatttgcgcgagacaattaccaaggctgtacaagattacgctgcggaagtacgcgatcgccagttcccagaatag

SEQ ID NO: 101155 - protein, 257 aa, Anabaena sp
MPVTTQQLIQWKQQGRSIVALTAWDYTIAQILDGAGVDLILVGDSMAVMLGYKTTLPITLEEMLHHAKAVCRGVQRALVVVDLPFLTYQESIPQAINSAGRILKETGAQAVKLEGGYPAMVDTINRLVQAGIPVMGHVGLTPQSVHQLGLRQQGKTQETAQRILNEAIALEQAGVFSIVLEHIPADLAMQITQKVNIPTIGIGAGSHCDGQVLVTSDVLGLSERQPPFAKVYTNLRETITKAVQDYAAEVRDRQFPE

SEQ ID NO: 101156 - DNA, 798 bp, Aquifex aeolicus
  CDS (1)..(798): transl_table=11
atggcgataaacctccagactctcttcaagaagaagagagaagggaaaaagattaccatggtttctacctacgattactggagtgccaaactctgcgacgaggtcgggatagactgcatactcgtcggagactccctcggaactgtcgtaaaaggtgaaggggatacgctttcagttaccttggaagaaatcatttatcacacaaagtgcgttatgagaggagtaaaaaacgccttcgttatagcggacatgccctttatgagttatcaggtttctatggaaaaggcggtggaaaactgcggaagggttataaaagagactaaggcaaaggctgtaaagcttgagggcggggaggagatagcggagctcgtgtacaaattaacgagaataggaatacctgtggtgggtcacgttggctttacaccccagcacataaacgtctttggaaaaccgaaggttgtgggaaagaaaaaagaagaggaggaaaaactaaggagagatttcagagctctggaagaggcgggagcttttatgatcgttcttgaaagcgttcccacacacttggcgaaagaactctggaaaggttcaaactctatagttataggaataggtgcgggaaagtacgttgacggacaagtgctcgtttttcacgatatagtcggtctttttgaggactttaaaccaaagtttgtgagaaggtaccttgaaggagctaaattggtaaaggaagcccttaaaaattttaaaattgacgtggaagggggcaatttcccttcggaagaggaaagttatggataa

SEQ ID NO: 101157 - protein, 265 aa, Aquifex aeolicus
MAINLQTLFKKKREGKKITMVSTYDYWSAKLCDEVGIDCILVGDSLGTVVKGEGDTLSVTLEEIIYHTKCVMRGVKNAFVIADMPFMSYQVSMEKAVENCGRVIKETKAKAVKLEGGEEIAELVYKLTRIGIPVVGHVGFTPQHINVFGKPKVVGKKKEEEEKLRRDFRALEEAGAFMIVLESVPTHLAKELWKGSNSIVIGIGAGKYVDGQVLVFHDIVGLFEDFKPKFVRRYLEGAKLVKEALKNFKIDVEGGNFPSEEESYG

SEQ ID NO: 101158 - DNA, 840 bp, Bacillus anthracis
  CDS (1)..(840): transl_table=11
ttgaaaacaaaaacagattttttgaaaatgaaagagcaaggtgagccgattacaatgctaacggcgtatgattatccttctgctaaattagcagaagaagctgaagttgatatgattctagttggagattctctcgggatggttgtgctcggctacgattcaacagtaccagtaacagtagaggatatgattcatcatacaaaagctgtacgccgcggagcgaaagagacgtttattgtaactgatatgccatttatgtcgtatcatgtgtcactgcaagatacgatggtgaatgcacgccgcatcgttcaagagagtggtgcccatgcactgaaggtagaaggtgcgggagaagtgatatcgactattcactatttgacgaatgcgggaattcctgtcgtggcgcacttaggtttaactcctcaatctgtaggagtgctaggtggatataaagtacaaggaaaagacgctgaaagtgcaaaaaaattaatagaagatgcgaagaaatgtgaggaagctggtgcaattgcactcgtgttagagtgtgtgccaatgcagttagcagaacttatttcagagcaattaacaattccaacaatcgggattggcgcaggacaaaaagtagatgggcaagtgcttgtttatcatgatcttatctcatatggggtaaatcgtgttccgaaatttgtgaagcaatatacgtccgttcaagaagaaattgtacgcgggatttctcaatatgttgctgaagtaaagacaaggcaatttcctgaagaaaaacattcgttcacaatgaaagaggaagaatgcttagcgttatacggaggaaaacaatcatga

SEQ ID NO: 101159 - protein, 279 aa, Bacillus anthracis
MKTKTDFLKMKEQGEPITMLTAYDYPSAKLAEEAEVDMILVGDSLGMVVLGYDSTVPVTVEDMIHHTKAVRRGAKETFIVTDMPFMSYHVSLQDTMVNARRIVQESGAHALKVEGAGEVISTIHYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVAEVKTRQFPEEKHSFTMKEEECLALYGGKQS

SEQ ID NO: 101160 - DNA, 837 bp, Bacillus cereus
  CDS (1)..(837): transl_table=11
ttgaaaacaaaaacagattttttgaaaatgaaagagcaaggtgagccgattacaatgctaacggcgtatgattatccatctgctaagttagcagaagaagcggaagttgatatgattctagttggagattcccttgggatggttgtgctcggctatgattcaacagtacctgtaacagtagaggatatgattcatcatacgaaagctgtacgccgaggagcgaaagagacgtttattgtaactgatatgccatttatgtcgtatcatgtgtcgcctcaagatacgatggtgaatgcacgccgcatcgttcaagagagtggtgctcatgcactgaaggtagaaggtgcaggagaagtgatatcaactattcattacttgacgagtgcgggaattcctgtcgtggcacacttaggcttaactcctcaatctgtaggagtgttaggtggctataaagtacaaggaaaagatgctgaaagtgcaaaaaaattaatagaagatgcgaagagatgtgaggaagctggtgcgatagcacttgtattagaatgtgtgccaatgcagctagcagaattcatttcgaagcaactaacaattccaacgattggaattggagcaggacaaaaagtggatgggcaagtactcgtttatcatgatcttatctcatatggcgtaaatcgtgttccgaaatttgtgaagcaatatacgtttgttcaagaggagattgtgcgagggatttcacaatacgtaactgaagtaaagacagggcaatttccggaagaaaaacattcattcacaatgaaagaggaagaatgtttagcgttatacggaggaaaacaataa

SEQ ID NO: 101161 - protein, 278 aa, Bacillus cereus
MKTKTDFLKMKEQGEPITMLTAYDYPSAKLAEEAEVDMILVGDSLGMVVLGYDSTVPVTVEDMIHHTKAVRRGAKETFIVTDMPFMSYHVSPQDTMVNARRIVQESGAHALKVEGAGEVISTIHYLTSAGIPVVAHLGLTPQSVGVLGGYKVQGKDAESAKKLIEDAKRCEEAGAIALVLECVPMQLAEFISKQLTIPTIGIGAGQKVDGQVLVYHDLISYGVNRVPKFVKQYTFVQEEIVRGISQYVTEVKTGQFPEEKHSFTMKEEECLALYGGKQ

SEQ ID NO: 101162 - DNA, 837 bp, Bacillus cereus
  CDS (1)..(837): transl_table=11
ttgaaaacaaaaacagattttttgaagatgaaagagcaaggtgagccgattacaatgctaacggcgtatgattatccatctgctaaattagcagaagaagctgaagttgatatgattctagttggagattctcttggaatggttgtactcggatacgattcaacagtacctgtaacagtagaggatatgattcatcatacgaaagctgtacgccgtggagcgaaagagacgtttattgtaactgatatgccatttatgtcgtatcacgtatcattacaagaaacgatggtgaatgcacgtcgcatcgttcaagagagcggggcacacgcactgaaggtagaaggtgctggagaagttatatcgacgattcaatatttgacgaacgcaggaattcctgttgtagcgcatttaggtttaacccctcaatcggtaggagtgttgggtggatataaagtgcaaggaaaagatgcggagagtgcaaaaaaattaatagaagatgcaaagaaatgtgaagaagctggtgcaatagcgcttgtgttagaatgtgtaccaatgcagttagcagaacttatttcagagcaactaacaataccaacaattgggattggtgcaggacaaaaagtagatggacaagtgcttgtttatcatgatcttatctcatacggcgtaaatcgtgttccgaaatttgtgaagcaatatacgtctgttcaagaggagattgtgcgtgggatttcacaatatgttactgaagtaaagacaaggcaatttcctgaagaaaaacattcgttcacaatgaaagaggaagaatgcttatcgttatacggaggaaaacaataa

SEQ ID NO: 101163 - protein, 278 aa, Bacillus cereus
MKTKTDFLKMKEQGEPITMLTAYDYPSAKLAEEAEVDMILVGDSLGMVVLGYDSTVPVTVEDMIHHTKAVRRGAKETFIVTDMPFMSYHVSLQETMVNARRIVQESGAHALKVEGAGEVISTIQYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVTEVKTRQFPEEKHSFTMKEEECLSLYGGKQ

SEQ ID NO: 101164 - DNA, 822 bp, Bacteroides fragilis
  CDS (1)..(822): transl_table=11
atggctggttatatatcagatgacacaagaaaagtgacgactcatcgcctaatcgaaatgaagcaaagaggcgaaaaaatatctatgcttacatcgtatgactacacaatggcacagattgtcgacggtgccggtatcgatgtaattcttgtaggcgattccgcatcgaatgtgatggcaggtaatgtgactacacttcctattaccctggatcagatgatctatcatggaaaatcggttgtacgtggtgtaaagcgtgcaatggtagtagtggatatgccttttggctcttatcagggtaatgaaatggaagggcttgcttcagctatccgcataatgaaggagagtcatgccgatgcattgaaactggaaggtggtgaagagattatagatactgtgaaacgtattctgagtgccggtatccccgtgatgggacatcttggactgatgccacaatctatcaataaatatggtacatacacggttcgtgccaaggatgatgccgaagcagagaaattgattcgtgatgcacatttacttgaggaggccggatgtttcggacttgttcttgaaaagattcctgcagcattggcatcacgtgtcgcaagcgaactgaccattccggtgatcggtatcggtgccggtggagatgtagacggacaggtattggtaattcaggatatgttgggtatgaataacggtttccgcccgcgcttccttcgtcgttatgccgatctttatacggtaatgaccgatgctatcagtcactatgtttcagatgtaaagaactgcgacttcccgaacgagaaagaacaatattaa

SEQ ID NO: 101165 - protein, 273 aa, Bacteroides fragilis
MAGYISDDTRKVTTHRLIEMKQRGEKISMLTSYDYTMAQIVDGAGIDVILVGDSASNVMAGNVTTLPITLDQMIYHGKSVVRGVKRAMVVVDMPFGSYQGNEMEGLASAIRIMKESHADALKLEGGEEIIDTVKRILSAGIPVMGHLGLMPQSINKYGTYTVRAKDDAEAEKLIRDAHLLEEAGCFGLVLEKIPAALASRVASELTIPVIGIGAGGDVDGQVLVIQDMLGMNNGFRPRFLRRYADLYTVMTDAISHYVSDVKNCDFPNEKEQY

SEQ ID NO: 101166 - DNA, 840 bp, Bacillus halodurans
  CDS (1)..(840): transl_table=11
atgaagacgacagcaagctttaaaaaaatgaaacaacaaaaggaaaaaattgcgatgatgactgcttatgatgcaccatcggcaaggctagtagaggacgcagatgttgacatgattcttgtaggtgattcgctcggaatggtcgtgttaggttacgattcaacgattccggtcacattggatgacatgatccaccatacaaaggccgtaaagcggggagcgaaaaacaccttcatcgtaacggatatgccgtacttaacgtatcatggctcatttaatgaaacgttggtaggagcaaaacgactcatgcaggaggctggagctgatgcgcttaagcttgaaggaaatggggacatcattgatacgattgagcgtctaacgttagcaggtgttccgatcgtggcccatttaggtctaaccccgcaaaacgtagcagtggaaggcggctaccgagttcaagcaaaggatgcgaaaagcgcaaagcaactattggccgatgcaaaagcagttgaggcggctggagcgttcgcccttgtgctagagtgtgtgcctgagcaagtcgctacccaaattagcgaagagttaacgatccccgtcatcggaatcggggcaggcgcaggctgtgatggacaagtgctcgtctaccatgatgtgatcgggtatggagcaggtcacgtgccgagctttgtcaagcaatatgtaaacataacaaagccgattgaagaggccatgaagcaatatgttcaagaggttaaggcagggacatttcccgataaagatcacgccttttctcttaaagagaatgtcattcaggaactgtatggaggagcactcacatga

SEQ ID NO: 101167 - protein, 279 aa, Bacillus halodurans
MKTTASFKKMKQQKEKIAMMTAYDAPSARLVEDADVDMILVGDSLGMVVLGYDSTIPVTLDDMIHHTKAVKRGAKNTFIVTDMPYLTYHGSFNETLVGAKRLMQEAGADALKLEGNGDIIDTIERLTLAGVPIVAHLGLTPQNVAVEGGYRVQAKDAKSAKQLLADAKAVEAAGAFALVLECVPEQVATQISEELTIPVIGIGAGAGCDGQVLVYHDVIGYGAGHVPSFVKQYVNITKPIEEAMKQYVQEVKAGTFPDKDHAFSLKENVIQELYGGALT

SEQ ID NO: 101168 - DNA, 840 bp, Bacillus clausii
  CDS (1)..(840): transl_table=11
gtgaaaacaacaaaaacgtttaaacaaatgaagcgagatggtgagccgattgcgatgcttacggcttatgatgctccttctgcccgcttggcagaacgagctggcgtagacatgatccttgtcggagattccctcggaatggtagtgcttggttacgactccacggttcctgtaagcgttgatgatatggtgttgcatacgaaagcagtcaaacgtggggcgccgaacacatttgttgtcacggatatgccgtttttaacgtaccatagctccttttctgaaacggctggccatgtgcgcaggctgttgcaagaggcaggagccgatgcggtaaagctggaaggaggcacagacattgccagcactgtgcaacgtctaacggcagcgggtgtgcctgtcgttggacatatcggcttgacgccacaatcagtcggtgttttaggcggctatcgcgtgcaaggaaaggcgcaagaagaaggcgaacaattgcttgctgacgcacaggcattggaacaagcaggcgcgtttgccattgtcgttgagtgtgtgccaaagcagcttggtgccctgttggctaaagaaatcaacgtgccgattattggcattggcgctggagcagagacagatggccaagtccttgtttatcacgacgtgattggctacgagtcggaacgagtggcgaaatttgtcaaacaatatacggctgtatcgccaatcattgaggaagggctcgcttcttatgtcaccgatgtaaaacaacgggcatttcctgaagaagcccatacgtatacaacgaacgacacaggctggttggctgtgtatgggggcgacaaaaaatga

SEQ ID NO: 101169 - protein, 279 aa, Bacillus clausii
MKTTKTFKQMKRDGEPIAMLTAYDAPSARLAERAGVDMILVGDSLGMVVLGYDSTVPVSVDDMVLHTKAVKRGAPNTFVVTDMPFLTYHSSFSETAGHVRRLLQEAGADAVKLEGGTDIASTVQRLTAAGVPVVGHIGLTPQSVGVLGGYRVQGKAQEEGEQLLADAQALEQAGAFAIVVECVPKQLGALLAKEINVPIIGIGAGAETDGQVLVYHDVIGYESERVAKFVKQYTAVSPIIEEGLASYVTDVKQRAFPEEAHTYTTNDTGWLAVYGGDKK

SEQ ID NO: 101170 - DNA, 834 bp, Bacillus subtilis
  CDS (1)..(834): transl_table=11
atgaaaacaaaactggattttctaaaaatgaaggagtctgaagaaccgattgtcatgctgaccgcttatgattatccggcagctaaacttgctgaacaagcgggagttgacatgattttagtcggtgattcacttggaatggtcgtcctcggccttgattcaactgtcggtgtgacagttgcggacatgatccatcatacaaaagccgttaaaaggggtgcgccgaatacctttattgtgacagatatgccgtttatgtcttatcacctgtctaaggaagatacgctgaaaaatgcagcggctatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataa

SEQ ID NO: 101171 - protein, 277 aa, Bacillus subtilis
MKTKLDFLKMKESEEPIVMLTAYDYPAAKLAEQAGVDMILVGDSLGMVVLGLDSTVGVTVADMIHHTKAVKRGAPNTFIVTDMPFMSYHLSKEDTLKNAAAIVQESGADALKLEGGEGVFESIRALTLGGIPVVSHLGLTPQSVGVLGGYKVQGKDEQSAKKLIEDSIKCEEAGAMMLVLECVPAELTAKIAETLSIPVIGIGAGVKADGQVLVYHDIIGHGVERTPKFVKQYTRIDETIETAISGYVQDVRHRAFPEQKHSFQMNQTVLDGLYGGK

SEQ ID NO: 101172 - DNA, 822 bp, Bacteroides thetaiotaomicron
  CDS (1)..(822): transl_table=11
atggctggttatatatcagatgacacaagaaaggtgactactcatcgcctggttgaaatgaagcaaagaggcgaaagaatatctatgcttacttcttatgattacacaatggcacagatcgtagatggtgcgggaatggacgtaattttggtaggcgactccgcttccaacgtgatggcaggtaacgtgactacattgcctataactctcgaccagatgatttatcacgctaaatcagtggtacgtggcgtaaaacgcgctatggttgtagtcgatatgcctttcggatcttatcagggtaacgaaatggaaggtcttgcttctgccatccgcattatgaaggaaagccatgccgatgctttgaaactggaaggtggagaagaaatcatcgatacggtgaaacgtatcatcagcgcgggtattccggtgatgggacacttgggactgatgcctcagtccattaataaatacggtacttatacggtacgtgccaaagatgacagcgaagctgaaaagctgattcgtgatgctcatcttctcgaagaggcaggctgctttgccatcgtactcgaaaagataccggctactcttgcagaacgtgtggcttccgaactgacgatacctattataggtattggtgccggtggtcatgttgacggacaagtattggtcattcaggatatgcttggaatgaacaacggattccgtccgcgcttcttacgtcgttatgcagacctgtatacggtgatgactgacgctatcagccgttacgtatccgacgtgaagaattgcgacttccctaacgagaaggaacaatattaa

SEQ ID NO: 101173 - protein, 273 aa, Bacteroides thetaiotaomicron
MAGYISDDTRKVTTHRLVEMKQRGERISMLTSYDYTMAQIVDGAGMDVILVGDSASNVMAGNVTTLPITLDQMIYHAKSVVRGVKRAMVVVDMPFGSYQGNEMEGLASAIRIMKESHADALKLEGGEEIIDTVKRIISAGIPVMGHLGLMPQSINKYGTYTVRAKDDSEAEKLIRDAHLLEEAGCFAIVLEKIPATLAERVASELTIPIIGIGAGGHVDGQVLVIQDMLGMNNGFRPRFLRRYADLYTVMTDAISRYVSDVKNCDFPNEKEQY

SEQ ID NO: 101174 - DNA, 828 bp, Bartonella henselae
  CDS (1)..(828): transl_table=11
atgactattcataaggctgtaaagcgtattactgcttctgaaatacgatcaagaaaaggacaagaaccgattgtttctctaactgcttatcaggcttatagtgcgcggattgctgatccttactgtgatttgctattagttggtgatagcgttggtatggttgtgcatgggtttgagacaacgttgccagtgagtttggatatgatgattttgcatgggcaggctgttatgcgtggatctaagagggctcttgtggttgtagatatgccttttggatcttatgaagaaagcccagaacaagctttttccaatgcatcgcgtattcttgcagaaacagggtgtagtgcagttaagcttgaaggtggtgtttatatagcggaaacaattgattttttgtgtaaacgcggtatcccagttatgagtcatgttggtctgacaccacaggcagtgaatcgttttggtggttttaagacgcaaggacgcaatgaaagtaattggcaacagattgaagctgatgcagcagcaattgaaaaggcaggtgcctttgctgttgttgtggaaggagttgtagaaccattagcagtaaaacttacacagatgctttctatccctaccattggcattggtgcatctagtcagtgtgatgggcagatattggtgatggaagatatgttaggttacggtacatgggtccctaaatttgtacgccgttatggtgttctcgaacaggagatggagaaggcgattaagagttatgcggatgatgttaaatcacgtacttttccaagtgatgaagaaatttataagctcaaacaaaagtcaggttaa

SEQ ID NO: 101175 - protein, 275 aa, Bartonella henselae
MTIHKAVKRITASEIRSRKGQEPIVSLTAYQAYSARIADPYCDLLLVGDSVGMVVHGFETTLPVSLDMMILHGQAVMRGSKRALVVVDMPFGSYEESPEQAFSNASRILAETGCSAVKLEGGVYIAETIDFLCKRGIPVMSHVGLTPQAVNRFGGFKTQGRNESNWQQIEADAAAIEKAGAFAVVVEGVVEPLAVKLTQMLSIPTIGIGASSQCDGQILVMEDMLGYGTWVPKFVRRYGVLEQEMEKAIKSYADDVKSRTFPSDEEIYKLKQKSG

SEQ ID NO: 101176 - DNA, 828 bp, Bartonella quintana
  CDS (1)..(828): transl_table=11
atgagtatccatcaaaccataaagcgtattactgctgctgaaatacgatcaagaaaagggcaagaaccgattgtttctctaacggcttatcaggcttacagtgcgcggattgctgatccttattgcgattttcttttggttggtgatagcgttggtatggttgtgcatggctttgagacaacgcttccagtgagtttggatatgatgattttgcatgggcaggcggttatgcgtggggctaagaaggcattggttgttattgatatgccttttggttcttatgaagaaagtccagaacaggctttttccaatgcgtcccgtattcttgcggaaacagggtgtggtgcagtgaaattggaaggtggtgtttatatagcggaaacgattgattttttgtgtaagcgcggtatcccagttatggggcatattggccttacaccacaggcagtaaatcgttttggtggttttaagacgcaagggcgcaatgaaagtaattggcaacagatcgaagctgatgcagcagcaattgaagaggcaggtgcctttgctgttgttgtggaaggggttgtagaaccattagcagtaagacttacagagatgctttctattcctaccattggcattggtgcatctagtcagtgtgatgggcagatattggtgatggaagatatgttaggttatggtacttgggttcctaaatttgtacgtcgttatggtgctctcgaacaggagatggagaaggcgatcaagagctatgcggatgatgttaaatcacgtgcttttccatctgaagcagaaatttataagctcaaacaaaagtcaggttaa

SEQ ID NO: 101177 - protein, 275 aa, Bartonella quintana
MSIHQTIKRITAAEIRSRKGQEPIVSLTAYQAYSARIADPYCDFLLVGDSVGMVVHGFETTLPVSLDMMILHGQAVMRGAKKALVVIDMPFGSYEESPEQAFSNASRILAETGCGAVKLEGGVYIAETIDFLCKRGIPVMGHIGLTPQAVNRFGGFKTQGRNESNWQQIEADAAAIEEAGAFAVVVEGVVEPLAVRLTEMLSIPTIGIGASSQCDGQILVMEDMLGYGTWVPKFVRRYGALEQEMEKAIKSYADDVKSRAFPSEAEIYKLKQKSG

SEQ ID NO: 101178 - DNA, 792 bp, Bdellovibrio bacteriovorus
  CDS (1)..(792): transl_table=11
gtgaaaaccatcctcgatttccacgacaagaaaagcaaaaagcaaaagatctcgatgatcacttgctatgactattccttcgcccgcattgtggccgacagtgatatcgactgcattctggtcggagactctttggcgatggtgatgctgggtcattccaccacgctggatgtttccgccagtgtcatggctcatcacacagccgccgttgtgcgcggggcgggtgataagtttgtgatcgcggatctgccattcatgagttaccgcaaaggcctgaccgccaatatgacggctgttgaaaaagtgatgaaggccggtgctcacgccgtgaagctggaaggcgctgccggaaatttgaaactggtccgccatctggtggattcaggtgtgccggtgatgggacatctgggcctgactccgcaatcagtcaatcaactgggtggattcaaggttcagggccgtgatgaaaaagcccaaaagaaaattctggaagccgctctgcaactgcaggacgccggggctttttccgtggttcttgaatgtgtcccttcgaaactggccaaagaaatcaccgcagccctggagattccaactatcggaatcggtgcgggcgtggattgcgacggacaggtgctggtactgcaagatatgctcggcatgaaccaaggcttcaaaccgaagttcgtgaaaacataccttgatggctttaacaccattaaaggtgccttgaaccagtatcatcaggaagtcagcaccgaaatcttcccgtccgagaaagagagctattcatga

SEQ ID NO: 101179 - protein, 263 aa, Bdellovibrio bacteriovorus
MKTILDFHDKKSKKQKISMITCYDYSFARIVADSDIDCILVGDSLAMVMLGHSTTLDVSASVMAHHTAAVVRGAGDKFVIADLPFMSYRKGLTANMTAVEKVMKAGAHAVKLEGAAGNLKLVRHLVDSGVPVMGHLGLTPQSVNQLGGFKVQGRDEKAQKKILEAALQLQDAGAFSVVLECVPSKLAKEITAALEIPTIGIGAGVDCDGQVLVLQDMLGMNQGFKPKFVKTYLDGFNTIKGALNQYHQEVSTEIFPSEKESYS

SEQ ID NO: 101180 - DNA, 837 bp, Bordetella bronchiseptica
  CDS (1)..(837): transl_table=11
atgagcgtgcccaccgccgccaaacgcatcaccacccgccaattgcgcatgcgcacgccggacgagcccatcgtggcgctgaccgcctacacggctcccatcgccggcctgctggatgcgcactgcgacctgctgctggtgggcgactcgctgggcatggtcatctacggcatggaaaccaccctgccggttaccgtggacatgatgatccagcacggccgcgccgtgatgcgcggttcgcagcgtgcctgcgtggcggtggacatgccgttcggcagctaccaggaagacgagcgccaggcctatcgcaacgccgcccgcatcatggccgagaccggcgcaagctgcgtcaagctggagggcggcgcggaaatggcctcgaccgtggcgttcctggtcgagcgcggcattcccgtgatgggccacgtcgggctcaagccccaatcggtgcacggccatggcggcttccgtaccgtcggccgcggcgccgaggccgagcaggtcatggccgacgcacaggccatcgccgcggcgggcgcctttacggtggtcatcgaaggcacgcttgaacccgtggcgcgcgccatcaccgaggccttgcccgttcccaccatcggcatcggcgcctcgcccgcctgcggcggacagatcctggtgtcggacgacgtgctgggcctgttctcggatttcacgccgcgctttgtcaagcgctacgcgcagctgggccccatcatcgaacaggccgccgcggcctacgccagcgaggtccgcgcgcgcacgttcccggcgccggaacactgcaccggcatgccggcgcccgacggccgcccggcctga

SEQ ID NO: 101181 - protein, 278 aa, Bordetella bronchiseptica
MSVPTAAKRITTRQLRMRTPDEPIVALTAYTAPIAGLLDAHCDLLLVGDSLGMVIYGMETTLPVTVDMMIQHGRAVMRGSQRACVAVDMPFGSYQEDERQAYRNAARIMAETGASCVKLEGGAEMASTVAFLVERGIPVMGHVGLKPQSVHGHGGFRTVGRGAEAEQVMADAQAIAAAGAFTVVIEGTLEPVARAITEALPVPTIGIGASPACGGQILVSDDVLGLFSDFTPRFVKRYAQLGPIIEQAAAAYASEVRARTFPAPEHCTGMPAPDGRPA

SEQ ID NO: 101182 - DNA, 828 bp, Brucella melitensis
  CDS (1)..(828)
atgagtgcacccgtaacccgcaaacggctgacgccgaaggttattcaggcgatgaagggcgagtgtcccatcgtcagcctcaccgcttatacgacgccggttgcgcgtctgctcgacccgcattgcgacctgcttctggtgggggattcgcttggcatggtactttacggcatggagtccacgcttgccgtcacgctcgacatgatgatcatgcatgggcaggcggtcatgcgcggtacaagccatgcctgcgtgatcgtggatatgcctttcggctcctatcaggaatcgaaggagcaggccttccgcaatgccgcccgtgtgatgcaggaaacgggctgtgacggcgtgaagctggaaggcggcgaggaaatggccgaaacggtggcctttctcgtccggcgcggcattccggtcttcggccatgtcgggctgatgccgcagcaggtgaatacggtcggcgggtttcgttcgctggggcgcggcgacgatgaagccggcaagatacgccgcgacgcgcaagccattgcccaagcgggtgctttcgcggtggtcatcgaaggcacggtcgagccgcttgcgcgcgaaataacggccttgatcgatattccgaccgtcggtatcggcgcttcatccgcctgcgacgggcaggttctggtttcggatgacatgctgggcctgttccaggatttcacgccgcgtttcgtcaagcgttttgcgcatctggcgccgcaggtgtcgcaagcggccgaagcctatgccgaagaggtgcgcgcgcgcagatttcccggcccggaacatgttttcggggccaagcccggagcgtga

SEQ ID NO: 101183 - protein, 275 aa, Brucella melitensis
MSAPVTRKRLTPKVIQAMKGECPIVSLTAYTTPVARLLDPHCDLLLVGDSLGMVLYGMESTLAVTLDMMIMHGQAVMRGTSHACVIVDMPFGSYQESKEQAFRNAARVMQETGCDGVKLEGGEEMAETVAFLVRRGIPVFGHVGLMPQQVNTVGGFRSLGRGDDEAGKIRRDAQAIAQAGAFAVVIEGTVEPLAREITALIDIPTVGIGASSACDGQVLVSDDMLGLFQDFTPRFVKRFAHLAPQVSQAAEAYAEEVRARRFPGPEHVFGAKPGA

SEQ ID NO: 101184 - DNA, 792 bp, Buchnera aphidicola subsp
  CDS (1)..(792): transl_table=11
atggagtccattacaatctctcaattaaagaattggaaaataaataaaaaaaaatttgcagctattacagcttatgattttagtttttctagattgttttctaattgtggcattcctgtcatacttataggagactctcttggaatgactatacaaggtcacacttctactttaccagtgaagattgaagatattgcatatcatacaaaagctgtcagaaaaggagctcctaatacgttcttaatatctgatttaccttttatgtcttattatgacactaaacaggctcttaaaaacacagcaaaaattataagatctggtgcaaatatgataaaaatggaaggtggaaaatggctaattgaaattattagagaactatctaatagattaatattaatttgcggtcatattggtttaatacctcaatcttttcattatttaggtggctataaagttcaaggacgaaaagaaaatgacgctaataaattaatagatgaagcattattattagaagaatctggaattaatatgcttatattagaatgtattccagaaaaactagcaaaaaagattactgaaagtttatcaattccagttattggaataggatcaggtaaaaatactgatggacaaattcttgtgatgcatgacttattaggtattactgaaggaaaaacacctagttttacaaaaaattttctctcagagagcgatagcattcaaaaagcaattcaaaagtatatatatgaagtggaacatagtatttatcctagcaaaaaacatagtttttaa

SEQ ID NO: 101185 - protein, 263 aa, Buchnera aphidicola subsp
MESITISQLKNWKINKKKFAAITAYDFSFSRLFSNCGIPVILIGDSLGMTIQGHTSTLPVKIEDIAYHTKAVRKGAPNTFLISDLPFMSYYDTKQALKNTAKIIRSGANMIKMEGGKWLIEIIRELSNRLILICGHIGLIPQSFHYLGGYKVQGRKENDANKLIDEALLLEESGINMLILECIPEKLAKKITESLSIPVIGIGSGKNTDGQILVMHDLLGITEGKTPSFTKNFLSESDSIQKAIQKYIYEVEHSIYPSKKHSF

SEQ ID NO: 101186 - DNA, 792 bp, Buchnera aphidicola subsp
  CDS (1)..(792): transl_table=11
atggaatctattactatatcaaaaatacaaaactggaaaaaaaatcaaataaaatttgctgctattacagcttatgatttcagtttttctagactttttgaaaaggaaggtattcctattatgcttgtaggtgattctctaggtatgactattcaaggtcataattctacactacctgtaaaaattcaagatattaaatatcatacaaaagcagtgagaagaggtgcaccaaattcctttttattgtctgatttaccatttatgtcgtattatagtatcgaagaaactttaaaaaacacagctaaaattatacaatctggtgctaatatgataaaaatagaaggtggaaaatggttagttgaaactgtcaaagaactatcaaaaagatcaatattagtgtgtggtcatataggattaaccccacaatctataaattttttaagcgggtataaaattcaaggaaaagaaaaaaatgatgcacaacgaataatagatgaagcctttattctagaagaagcaggaattaaaatgctagttttagaatgtattccttcacttttagctaaaaaaataactgaaaacttatctattccagtaattggtataggatcaggtcatcatactgacggacaaatacttgttatgcaagatttattaggaataacggatggaaaaaaactaaaatttgtaaaaaatttcctttgtcacaatggaagcattcaaaatgctattaaacaatatatcaatgaagttaaaaatggaaatttccccagtgaaaaatatagtttttaa

SEQ ID NO: 101187 - protein, 263 aa, Buchnera aphidicola subsp
MESITISKIQNWKKNQIKFAAITAYDFSFSRLFEKEGIPIMLVGDSLGMTIQGHNSTLPVKIQDIKYHTKAVRRGAPNSFLLSDLPFMSYYSIEETLKNTAKIIQSGANMIKIEGGKWLVETVKELSKRSILVCGHIGLTPQSINFLSGYKIQGKEKNDAQRIIDEAFILEEAGIKMLVLECIPSLLAKKITENLSIPVIGIGSGHHTDGQILVMQDLLGITDGKKLKFVKNFLCHNGSIQNAIKQYINEVKNGNFPSEKYSF

SEQ ID NO: 101188 - DNA, 783 bp, Burkholderia mallei
  CDS (1)..(783): transl_table=11
gtgacggtacccaaactgcaggcgatgcgggaagccggcgagaagatcgcgatgctcaccagctacgacgcaagcttcgccgccctcctcgatcgcgcgaacgtcgacgtgcaactgatcggcgattcgctcggcaacgtgctgcagggccaggcgacgacgctgcccgtcacgctcgacgacatcgcgtatcacaccgcatgcgtcgcgcgcgcgcagccgcgcgggctcgtcgtcgcggacctgccgttcggcacctacggcacgcccgccgacgcattcgcgagcgcggtgaagctgatgcgcgcgggcgcgcagatggtcaagctcgaaggcggcgaatggctcgccgaaacggtgcgcttcctcgtcgagcgggccgtgcccgtgtgcgcgcacgtcggcctcacgccgcagtcggtgcacgcgttcggcggcttcaaggtgcaaggcaagacggaagcgggcgccgcgcaattgctgcgcgatgcgcgcgcggtcgaggaagccggcgcgcagctcatcgtgctcgaggcggtgcccacgctcgtcgcggccgaagtcacgcgcgagctgtcgatcccgacgatcggcatcggcgcgggcgccgaatgctcgggccaggtactcgtgctgcacgacatgctcggcgtgttccccggcaagcggccgcgcttcgtcaaggatttcatgcaggggcagccgagcatcttcgcggcggtcgaggcctacgtgcgcgcggtgaaggacggcagcttccccgggcccgagcattcgttctga

SEQ ID NO: 101189 - protein, 260 aa, Burkholderia mallei
MTVPKLQAMREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 101190 - DNA, 816 bp, Burkholderia pseudomallei
  CDS (1)..(816): transl_table=11
atgacctaccttcaggaatccagccgaccggccgtgacggtacccaagctgcaggcgatgcgggaagccggcgagaagatcgcgatgctcaccagctacgacgcaagcttcgccgccctcctcgatcgcgcgaacgtcgacgtgcaactgatcggcgattcgctcggcaacgtgctgcagggccaggcgacgacgctgcccgtcacgctcgacgacatcgcgtatcacaccgcatgcgtcgcgcgcgcgcagccgcgcgggctcgtcgtcgcggacctgccgttcggcacctacggcacgcccgccgacgcattcgcgagcgcggtgaagctgatgcgcgcgggcgcgcagatggtcaagctcgaaggcggcgaatggctcgccgaaacggtgcgcttcctcgtcgagcgggccgtgcccgtgtgcgcgcacgtcggcctcacgccgcagtcggtgcacgcgttcggcggcttcaaggtgcaaggcaagacggaagcaggcgccgcgcaattgctgcgcgatgcgcgcgcggtcgaggaagccggcgcgcagctcatcgtgctcgaggcggtgcccacgctcgtcgcggccgaagtcacgcgcgagctgtcgatcccgacgatcggcatcggcgcgggcgccgaatgctcgggccaggtactcgtgctgcacgacatgctcggcgtgttccccggcaagcggccgcgcttcgtcaaggatttcatgcaggggcagccgagcatcttcgcagcggtcgaggcctacgtgcgcgcggtgaaggacggcagcttccccgggcccgagcattcgttctga

SEQ ID NO: 101191 - protein, 271 aa, Burkholderia pseudomallei
MTYLQESSRPAVTVPKLQAMREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 101192 - DNA, 825 bp, Campylobacter jejuni
  CDS (1)..(825): transl_table=11
atgagaaaaagtatgattagttttttggaaaaaaaggccaaaaatgaaaaaataaccatggtaagtgcgtatgattatcatagtgcaagaattttagacaatagcgatatagatattatattggttggagattcattagccatgacggtacttggtatgcaagatactttaagtgttactatggatgaaatgttgatttttaccaaagctgtttctcgcggagctaaaaagtctttcgtacttgctgatatgccttttatgtcttatcaaagttcagatcgtgacgctatcttaaatgcctcaagatttatcaaagaaagccacgcaaatggggtaaaagtggaagggggtatagaaatcgcaagtaagattaaattgatttcccaatcaggaatacccgtcgttgctcacctaggactaaccccacaagctgtaaatatgctaggtggctatagggttcaaggtaaagatttacaatcagcccaaaaaattatagatgatgcaaaagctgtgcaagatgcgggtgcttgtatgttggttttagaatgtgtgcctgtaaaactagcacaaaaaataagctctattttagaaattccaacaatcggcataggttcaggcaaatactgcgatggacaagttttagtttatcacgatcttttgggtttaaataaagattttaaagcaaaatttgtaaagcattttgataaaattgatcctcaagtaggagttgaaaaatatagagatgaagttaaaagcggtatttttccttcccaagagcacagctttgattatttagatgatgaattattagataaattatactaa

SEQ ID NO: 101193 - protein, 274 aa, Campylobacter jejuni
MRKSMISFLEKKAKNEKITMVSAYDYHSARILDNSDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSQEHSFDYLDDELLDKLY

SEQ ID NO: 101194 - DNA, 825 bp, Campylobacter jejuni
  CDS (1)..(825): transl_table=11
atgagaaaaagtattcttagttttttggaaaaaaaaggtaaaaatgaaaaaataaccatggtaagtgcctatgactaccatagtgcaaaaattctagataattgcgatatagatatcatattggttggagattcattagctatgacagtgcttggcatgcaagatactttaagtgtgaccatggatgaaatgttgatctttaccaaagctgtttctcgcggagctaaaaagtctttcgtacttgcggatatgcctttcatgtcttatcaaagctcggatcgtgacgctatcttaaatgcctcaagatttatcaaagaaagccatgcaaatggggtaaaagtggaagggggtatagaaatcgcaagcaagattaaattaatttcccaatcaggaatacccgtcgttgctcacctaggactaaccccacaagctgtaaatatgctaggtggatatagagttcaaggtaaagatttacaatcggctcaaaaaatcatagatgatgcaaaagctgtgcaagatgcgggtgcttgtatgttggttttagaatgcgtacctgtaaaattagcacaaaaaataagctctattttagaaattccaacaatcggcataggttcaggtaaatactgcgatggacaagttttagtttatcatgatcttttaggtttaaataaagattttaaagcaaaatttgtaaagcattttgataaaattgaccctcaagtaggagttgaaaaatatagagatgaagttaaaagcggtatttttccttccgaagagcacagctttgattatttagatgatgaattattagataaattatactaa

SEQ ID NO: 101195 - protein, 274 aa, Campylobacter jejuni
MRKSILSFLEKKGKNEKITMVSAYDYHSAKILDNCDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSEEHSFDYLDDELLDKLY

SEQ ID NO: 101196 - DNA, 834 bp, Chlorobium tepidum
  CDS (1)..(834): transl_table=11
atgaaccagccctctggcaataaattgccccacgtcacaacccgccggatgctcgatatgaaagagcgcggcgagaagatcgccatgctgaccgcctatgactacacgatggcgcggattctggaccgctcgggcgttgacgcgattcttgtcggcgattcggcgagcaacgtcttcgccgggcacagcaccacgctgccgatgaccgttgacgagatgatctaccacgccaaggcggtggtgcgtggcgtgcaggcagagacgcgacgggcgatggtgattgtcgatatgcccttcatgagctaccagctctcgccggaagatgcggtgcgcaacgccgggaaaatcatgaaagagcacgagtgcgacgcggtgaaaatggaggggggcaaggtgatcgccgaagcggtcaagcggatcaccgatatcggcattccggtgatgggccacctcggcctcatgccgcagtcgatctacaaatatggcagctacaaggtgcgcgcgatggaggaggaggaggcccggcagctcatcgaggatgcgaagatcatcgaggaggctggagcgttcgccatcgtgctcgaaaagattccatcgaagctcgccggtgaggtgagccgcttgctgaccattccgactatcggcatcggcgcggggccggagtgcgacggccaggttctggtcatcaacgacatgcttggcctcagcaccgacttccgccctcgcttcgtccgccgctacgctgacctctcctcggtgatcgagcaagcggtcaaaagctacgtcgaggatgtgcggagcaacagcttcccgtcggaggatgagagttactga

SEQ ID NO: 101197 - protein, 277 aa, Chlorobium tepidum
MNQPSGNKLPHVTTRRMLDMKERGEKIAMLTAYDYTMARILDRSGVDAILVGDSASNVFAGHSTTLPMTVDEMIYHAKAVVRGVQAETRRAMVIVDMPFMSYQLSPEDAVRNAGKIMKEHECDAVKMEGGKVIAEAVKRITDIGIPVMGHLGLMPQSIYKYGSYKVRAMEEEEARQLIEDAKIIEEAGAFAIVLEKIPSKLAGEVSRLLTIPTIGIGAGPECDGQVLVINDMLGLSTDFRPRFVRRYADLSSVIEQAVKSYVEDVRSNSFPSEDESY

SEQ ID NO: 101198 - DNA, 789 bp, Chromobacterium violaceum
  CDS (1)..(789): transl_table=11
atgaaaataaccgtcaataccctgcacaagctggccgaggaaggccggaagatcaccatgctgacctgctacgacgccagcttcgccagcctgctggacgaggccggcgtggaaatcctgctggtcggcgactcgctgggcccggtgatgcagggcgtggactccacgctgccggtcagcgaagaggacatgctctaccacatccgctgcgtggcccgcggcgccaagaacgcgctgatcctcggcgacatgaccttcggcgcctaccaggagagcccgcaacaggccttcgcccatgccgcgcgcctgctgcaggccggcgcccacatggtgaagctggaaggcggcgcctacatggccgagaccacccgcttcctggtggagcgcggcattccggtgtgctcccacatcggcctgacgccgcaatacgtcaacatgttcggcggctaccgcgtgcagggcaggggcgaagacgcgcagcgcatcctgaacgacgccaaggtcctggccgaggccggcgccagcctggtgctgatggagtgcgtgccggcgccgctggccaaggagatcaccgaaaccgtcaaggcgccgaccataggcataggcgcgggcgcggacacgtccggccaggtgctggtgctgcacgacatgctgggcgtgtatccgggcaagaaggccaagttcgtcaagaacttcatggaagaggccggcagcatccagggcgctgtccaggcttacatcaaggcggtgaaggacaagaccttcccggccgaagagcacacttactaa

SEQ ID NO: 101199 - protein, 262 aa, Chromobacterium violaceum
MKITVNTLHKLAEEGRKITMLTCYDASFASLLDEAGVEILLVGDSLGPVMQGVDSTLPVSEEDMLYHIRCVARGAKNALILGDMTFGAYQESPQQAFAHAARLLQAGAHMVKLEGGAYMAETTRFLVERGIPVCSHIGLTPQYVNMFGGYRVQGRGEDAQRILNDAKVLAEAGASLVLMECVPAPLAKEITETVKAPTIGIGAGADTSGQVLVLHDMLGVYPGKKAKFVKNFMEEAGSIQGAVQAYIKAVKDKTFPAEEHTY

SEQ ID NO: 101200 - DNA, 831 bp, Clostridium acetobutylicum
  CDS (1)..(831): transl_table=11
atgaaaaataccactgaaacatttaaaaattctaaatttaaaaaagagaagctcgttatgttaacagcctatgattactcaactgcaaagataattgattcctgcgacatcaatggaattctcgttggagattctcttggcatggtatgtctcggatacgaaaataccttaagtgtaacaatggaagacatgattcatcatacaaaagctgtagtacgtggtgcaaaaagcacccttattgtagctgacttaccttttatgtcatatcaaacttcagtttacgatgctgtttttaacgccggtaggcttgtcaaagaagctggtgctactgccattaaacttgagggcggtgctttagtctgcgatagaataaaagcaatcgtggatgctcaaattcctgtaatgggccatattggtcttactccccaatctgtaaatgcctttggcggttttaaaattcagggaaaaaatatctctaaagcaaaagaactaattgaagatgctaaaaagatagaagcagctggagcctttgctattactttagagggtattcctgagaaacttgctaaaattataactgaaagcattacaataccaactataggaattggtgctggtaaacattgtgatggtcaaatacttgtttatcaagatatgcttggaatgttttctgatttggcgcctaaatttgttaaaagatatggtaatataggtgacgacatgaaagaagcttttaatagttatgcaaaagaagtacgagaaggcacatttcctgacgaagctcactcatttaagattgatcagagcattatagacgaaattaccaaataa

SEQ ID NO: 101201 - protein, 276 aa, Clostridium acetobutylicum
MKNTTETFKNSKFKKEKLVMLTAYDYSTAKIIDSCDINGILVGDSLGMVCLGYENTLSVTMEDMIHHTKAVVRGAKSTLIVADLPFMSYQTSVYDAVFNAGRLVKEAGATAIKLEGGALVCDRIKAIVDAQIPVMGHIGLTPQSVNAFGGFKIQGKNISKAKELIEDAKKIEAAGAFAITLEGIPEKLAKIITESITIPTIGIGAGKHCDGQILVYQDMLGMFSDLAPKFVKRYGNIGDDMKEAFNSYAKEVREGTFPDEAHSFKIDQSIIDEITK

SEQ ID NO: 101202 - DNA, 810 bp, Corynebacterium efficiens
  CDS (1)..(810)
atgtctggcattgatgcaaagaagatccgcacccgtcacatccatgaggcgaaggcgaatgggacgaagatttccgtcctcaccagttatgacgcgatgaccgccgccatctttgatgaggcggggatcgatatgctgctggtcggtgattccgccgccaatgtggtgctggggcgggagaccaccctgtcgatcaccctggatgagatgatcgtgctggccaaggcggtcaccatcgcggctaaacgtgcgctggtcattgtggatctgcccttcggcacctatgaggtcagtgagcagcaggcggtggaatccgccgtgcgcgtcatgcgggagaccggcgccgcggccgtcaagatcgagggtggtgtggagatggcctccaccatccggcgcattgtcgacgccggcattcccgtctgcgggcacatcggtttcaccccgcagtccgagcatgccctcggcggacccgtggtccagggccgcggcagcggtgcggacaagctgcttgccgacgcccacgccgtccaggccgccggtgccttcgccgtggtcctggagatggtccccgccgagatcgccaccgaggtgaccaaccagctcgacatcgccaccatcggcatcggcgcaggtaacggcaccgatggccaggtgctcgtgtggcaggatgccttcgggttcaaccggggccgcaagccgcgtttcgtccgtgagtacgccaccttaggcgatcagctgctcgaggccgcccgcgcctacgccgatgaggtgggctccggcgcgttccccggcgaggtggagagctactga

SEQ ID NO: 101203 - protein, 269 aa, Corynebacterium efficiens
MSGIDAKKIRTRHIHEAKANGTKISVLTSYDAMTAAIFDEAGIDMLLVGDSAANVVLGRETTLSITLDEMIVLAKAVTIAAKRALVIVDLPFGTYEVSEQQAVESAVRVMRETGAAAVKIEGGVEMASTIRRIVDAGIPVCGHIGFTPQSEHALGGPVVQGRGSGADKLLADAHAVQAAGAFAVVLEMVPAEIATEVTNQLDIATIGIGAGNGTDGQVLVWQDAFGFNRGRKPRFVREYATLGDQLLEAARAYADEVGSGAFPGEVESY

SEQ ID NO: 101204 - DNA, 882 bp, Deinococcus radiodurans
  CDS (1)..(882): transl_table=11
atgcagcccgaatccgcgtctcctcaattggcgtctccggcccgcgtcaaacgcagcctgcccgacctgacccatcctgaactcacatcctctggcgcgccgctggtgatggtgaccgcctacgactatccgggcgcgcgccacgccgaggccgccggggtggacctgattctggtgggcgacagcctgggcaacgtggtgctgggctacgactccaccgcgccggtcacgcttgccgacatgattcaccacggcaaggccgtgcggcggggagcaccgaacacctttctggtggtggacctgccgttcggcacctaccacgcaggcgtgaccgacgcgatgcggcacgccgtgcgggtcattcaggagacgggcgccgacgccgtgaagatggaaggctccacccccgaggtgctcgacgtcgtgcgggtgctctcgcgcaacggcgtgccggtgatggggcacgtggggctgatgccgcagaccgccgccgcccagggaggcctgcgcgtgcagggcaaggacgacgacagcgcccgccgcaccctggaaggcgcagtcgcgttgcaggaagcaggggccttcgcggtggtcctcgaagccattcccgcccggctcgctcgcctgatttccgagcggctgagcgtcgccaccatcggcatcggcgcaggcgttcattgcgacgggcaggtactcgtctatcacgacctgctggggctctacgaaggcgaggaaaagaaaattgccaagcgctacgccgacctggggcgcgaggcccgtgaagccatcgctcactacgccgccgaggtccgcgcccgcgagtttcccagcaaggacaacagcttcgtgatgaaggacgaggtgctcgacaagctgtattga

SEQ ID NO: 101205 - protein, 293 aa, Deinococcus radiodurans
MQPESASPQLASPARVKRSLPDLTHPELTSSGAPLVMVTAYDYPGARHAEAAGVDLILVGDSLGNVVLGYDSTAPVTLADMIHHGKAVRRGAPNTFLVVDLPFGTYHAGVTDAMRHAVRVIQETGADAVKMEGSTPEVLDVVRVLSRNGVPVMGHVGLMPQTAAAQGGLRVQGKDDDSARRTLEGAVALQEAGAFAVVLEAIPARLARLISERLSVATIGIGAGVHCDGQVLVYHDLLGLYEGEEKKIAKRYADLGREAREAIAHYAAEVRAREFPSKDNSFVMKDEVLDKLY

SEQ ID NO: 101206 - DNA, 840 bp, Desulfotalea psychrophila
  CDS (1)..(840)
atgcgtaagaccgttgtggatattattgcaatgaaggccgccgggcagaagataagcatgcttaccgcctatgatgcctccatgtctgccctgcttgatcaggctggaatcgacatcctcttggttggtgattctcttggaatgaccgtgctcggctatgattcgacggttcctgtcaccatggctgatatggttcatcatatggcagcggtgcgtcgcggggccccagatgcctttgtggtgggcgatatgccctttggctcctatcaaacaggggcgcgtgatgctgtccttaatgccatgcgtttgctgaaagagggtggttgtgatgtggtaaagcttgaaggtggtgaggtcgtctgtcctgtggttaaggccattgttgatgcggggattcctgttatgggccatttagggcttactcctcagactgcggcagtgctcggtggttacaaggtgcagggtcgtgatatggaggctgccagaaaactctttgccgatgccaaaagattggaagaggccggggtctgtgggctggttctggagtgcattcctgcaggtcttgccgaagttgttacagcatccatagcggtgcccaccgtaggcattggggcgggcaagggctgtgatggccaggttctggttattaacgatatgctgggactctttgaaaaatttactcccaagtttgtcaaacattatgcccagctagctcctctggtccggcagggagtagaaaactatatcggcgaggttcgtgccggtgcctttccggaggcagagcatacctttaccagttcctgtgattataaggttctcctctccggagatgatcagtaa

SEQ ID NO: 101207 - protein, 279 aa, Desulfotalea psychrophila
MRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 101208 - DNA, 1050 bp, Emericella nidulans
  CDS (1)..(1050)
atgactttcttaagaatagcgacaaagcgggccatatacctgcatcgtcctgctaatccggctcttcctacctcgtctatactccctgtcctgcacagcaccaacgtcgccactcgtgtaccctcaccatgcgccatccgtcatagctcccactcgccgttgggagcagcccaagccaatcccagaaagaaagttaccatgcagaccttacgaaatttatacaagaagggcgagcctattacaatgttgactgcgcacgattttccgagcgcgcatgtcgccgacgcagccggaatggacatgattctcgtgggtgatagcttggcaatggtcgctctgggcatgcaggatacgagcgaagtgactctagatgacatgttagtgcactgtcgcagtgttgcccgagctgctcagagcgcctttacagtttcagatttacctatgggttcgtacgaggtgtcgccagaacaagctcttcagtcggctattcgaatcgtgaaagagggtcgggtgcagggggttaagcttgaaggtggggaggagatggctccagccatcaagcgcatcacaactgctggtattcccgttgttggacatatcggtctcacgcctcagcgtcaaaacgcgcttggagggtttcgagttcaaggaaagtcaacgacggacgcactgaaactgttaaaggacgcacttgcggtacaagaagcaggtgcgttcatgatagttatcgaggccgtaccgccagagatcgcaagtattgtcacacaaaagctcagtgttcctaccattggtattggtgccgggaacggttgctctggacaagtactcgtccagattgacatgaccgggaacttcccgcctggtcgcttcttacccaaatttgttaagcagtatgccaacgtctggaacgaggcactccaaggcatccaacagtatcgtgaggaggttaagagccgagcgtatcccgcagagcagcacacataccctataccgaaagaggaactggttgaattccagaaggctgttgatgaattacctgaagagaaatga

SEQ ID NO: 101209 - protein, 349 aa, Emericella nidulans
MTFLRIATKRAIYLHRPANPALPTSSILPVLHSTNVATRVPSPCAIRHSSHSPLGAAQANPRKKVTMQTLRNLYKKGEPITMLTAHDFPSAHVADAAGMDMILVGDSLAMVALGMQDTSEVTLDDMLVHCRSVARAAQSAFTVSDLPMGSYEVSPEQALQSAIRIVKEGRVQGVKLEGGEEMAPAIKRITTAGIPVVGHIGLTPQRQNALGGFRVQGKSTTDALKLLKDALAVQEAGAFMIVIEAVPPEIASIVTQKLSVPTIGIGAGNGCSGQVLVQIDMTGNFPPGRFLPKFVKQYANVWNEALQGIQQYREEVKSRAYPAEQHTYPIPKEELVEFQKAVDELPEEK

SEQ ID NO: 101210 - DNA, 828 bp, Enterococcus faecalis
  CDS (1)..(828): transl_table=11
atgaaaaatacagcagttacatttaaagaatctaaattaagaaatgaaaaattaacaatgcttacagcttatgactattcaacagcaaaaataattgatgaagctgggataaatggaatattagtaggagattctcttggtatggtatgtctaggacatgaagatacactttcagtaacaatggaagacatgattcatcatactagagcagttacaagaggagctaagaacactttagttgttgcagatatgccatttatgtcttatcaaacttcagtatatgattcagtagttaatgcaggaagattaataaaagaaggacgagctcaggttgttaaattagaaggagggatagaagtatgcgataaaatagaggctatagtaaaggcttctatacctgttatggcgcatataggtttaacacctcaatctgttaatgcatttggaggatttaaggtacaaggaaaggacaaggaagctgctaaagaattaataagagctgctaaagctgtagaaaaagcaggagcattcgctgtagtgttagaatgtgttccaactaagcttgcagagttaatttctaaagagatatcaatacctacaattggtattggagcaggtgcagggtgtgatggacaaattcttgtatatcaagatatgttggggatgtatagtgattttacccctaaatttgtgaagaaatatgctaatttatcagaagagatgaataaagcatttacaaaatatatagaggaagtaaaagatggagtttttccaggtccagaacatgggtttaaaataagtgatgatgttttagaaaaattatattaa

SEQ ID NO: 101211 - protein, 275 aa, Enterococcus faecalis
MKNTAVTFKESKLRNEKLTMLTAYDYSTAKIIDEAGINGILVGDSLGMVCLGHEDTLSVTMEDMIHHTRAVTRGAKNTLVVADMPFMSYQTSVYDSVVNAGRLIKEGRAQVVKLEGGIEVCDKIEAIVKASIPVMAHIGLTPQSVNAFGGFKVQGKDKEAAKELIRAAKAVEKAGAFAVVLECVPTKLAELISKEISIPTIGIGAGAGCDGQILVYQDMLGMYSDFTPKFVKKYANLSEEMNKAFTKYIEEVKDGVFPGPEHGFKISDDVLEKLY

SEQ ID NO: 101212 - DNA, 795 bp, Erwinia carotovora subsp
  CDS (1)..(795): transl_table=11
atgaaaccgacgactatctcccacttgcgccaatggaaacaagagcagcgaaaattcgctacgataacggcttacgatgccagcttctctcgtttgttttttgaacaaggcattcgcgtgatgctggtgggtgactctctgggaatgaccgtgcaaggtcacgactccacactgcccgtgaccacacacgacatcgtttaccatacacagtgtgtccgccgtggcgcaccgctggcactggttctctccgatatgccttttatgacctacgccacgccggaacaaacattcagccaggcagcagaactgatgcgcgctggggcgaatatggtgaagctggaaggcggaagctggcttgccccaacggtaaaaatgctgactgaacgtgccgtgccggtttgcggtcatctgggtctgactccgcagtccgttaacatcttcggtggctataaaattcagggccgcagcgaaagcgatgccaatcagctgctggccgatgctcttgcgcttgaagaagcaggtgctcagttgctcgtgctggaatgcgtgcctgtcgcgctggccaaacgtgtaacagaagcgctgtctattcccgtgatcggcattggcgcaggcaacgtcaccgacgggcagattctggtcatgcatgatgctttaggcattaccggcgacagcacgcctaagtttgccaagaattttctggcgcaaagcggtgatattcgcacggcggtacgcctgtattcacaagaagtcgaacagggtatctacccagccgaagaacattcatttcattaa

SEQ ID NO: 101213 - protein, 264 aa, Erwinia carotovora subsp
MKPTTISHLRQWKQEQRKFATITAYDASFSRLFFEQGIRVMLVGDSLGMTVQGHDSTLPVTTHDIVYHTQCVRRGAPLALVLSDMPFMTYATPEQTFSQAAELMRAGANMVKLEGGSWLAPTVKMLTERAVPVCGHLGLTPQSVNIFGGYKIQGRSESDANQLLADALALEEAGAQLLVLECVPVALAKRVTEALSIPVIGIGAGNVTDGQILVMHDALGITGDSTPKFAKNFLAQSGDIRTAVRLYSQEVEQGIYPAEEHSFH

SEQ ID NO: 101214 - DNA, 795 bp, Francisella tularensis subsp
  CDS (1)..(795): transl_table=11
atgaaatcagttttaggcttcaaaaaagctaaagtaacagaaaaaatctcgatggtaacatgctatgactatactttagctaaaattataaactcaacagatatagactgtatcctcgttggcgatagtggtggtatggtattacttggtaaaaaaaatactacttatacaacccttgatgacatgcagttcatgactcaagcggtagctaatggtgctacagataaattcatagtcgctgatttaccatttatgagttatcgccaatcattagaaacaacaatgcaggctgtaatggcactgattcaatcaggagctcatgcgattaagcttgaaggtagttcaggaaatttagatattattaaacatatcgtagattctggtgttccagtaatgggacacattggtatgacaccacaatttataaatagctttggaggttttaaagttcaaggtagaactgaagaagccgccaaacacttacttgaagaagctaagcttctcgagcaagcaggatgctttggaatagttctagaatgtataccagcaaatattgctaaagatattacgcaaaatttagacatcccaacaataggtattggtgctggtagcaatactgatggtcagattttagttctccaagatatgcttggcatgaatactgactttcaaccaaaatttgtcaaaaaatatatagacggctcaaagttattttctgatgctataaatacatatgttaaagaaacaaaagctaatacttttcctactaaggagcattgttatgattattgctga

SEQ ID NO: 101215 - protein, 264 aa, Francisella tularensis subsp
MKSVLGFKKAKVTEKISMVTCYDYTLAKIINSTDIDCILVGDSGGMVLLGKKNTTYTTLDDMQFMTQAVANGATDKFIVADLPFMSYRQSLETTMQAVMALIQSGAHAIKLEGSSGNLDIIKHIVDSGVPVMGHIGMTPQFINSFGGFKVQGRTEEAAKHLLEEAKLLEQAGCFGIVLECIPANIAKDITQNLDIPTIGIGAGSNTDGQILVLQDMLGMNTDFQPKFVKKYIDGSKLFSDAINTYVKETKANTFPTKEHCYDYC

SEQ ID NO: 101216 - DNA, 840 bp, Geobacillus kaustophilus
  CDS (1)..(840): transl_table=11
atgaaagcgaaaaccgattttttccacatgaagcaggcgggtgagccgatcgtgatggtgaccgcctacgattttccgtccgcgaagcttgccgagcaagccggcgtcgacatgattttggtcggcgattcgctcggcatggttgtgctcgggtatgattcaacgatcccggtgacggtcgatgatatgatccaccatacgaaggcggttcgccgcggtgcgccgaacacgtttattgtcaccgatatgccgtttatgtcgtaccatgcgtccaaagaagaggcgctgcaaaacgcccgccgcatcatgcaagagtcaggggcgaacgccgttaaagtcgaaggagcggatgaagtcgtcgatatgattgccgcgctgacgaaagccggcgtgccggtcgttgcccatctcgggttgacgccgcaatcggtcggcgttcttggcggctataaagtgcaaggcaaagatgccgaaagtgcgaaaaagctgctcgatgatgcgaaacaatgcgagcaggcgggagcgatcgcccttgtcttagagtgtgttccgaagcagctcggggcggccatggcccgggaactcaccattcccgtcatcggcatcggcgccggggcggaagtcgacggccaagtgctcgtgtatcacgatttgcttggctacggtgtcacccgcgtgccgaagtttgtgaaacaatacgcgtccatccaagagacgatcgttgaggcgttagccaactacgtcgctgatgtcaaactgcgccagttcccggagccggcgcacacgtttacgatgaaggaagaagaatgggtggcgctttacggaggaaagcaaggatga

SEQ ID NO: 101217 - protein, 279 aa, Geobacillus kaustophilus
MKAKTDFFHMKQAGEPIVMVTAYDFPSAKLAEQAGVDMILVGDSLGMVVLGYDSTIPVTVDDMIHHTKAVRRGAPNTFIVTDMPFMSYHASKEEALQNARRIMQESGANAVKVEGADEVVDMIAALTKAGVPVVAHLGLTPQSVGVLGGYKVQGKDAESAKKLLDDAKQCEQAGAIALVLECVPKQLGAAMARELTIPVIGIGAGAEVDGQVLVYHDLLGYGVTRVPKFVKQYASIQETIVEALANYVADVKLRQFPEPAHTFTMKEEEWVALYGGKQG

SEQ ID NO: 101218 - DNA, 804 bp, Geobacter sulfurreducens
  CDS (1)..(804): transl_table=11
gtgaaccgcgcgaaaaccatcctcgatatccagaaaatgaaggcgacgggcgagaagataaccgtccttaccagctacgactatccctttacccgcattatggatgaatgcggcatcgacatgattctggtcggagactcggtcggtgttgtctttgccggtcacgacaacaccctgccggttaccgtggacgatatgctctatcacacccgcgccgttacccgggccagaccaaaggctctggtggttacggacatgccgtttctttcctaccagaccgatttgcgcgatgcccgcatcaacgccggacgcctggtcaaggagggtggagccgaagcggtgaagctggaggggggagcccacgtgacggacaccatcagggccatcgtcgatatggacatcccggtcatggcccacatcggacttaccccccaatcgatccaccggatggggggctacaaggtgcagggcaaaaaggacgagcaggctcagcggttgctggaggatgccctcgcggtccaggaggcgggagcctttgccgtggtcctggaagggattccgctcaagcttgccggccgcatcaccgcagaactctccattcccaccattggcatcggtgccggtccccactgcgacggccaggttctcgttatccacgacatcctcggcctgtgcgagaagtactctcccaaattcgtcaagcgctacggcgatgctcgtacgctcatttccgacgcggtagcgtcctacatctcagaagtcaagaaaggagaattccccaccgaggggcattcgttcagctga

SEQ ID NO: 101219 - protein, 267 aa, Geobacter sulfurreducens
MNRAKTILDIQKMKATGEKITVLTSYDYPFTRIMDECGIDMILVGDSVGVVFAGHDNTLPVTVDDMLYHTRAVTRARPKALVVTDMPFLSYQTDLRDARINAGRLVKEGGAEAVKLEGGAHVTDTIRAIVDMDIPVMAHIGLTPQSIHRMGGYKVQGKKDEQAQRLLEDALAVQEAGAFAVVLEGIPLKLAGRITAELSIPTIGIGAGPHCDGQVLVIHDILGLCEKYSPKFVKRYGDARTLISDAVASYISEVKKGEFPTEGHSFS

SEQ ID NO: 101220 - DNA, 789 bp, Gloeobacter violaceus
  CDS (1)..(789): transl_table=11
gtgggcatggggttatccatccacagtctcagaaagctcaaagagcgcgcccaaccgattgtcgcccttaccgccaccgagtacgcgatggcccgcattctcgatcaagcgggggtcgatctgctgctggtgggcgactcgctttcgatggtcgccctgggccatacgagcaccctgccggtgacagtggacgagttgttgcaccactgccgggcagtgcgccggggggtcgagcgcgctttgctggtagccgatttgcccttcggttcctacgagcagagcccccagcaagctttttccaccgcgacccgatttctcaaagaagcgggagtgcaggcggtcaagctcgaaggcggttacccgcgcatgaccgagacggtcgcttttttgaccgaaagcggcatcccggtgctcgggcatctcggcctcaccccccaggcggttcaccagttggggggctaccgcgtccagggcaagaccgcccaggcggccgaacggctcatcgatcaggctctcgccctggagggggcgggggcgttcgcgctcgtgctggagcacattccctacgatctggcgggggaaattagcggcaaactggtcatcccgactgtcggcatcggcgccggtccgcactgcaacggccagatcctcgtcacccacgatctattgggccttactgagaatccgccgccttttgtaaatccttacgccgacttgcgcgcgcttatcagcaaagcggtcggccgctacagtgcggatgtgcgcgcccatggctcccgtgaggagtga

SEQ ID NO: 101221 - protein, 262 aa, Gloeobacter violaceus
MGMGLSIHSLRKLKERAQPIVALTATEYAMARILDQAGVDLLLVGDSLSMVALGHTSTLPVTVDELLHHCRAVRRGVERALLVADLPFGSYEQSPQQAFSTATRFLKEAGVQAVKLEGGYPRMTETVAFLTESGIPVLGHLGLTPQAVHQLGGYRVQGKTAQAAERLIDQALALEGAGAFALVLEHIPYDLAGEISGKLVIPTVGIGAGPHCNGQILVTHDLLGLTENPPPFVNPYADLRALISKAVGRYSADVRAHGSREE

SEQ ID NO: 101222 - DNA, 825 bp, Halobacterium salinarium
  CDS (1)..(825): transl_table=11
atgccaacggtgaattcagtgcggcgtgcgggcaacaccgacgaggaaaccgacccggtgacgatgctgaccgcgtacgacgcccccacggcgtcggtggtcgacgacgccggcgtcgacatgatcctggtcggggacagcgtcgggaacgcgaagctcggatacgacacgacgctgcccgtctccgtcgacgagatcgcgtcggcgaccggcgcggtcgcacgcgccaccgcggacgcggtcgtcgtcgcggacatgccgtttctgagcttcggcgccgacgagaccgagagcgtgcgaaacgccggtcgcatgctcaaagaggaggacgccgacgcggtgaaactcgaatccgggccgcacacggtgtcgctgaccgagacgctcacgtcgctggggattcccgtgatggcgcacctcgggttgaccccccagcacgtcaaccagctcggggggtatttccggcagggcaccgaccaggacagcgccgagcgcatgctggatctggcgcgcgaccacgaggccgccggcgcgttcgcgctcgtgctcgaacacgtgccggcgaacgtcgccgccgacatcaccgacgccatcgacatcccgaccatcggtatcggcgcggggccggacaccgacggccaggtgctcgtgatctcggacgtgatcgggatgtcagaacgcagcccgccgttctccaagcagttcggggacgtgaaccgagaaatggcggccgcggtcgacgactacgtcgacgcggtcgaatccggatcgttcccggcggccgagcacagccacgtcgccgacgacgtcgacgacgtgtactga

SEQ ID NO: 101223 - protein, 274 aa, Halobacterium salinarium
MPTVNSVRRAGNTDEETDPVTMLTAYDAPTASVVDDAGVDMILVGDSVGNAKLGYDTTLPVSVDEIASATGAVARATADAVVVADMPFLSFGADETESVRNAGRMLKEEDADAVKLESGPHTVSLTETLTSLGIPVMAHLGLTPQHVNQLGGYFRQGTDQDSAERMLDLARDHEAAGAFALVLEHVPANVAADITDAIDIPTIGIGAGPDTDGQVLVISDVIGMSERSPPFSKQFGDVNREMAAAVDDYVDAVESGSFPAAEHSHVADDVDDVY

SEQ ID NO: 101224 - DNA, 813 bp, Helicobacter pylori J99
  CDS (1)..(813): transl_table=11
atgagcatgcaaaccgccccaattaaaaaaatcacccttagtcacctccaagctaaaaaaaatcaagaaaaaatcatcgccattaccgcttatgacgccctattcgctcaaatatttgatccgctagtggatgtgattttagtgggcgatagtttgaatatgagttttttcaatcaaaacgacactttaagcgcgagtgtaaaaatgatgctctatcacactaaagccgtgtgcgcgggcgctaagactccttttatcatcacagacatgccctttggaagctataaagatgaaaaaacagccctaaaaaacgccatcagggtttataaagaaacccaagcgagcgcgatcaaactagagggggggaaagaaaaagcgaaactggttaaaacgctcactgatgagggcgttatcgtggtagggcatattggcttgatgcctcaattcgtgcgtcttgatggaggctataagattaagggcaaaaatgaagagcaacaaaaaaagcttttagaagacgcgttgagtttagaagaagctggagtgggtttgttggttttagagggtataaccacccctatcgctcaaacaatcacgcaaaaaatcaaaatccccacgatcggcatagggagcggcaaggattgcgacgggcagattttagtgtggagcgatatgttaggcttttttgatagttttaagcctaaattcgtgcgagaataccttaaagggaaagaattgattcaaaacgcgattcaacaatacgctgacgatgtgaaaaagggaaacttccctaacgaattagaaagttatcattaa

SEQ ID NO: 101225 - protein, 270 aa, Helicobacter pylori J99
MSMQTAPIKKITLSHLQAKKNQEKIIAITAYDALFAQIFDPLVDVILVGDSLNMSFFNQNDTLSASVKMMLYHTKAVCAGAKTPFIITDMPFGSYKDEKTALKNAIRVYKETQASAIKLEGGKEKAKLVKTLTDEGVIVVGHIGLMPQFVRLDGGYKIKGKNEEQQKKLLEDALSLEEAGVGLLVLEGITTPIAQTITQKIKIPTIGIGSGKDCDGQILVWSDMLGFFDSFKPKFVREYLKGKELIQNAIQQYADDVKKGNFPNELESYH

SEQ ID NO: 101226 - DNA, 813 bp, Helicobacter pylori
  CDS (1)..(813): transl_table=11
atgagcatgcaaaccgccccaattaaaaagatcactctcaaccacctccaagctaaaaaaaatcaagaaaaaatcatcgctattaccgcttatgatgcgctgttcgctcaaatatttgatccgctagtggatgtgattttagtgggcgatagtttgaatatgagttttttcaatcaaaacgacactttaagcgcgagtgtggaaatgatgctctatcacaccaaagccgtgtgcgcgggcgctaagactccttttatcatcacagacatgccttttggaagctataaagatgaaaaaacagccctaaaaaacgccattagggtttataaagaaacccaagcgagcgcaatcaaattagagggggggaaagaaaaagcgaaactggttaaaacgctcactaatgagggcgttattgtggtagggcatattggcttgatgccccaattcgtgcgccttgatggaggttataagattaagggcaaaaatgaagaacaacaaaaaaagcttttagaagacgccttgagtttagaagaagctggggtgggtttgttggttttagagggtataaccacccctatcgctcaaaaaatcacgcaaaaaatcaaaatccccacgatcggcatagggagcggtaaagattgcgatgggcagattttagtgtggagcgatatgttaggcttttttgatagctttaagcctaaattcgtgcgagaataccttaaggggaaagaattgattcaaaacgctatcaaacaatacgctgatgatgtgaaaaagggaaacttccctaacgaattagaaagttatcattaa

SEQ ID NO: 101227 - protein, 270 aa, Helicobacter pylori
MSMQTAPIKKITLNHLQAKKNQEKIIAITAYDALFAQIFDPLVDVILVGDSLNMSFFNQNDTLSASVEMMLYHTKAVCAGAKTPFIITDMPFGSYKDEKTALKNAIRVYKETQASAIKLEGGKEKAKLVKTLTNEGVIVVGHIGLMPQFVRLDGGYKIKGKNEEQQKKLLEDALSLEEAGVGLLVLEGITTPIAQKITQKIKIPTIGIGSGKDCDGQILVWSDMLGFFDSFKPKFVREYLKGKELIQNAIKQYADDVKKGNFPNELESYH

SEQ ID NO: 101228 - DNA, 801 bp, Idiomarina loihiensis
  CDS (1)..(801): transl_table=11
atggcaacaaccaaaaccagcattgcaacgttacaaaaaatgaaacgggaaggaaccaaaatcagttccctcaccgcctatgattcaagttttgctaaactcatgaccgagcaaggcgtcgactttattctggtgggcgattcactgggtaatgttgtgcagggacgcgactcaactgtaccggtaactgtcgatgatatgatttaccacactcagtgtgtgcgtcgaggtgccagcaatgcctttgttatagcagacatgccatttatgacttacagcacacccgagcaagcctatgatgtggcggcagctttaatgcaggcaggtgccaacatggtcaaactggaaggtggtcactggctggttgaaaccattgaaggcttgaaaacccggggcattccggtgtgcgctcaccttggtttactgccgcaatcggttaatgttcttggtggttataaagtacagggcaaagagcagcaacaggccgacgacacactgaaccaggctttggctctcgaacaggccggcgcgcaattacttgttctggaatgcgtacccgcgtctctgggtaaacgtattaccgagcagctatctattcctactattggtattggcgcaggtgcagacaccgacggacaaattttggttatgcacgatatgctcggcatgaacagtgactatctgcctaaatttgccaaagactttttggctcagggcggctcgcttgctgatgcattccgtttatattcggaacaggtgcgctcaggcgagttcccgacagcagagcatagctacaaatga

SEQ ID NO: 101229 - protein, 266 aa, Idiomarina loihiensis
MATTKTSIATLQKMKREGTKISSLTAYDSSFAKLMTEQGVDFILVGDSLGNVVQGRDSTVPVTVDDMIYHTQCVRRGASNAFVIADMPFMTYSTPEQAYDVAAALMQAGANMVKLEGGHWLVETIEGLKTRGIPVCAHLGLLPQSVNVLGGYKVQGKEQQQADDTLNQALALEQAGAQLLVLECVPASLGKRITEQLSIPTIGIGAGADTDGQILVMHDMLGMNSDYLPKFAKDFLAQGGSLADAFRLYSEQVRSGEFPTAEHSYK

SEQ ID NO: 101230 - DNA, 789 bp, Legionella pneumophila subsp
  CDS (1)..(789)
atgaaaatccatgattttaaaataaaaaagcaggaacaaaagaaaatttccatgttgacctgttacgattacccttcagcatgcatagtagcagaatcaaatatcgattgtgttctcgtgggtgattccgtagctatggcagtgcacggccaccctacaaccattatggccactatcgaaatgatggaattacatacccaggcagtagctcgtggtttaggcaaacagtttttgattactgacttaccttttctcggacataaatcatctcaaggtcatacagtagaaaacgtaaaaaggctgttacaggctggagcccaagcagttaaaatcgagggcgctgataaagacacctgccaaacgatttcccatttagttaatgccggcatccctgttatgggtcatatcggcttaactccccaatccattcatcaattaggcggttataaagtccagggaaaaaacagcgaacaggcagaaactctattacaacaggcagccaccctggaacaagccggctgctttgcggtagttattgaatgtgttccgcaggagctggcaaaaacgattaccgattcgttagttattcctactataggaattggcgcaggcccaggaactgatgggcaagtccttgtctggcacgatatgctaggtttacagacttcatttaatcctaaatttgtaaaaaaatattttagagccaaagaccattttattgaagccttaaacagctatgtccagcaagtacaacaaatgcatttcccagctaatgaacattctttctag

SEQ ID NO: 101231 - protein, 262 aa, Legionella pneumophila subsp
MKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 101232 - DNA, 834 bp, Leifsonia xyli subsp
  CDS (1)..(834): transl_table=11
gtgccctccgtcccttccgaagccccggcgtcgccgtcgccgaaacgcgtgcggacccgtcatttccaggcggcgaaggaagaaggctcccgtttcacggggctcaccagctacgacacgctgacggcacagatcttcgacgaggccgggatcgattttctcctcgtcggcgactcggccgcgaacacggtgctcggctacgacaccaccctccccatgacggtcgacgagctaatccccctcacacgcgccgtggcacgggcggcgaaacgcgcgttcgtcgtggcggacctgccgttcggatcgtacgagaccggcccccaggaggcgctgcgcacagccgtgcgcttcatgaaggagaccggtgcgcacgccgtcaaattggaaggcggcgagcgcagcgccgagcagatccgccgcatcgtggacgcgggcgttccggtcatggggcacatcggcttcacaccgcagagcgagcatgggctcggcgggcacctcgtgcagggccgcggccagggagccgagcaggtggtcgacgacgcgcacgcggtcgaggaggccggggcgttcgccgtcgtgctggagatggtgcccgcggacgtcgcacagcgcgtgacacaggagctgcgcatcccgacgatcggtgtgggcgcggggccgcacgtcgatggccagctgctggtttggacggactgggccgggttcacgacgggacgcgtcccgcgcttcgccaaacagtacgccgatctgaaggacgtgctcacggaggcggcacggatgtacagagacgaggtgggctccggggtgttccccggtcccgagcacagtttctaa

SEQ ID NO: 101233 - protein, 277 aa, Leifsonia xyli subsp
MPSVPSEAPASPSPKRVRTRHFQAAKEEGSRFTGLTSYDTLTAQIFDEAGIDFLLVGDSAANTVLGYDTTLPMTVDELIPLTRAVARAAKRAFVVADLPFGSYETGPQEALRTAVRFMKETGAHAVKLEGGERSAEQIRRIVDAGVPVMGHIGFTPQSEHGLGGHLVQGRGQGAEQVVDDAHAVEEAGAFAVVLEMVPADVAQRVTQELRIPTIGVGAGPHVDGQLLVWTDWAGFTTGRVPRFAKQYADLKDVLTEAARMYRDEVGSGVFPGPEHSF

SEQ ID NO: 101234 - DNA, 798 bp, Leptospira interrogans serogroup Icterohaemorrhagiae serovar
  CDS (1)..(798): transl_table=11
atgaaaaacatacataaaattttttctcctgaaaagaaagggaaagaaaaaatttccgtagttacatgttacgattttagttttgctaggattttaaacgaaactgaaatcgattctatccttgtaggggattcactgggaatggtttttcaaggaaatacgagtactctccccgtcactttagaagaaatgatctatcatacgaaggcggtccgtcgtggtgcgcccgataagtttctgatcgccgatctaccttttttaagttatcagacttctatcgaagaaggaattcgctccgccggaaaaatcatgaaggaaagcgattgcgacgcggttaaaatagaaggtggttccgaatttatctgtgagctggtttctattctcaaacaaattggagttcctgtgatggggcatttggggctgacacctcagagtgttcatgtgtttggcggtcatcgagttcaaggcaaaggagaagaatcgagttctaaactactaaaagaatcgatttctctttttgagtcaggtgttttctcaatggttctggagatgattcccgctgaactaggaaaaaaagtaagtcaagaagtaggtgttcctacaatcggaatcggagctggttcggattgtgacggacaggttttggttttaaacgatttacttggattggatataaactttcaacctaagtttttaaagaaattttccaatctgcattctatcgtaaaggaagcgatcgcggattatgataaagaagtaaaatccggagagtttccagggaaagatcatagtttctga

SEQ ID NO: 101235 - protein, 265 aa, Leptospira interrogans serogroup Icterohaemorrhagiae serovar
MKNIHKIFSPEKKGKEKISVVTCYDFSFARILNETEIDSILVGDSLGMVFQGNTSTLPVTLEEMIYHTKAVRRGAPDKFLIADLPFLSYQTSIEEGIRSAGKIMKESDCDAVKIEGGSEFICELVSILKQIGVPVMGHLGLTPQSVHVFGGHRVQGKGEESSSKLLKESISLFESGVFSMVLEMIPAELGKKVSQEVGVPTIGIGAGSDCDGQVLVLNDLLGLDINFQPKFLKKFSNLHSIVKEAIADYDKEVKSGEFPGKDHSF

SEQ ID NO: 101236 - DNA, 834 bp, Listeria monocytogenes serotype 4b
  CDS (1)..(834): transl_table=11
atgaaaagaccagtagacttttttgctatgaaggaaaacggtgagaaaatcacgatgataaccgcgtatgactatccttctgctaagaatgtagaacaagcagaagctgatatgattttagtcggcgattcacttggaatggtagtattaggctacgattcaactgtaccagttacgatggatgatatgattcatcatacaaaagccgtgaagcgcggggcaccagatacatttgttgttacagacatgccgtttatgacgtatcatggttcagtggatgaaactatccaaaatgcacggaagattatccaagaaagtggcgctcatgctgtaaaattagaaggagcaggagaagtcgttaacaaaattgctcgcctaacagaagcaggtgctccagttgtcgcgcatcttggcttaaccccgcaaagtgttggcttaactggaagctataaagtacgtgctaaatctgcccaagaagcacaagagctaatggataatgcgttagctgtagaagctgctggagcgattgcactcgtacttgaagcaattccacgtcaactcgctgaaaaagtaagtaaagcactttctatccctacaattggtattggagcaggcgtagaaacagatggacaagtactcgtttatcacgatattatcggttatggaatcagtcgtcgcgccaaatttgtaaaagcgtatgcggacattgatgaaagaatcgaaccagcactagcaagctacgtaaaagaagtaaaagcagcgacgtttccagaagtgaaacatagctttaccatggctgaagaagacttaaaaggcctttatggaagggaatag

SEQ ID NO: 101237 - protein, 277 aa, Listeria monocytogenes serotype 4b
MKRPVDFFAMKENGEKITMITAYDYPSAKNVEQAEADMILVGDSLGMVVLGYDSTVPVTMDDMIHHTKAVKRGAPDTFVVTDMPFMTYHGSVDETIQNARKIIQESGAHAVKLEGAGEVVNKIARLTEAGAPVVAHLGLTPQSVGLTGSYKVRAKSAQEAQELMDNALAVEAAGAIALVLEAIPRQLAEKVSKALSIPTIGIGAGVETDGQVLVYHDIIGYGISRRAKFVKAYADIDERIEPALASYVKEVKAATFPEVKHSFTMAEEDLKGLYGRE

SEQ ID NO: 101238 - DNA, 834 bp, Listeria monocytogenes
  CDS (1)..(834): transl_table=11
atgaaaagaccagtagacttttttgctatgaaggaaaacggagagaaaatcacgatgatcaccgcttatgactatccttctgctaagaatgtagaacaagcagaagcagatatgattttagtcggagattcactcggaatggtagtattaggctacgattcaaccgtaccagttacaatcgatgatatgattcatcatacaaaagccgttaagcgaggtgccacagacacatttattgtcactgacatgccgtttatgacttaccatggttcagtgaatgaaacaatccaaaatgcacgtaaaattattcaagaaagtggcgctcatgcagtgaaattagaaggagcaggagaagtcgttaacaaaattgctcgtttaaccgaagcaggtgctccagttgtcgctcatcttggcttaacaccccaaagtgttggtttaactggaagctataaagtacgcgctaaatctgcccaagaagcacaagagttaatggataatgcattagctgtagaagcagctggagctattgcaatcgtgctcgaagcaatacctcgccaattagctgaaaaggtaagtaaagcactttcaattcctacaattggtattggagcaggtttagaaacagatggacaagtactcgtttaccacgatattatcggttatggaatcagccgccgtgcaaaatttgtaaaagcttatgcagatattgacgagacaatcgaaccagcactcgcaagctatgtaaaagaagtgaaagccgagacatttccagaagtgaaacatagctttacaatggccgaagaagacttaaaaggcctctatggaagggaatag

SEQ ID NO: 101239 - protein, 277 aa, Listeria monocytogenes
MKRPVDFFAMKENGEKITMITAYDYPSAKNVEQAEADMILVGDSLGMVVLGYDSTVPVTIDDMIHHTKAVKRGATDTFIVTDMPFMTYHGSVNETIQNARKIIQESGAHAVKLEGAGEVVNKIARLTEAGAPVVAHLGLTPQSVGLTGSYKVRAKSAQEAQELMDNALAVEAAGAIAIVLEAIPRQLAEKVSKALSIPTIGIGAGLETDGQVLVYHDIIGYGISRRAKFVKAYADIDETIEPALASYVKEVKAETFPEVKHSFTMAEEDLKGLYGRE

SEQ ID NO: 101240 - DNA, 810 bp, Methylococcus capsulatus
  CDS (1)..(810): transl_table=11
atgactgatccggtgactctgcccgacctgctcgccatgaagcggcgcggcgaaaaaatcgcctgcctcactgcctacgacgcctcgtccgcagccttgcaggacgaagccggcatcgaggtcatcctggtgggcgattcgctcggcaacgtcatccagggccagcccaccaccttgagtgtcacgctcgaccacatggtgtaccacaccgcctgcgtgcagcgagccgcgcgccgtgcactggtactggccgacctccctttcctgagctattgcactccggaacaggcggtccgcagcgccgcccggctgatccgcgacggcggggcgcaggtggtcaagttggaaggcggacgggaacggctcgacgtggtccggttcctgacggaacagaatgtcccggtatgcggccatctgggcctgcagccgcaagccatccaccggctgggccgttacgcgctgcagggtcgcgacgccgaatcggcatgccgcatggtcgaagatgcccgccagttggccgaggccggcgcaatgctcctggtgctcgaatgcatcccctgggagctggcgcaggaaatcaccgccgcggtcgacatccccaccattggcatcggcgccgggcggcattgcgacggccaggtcttggtctggcaggacatgctgggcatgagcgcacgactcccgcgtttctgcaaagacttcctcgccggcaatgcaggggttcgtgaggccgtctcggcctacgtgcgcgaggtcaaggccggcatcttcccgggcgacaggcacagcttcggccgcgacggtccatga

SEQ ID NO: 101241 - protein, 269 aa, Methylococcus capsulatus
MTDPVTLPDLLAMKRRGEKIACLTAYDASSAALQDEAGIEVILVGDSLGNVIQGQPTTLSVTLDHMVYHTACVQRAARRALVLADLPFLSYCTPEQAVRSAARLIRDGGAQVVKLEGGRERLDVVRFLTEQNVPVCGHLGLQPQAIHRLGRYALQGRDAESACRMVEDARQLAEAGAMLLVLECIPWELAQEITAAVDIPTIGIGAGRHCDGQVLVWQDMLGMSARLPRFCKDFLAGNAGVREAVSAYVREVKAGIFPGDRHSFGRDGP

SEQ ID NO: 101242 - DNA, 846 bp, Mycobacterium bovis
  CDS (1)..(846): transl_table=11
atgtctgagcagactatctatggggccaatacccccggaggctccgggccgcggaccaagatccgcacccaccacctacagagatggaaggccgacggccacaagtgggccatgctgacggcctacgactattcgacggcccggatcttcgacgaggccggcatcccggtgctgctggtcggtgattcggcggccaacgtcgtgtacggctacgacaccaccgtgccgatctccatcgacgagctgatcccgctggtccgtggcgtggtgcggggtgccccgcacgcactggtcgtcgccgacctgccgttcggcagctacgaggcggggcccaccgccgcgttggccgccgccacccggttcctcaaggacggcggcgcacatgcggtcaagctcgagggcggtgagcgggtggccgagcaaatcgcctgtctgaccgcggcgggcatcccggtgatggcacacatcggcttcaccccgcaaagcgtcaacaccttgggcggcttccgggtgcagggccgcggcgacgccgccgaacaaaccatcgccgacgcgatcgccgtcgccgaagccggagcgtttgccgtcgtgatggagatggtgcccgccgagttggccacccagatcaccggcaagcttaccattccgacggtcgggatcggcgctgggcccaactgcgacggccaggtcctggtatggcaggacatggccgggttcagcggcgccaagaccgcccgcttcgtcaaacggtatgccgatgtcggtggtgaactacgccgtgctgcaatgcaatacgcccaagaggtggccggcggggtattccccgctgacgaacacagtttctga

SEQ ID NO: 101243 - protein, 281 aa, Mycobacterium bovis
MSEQTIYGANTPGGSGPRTKIRTHHLQRWKADGHKWAMLTAYDYSTARIFDEAGIPVLLVGDSAANVVYGYDTTVPISIDELIPLVRGVVRGAPHALVVADLPFGSYEAGPTAALAAATRFLKDGGAHAVKLEGGERVAEQIACLTAAGIPVMAHIGFTPQSVNTLGGFRVQGRGDAAEQTIADAIAVAEAGAFAVVMEMVPAELATQITGKLTIPTVGIGAGPNCDGQVLVWQDMAGFSGAKTARFVKRYADVGGELRRAAMQYAQEVAGGVFPADEHSF

SEQ ID NO: 101244 - DNA, 861 bp, Mycobacterium leprae
  CDS (1)..(861): transl_table=11
atgtctgagcagaatgttaatgtttatggggctgatccttctacatcctccattcaatcaatacagcgcaccaaaatacgcaccaagcatctccaaaaaatgaaggccgaaggccacaagtgggccatgctgacagcctatgattattcgactgctcgggttttcgacgaagccggtatcccggtgttgctggtgggtgattcagcggccaacgtggtgtacggctacgacaccacggtgccggtttcggccgacgaactactcccgctggttcgcggcgtggtgcggggtgcggggcacgctctggtcgtcgccgacctgccattcggcagctacgaacccggacccactgccgcgctggctgtcgccacccgatttatgaaggagggcggtgcacacgccgtaaaactcgaaggcggccagcgggtagctgaacaaatcgcgtgcctgaccgcagcaggcattccggtaatggcgcacatcggattcacaccgcaaagcgtcaacagcctcggcggtttccgggtacagggccgcggcggcgacgccgaacaaaccgtcgctgatgccgttgccgttgctgaagccggagcattttccgtcgtaatggaaatggtgccgaccgagttagccacccagatcaccggcaaattaaccattccgacaatcgggatcggtgcgggtcttaactgcgacgcccaggtcttagtttggcaagatatggccggtttaagcagcggtaaggtggcacgtttcgtcaagcagtatgctgatatcgctggcgagttgcggcgtgccgcaatgcagtacgcagaggaagtggccagcgcggttttccctgctgaggagcactgcttctga

SEQ ID NO: 101245 - protein, 286 aa, Mycobacterium leprae
MSEQNVNVYGADPSTSSIQSIQRTKIRTKHLQKMKAEGHKWAMLTAYDYSTARVFDEAGIPVLLVGDSAANVVYGYDTTVPVSADELLPLVRGVVRGAGHALVVADLPFGSYEPGPTAALAVATRFMKEGGAHAVKLEGGQRVAEQIACLTAAGIPVMAHIGFTPQSVNSLGGFRVQGRGGDAEQTVADAVAVAEAGAFSVVMEMVPTELATQITGKLTIPTIGIGAGLNCDAQVLVWQDMAGLSSGKVARFVKQYADIAGELRRAAMQYAEEVASAVFPAEEHCF

SEQ ID NO: 101246 - DNA, 858 bp, Mycobacterium paratuberculosis
  CDS (1)..(858): transl_table=11
atgtctgagcacaatgtttacggtgccgcccagccggcccaaccgggccagcccgcccagccgcgcaccaggattcgcacccaccatctgcaaaagatgaaggccgagggccacaagtgggccatgctgacggcgtacgactattccaccgcccgcatcttcgacgaggccggcatcccggtgctgctggtgggcgactcggcggccaacgtcgtctacggctacgacaccaccgtgccggtgtcgatcgacgagctgatcccgctggtccgcggcgtggtgcggggggcgccgcacgccctggtggtcgccgacctgccgttcggcagctacgaggccgggccggccgccgctctggccgccgccacccggttcatgaaggagggcggcgcgcacgcggtgaagctggagggcggtgaacgggtggccgagcagatcgctcacctgaccgccgcgggcatcccggtgatggcgcacatcggcttcaccccgcagagcgtgaacagcctgggcggtttccgggtgcagggccgcggcgacgcggccgaacagaccatcgccgacgcgatcgccgtcgccgaggccggagcgttctcggtggtgatggagatggtgccggccgagctggccacccagatcaccggcaagctcaccatcccgaccatcgggatcggcgccggccccaactgcgacggccaggttctggtttggcaggacatggccggcatgagcagcggcaagtccgcccgcttcgtcaagcgcttcgccgacatcggcggcgaattgcgccgcgccgcaacgcagtatgcgcacgaggtggccgccggggtcttcccggccgacgagcactgcttctga

SEQ ID NO: 101247 - protein, 285 aa, Mycobacterium paratuberculosis
MSEHNVYGAAQPAQPGQPAQPRTRIRTHHLQKMKAEGHKWAMLTAYDYSTARIFDEAGIPVLLVGDSAANVVYGYDTTVPVSIDELIPLVRGVVRGAPHALVVADLPFGSYEAGPAAALAAATRFMKEGGAHAVKLEGGERVAEQIAHLTAAGIPVMAHIGFTPQSVNSLGGFRVQGRGDAAEQTIADAIAVAEAGAFSVVMEMVPAELATQITGKLTIPTIGIGAGPNCDGQVLVWQDMAGMSSGKSARFVKRFADIGGELRRAATQYAHEVAAGVFPADEHCF

SEQ ID NO: 101248 - DNA, 843 bp, Mycobacterium vanbaalenii
  CDS (1)..(843): transl_table=11
atgtctgagcagcctgtctacggtgccgccgcggaagcacccaagccgcgtgtgaaagtccgcacgcaccatctgcacaagtggaaggccgagggccacaagtgggccatgctgaccgcctatgactactccacggcggcggtcttcgacgaggcggagatcccggtgctgctggtcggtgactctgcagcgaacgtggtgtacggatacgacaccaccgttccggtgacactcgacgaactcatcccgctggtgcgcggggtcgtgcgtggagcgccgcacgccctggtcgtggccgatctgccgttcggaagctacgaggcgggcccgcagcaggcgctggccaccgcgacccggatgctcaaggagaccggcgcgcacgcggtgaagctcgaagggggtgagcgagtggccgaccagatcgccgccgtaagcgccgcaggcatcccggtgatggcacacatcggtttcaccccgcagagcgtcaacggcctcggtgggttccgggtccagggtcgcggcgacgccgccgagcagaccatccacgacgcgatcgccgtgcaggaggccggcgcgttcgcggtggtgatggagatggtgcccgccgagctggccacccagatcaccggcaagctgaccatccccaccgtcggtatcggcgccggccccagctgcgacgcgcaggtgctcgtctggcaggacatggccgggatgaccaacggcaagaccgcgaagttcgtcaagcggttcggcgccgtcggagacgagctgcgccgcgccgcctccgactacgccagggaggtcgccaccggcgccttcccggccgacgagcactcctactga

SEQ ID NO: 101249 - protein, 280 aa, Mycobacterium vanbaalenii
MSEQPVYGAAAEAPKPRVKVRTHHLHKWKAEGHKWAMLTAYDYSTAAVFDEAEIPVLLVGDSAANVVYGYDTTVPVTLDELIPLVRGVVRGAPHALVVADLPFGSYEAGPQQALATATRMLKETGAHAVKLEGGERVADQIAAVSAAGIPVMAHIGFTPQSVNGLGGFRVQGRGDAAEQTIHDAIAVQEAGAFAVVMEMVPAELATQITGKLTIPTVGIGAGPSCDAQVLVWQDMAGMTNGKTAKFVKRFGAVGDELRRAASDYAREVATGAFPADEHSY

SEQ ID NO: 101250 - DNA, 792 bp, Neisseria meningitidis serogroup A
  CDS (1)..(792): transl_table=11
atgattactgtgaacacactgcaaaaaatgaaggcggcgggcgagaaaatcgctatgctgaccgcttacgaatccagttttgccgcgctgatggacgatgccggcgtggatgtgctgctggttggggattctttgggaatggcggttcaagggcggcagtcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggtcaaactcgaaggcggtgtgtggatggcggaaacgaccgaatttctgcaaatgcgcggtattccggtctgtgcccacatcggtctgaccccgcaatccgtgtttgccttcggcggatacaaggttcaggggcgcggcggcaaggcgcaggcgttgcttaacgatgccaaggcgcatgatgatgcgggggcggcggtcgtgctgatggagtgtgttcctgcggaactggcaaaaaaggtaactgaatccgtttcctgtccgaccatcggcatcggcgcgggtgtcgattgcgacgggcaggttttggtgatgcacgatatgctcggcattttcccgggtaagacggcgaaattcgtcaaaaactttatgcaggggcaaagcagcattcaggcggcggttcgggcgtatgttgccgaagtcaaagccaaaaccttccctgctgcggaacatatttttgcagactga

SEQ ID NO: 101251 - protein, 263 aa, Neisseria meningitidis serogroup A
MITVNTLQKMKAAGEKIAMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVPAELAKKVTESVSCPTIGIGAGVDCDGQVLVMHDMLGIFPGKTAKFVKNFMQGQSSIQAAVRAYVAEVKAKTFPAAEHIFAD

SEQ ID NO: 101252 - DNA, 792 bp, Neisseria meningitidis serogroup B
  CDS (1)..(792): transl_table=11
atgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggttaaactcgaaggcggcgtgtggatggcggaaacgactgaatttttgcaaatgcgcggtattccggtttgtgcgcacatcggtctgaccccgcaatccgtgtttgccttcggcggatataaagttcaggggcgcggcggcaaggcgcaggcgttgcttaacgatgccaaggcgcatgacgatgcgggggcggcggtcgtgctgatggagtgcgtactggcggaactggcaaaaaaggtaactgaaactgtttcctgtccgaccatcggcatcggcgcgggtgcggattgcgacgggcaggttttggtgatgcacgatatgctcggcattttcccgggtaagacggcgaaattcgtcaaaaactttatgcaggggcatgatagtgttcaagcggcggttcgggcgtatgttgccgaagtcaaagccaaaaccttccctgctgcggaacatatttttgcagattga

SEQ ID NO: 101253 - protein, 263 aa, Neisseria meningitidis serogroup B
MITVNTLQKMKAAGEKIAMLTAYESSFAALMDDAGVEMLLVGDSLGMAVQGRKSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVLAELAKKVTETVSCPTIGIGAGADCDGQVLVMHDMLGIFPGKTAKFVKNFMQGHDSVQAAVRAYVAEVKAKTFPAAEHIFAD

SEQ ID NO: 101254 - DNA, 810 bp, Nitrosomonas europaea
  CDS (1)..(810): transl_table=11
atggatcagtcagctgcgaaacggatgacgattacaacgctgcagaatgcttgcgagcagggagagaaaatagcggtactgacctgctatgacgcaacgtttgctgcggtactggaagaggcgggggtcgatattctgctggtgggagattcgctcgggaatgtggtgcaggggaaatccagcaccttgccggttacattggatgagatgatttatcacgtccggtgcgtggaacgcggtacccacagggtatttatcatggccgatatgccttttggcacgttccaggtgtctccgcaggaggcgttcgggaatgctgtccggttgatggctgctggtgcgcagatggtcaagatcgagggagggcagcatatggccgaaaccgtagagtttttatcctgccgcggaattccggtctgtgcccatatcggattgatgccccagtttgttcaccagttgggcggttacagggttcaggggaaaacgccgaatgatgccagacaattgcgtgaagatgcactcctgttacaagaggcaggagcagccatgctgctgatggaactgattccggctgtattgggtgaggaaattacccggttgctttccattcccaccatcggtattggtgctggtgcagcgtgttccgggcaggtactggtgttgcacgacatgttgggtatcagctctggtactttgccgcgtttcgtcagaaatttcatgatggacgcagacagtattcaaaccgctgtcagcaattatgtcgaagcagtcaagcttggggcatttcccgcatatgaacatacgttctga

SEQ ID NO: 101255 - protein, 269 aa, Nitrosomonas europaea
MDQSAAKRMTITTLQNACEQGEKIAVLTCYDATFAAVLEEAGVDILLVGDSLGNVVQGKSSTLPVTLDEMIYHVRCVERGTHRVFIMADMPFGTFQVSPQEAFGNAVRLMAAGAQMVKIEGGQHMAETVEFLSCRGIPVCAHIGLMPQFVHQLGGYRVQGKTPNDARQLREDALLLQEAGAAMLLMELIPAVLGEEITRLLSIPTIGIGAGAACSGQVLVLHDMLGISSGTLPRFVRNFMMDADSIQTAVSNYVEAVKLGAFPAYEHTF

SEQ ID NO: 101256 - DNA, 852 bp, Nocardia farcinica
  CDS (1)..(852): transl_table=11
atgtccgtatccgattcggaaacccctgcctacggtgcggcgcagccggctcagccgcggcgcaagacgcgcatcccgcacctgcggcagatgaaggccgacggtgagcgctgggcgatgctcaccgcctacgactactcctcggcgcgactgttcgaggaggcgggcatcccggtcctgctggtcggcgactccgccgccaacgtcgtctacggctacgacaccaccgtgccgatcaccgtcgacgaactgatcccgctggtgcgcggcgtggtgcgcggcgcaccgcacgccttggtggtcgccgacctgccgttcggcacctacgagggctcggcgcagcaggcgctggcggccgccacccgtttcatgaaggagggcggcgcgcacgcggtgaaactggagggtggcgagcgcgtggccgagcagatcgcgctgctcaccgccgcgggcattcccgtgatggcgcatatcggtttcaccccgcagagcgtgaacaccctcggcgggttccgggtgcagggccgcggcgacggcgccgaacagctcatcgccgacgcgatcgcggtgcaggaggcgggcgcgttctcggtggtgatggagatggtgcccgcggagctggccggacaggtcacccgcaagctcaccatcccgacgatcggcatcggcgccggtcccgactgcgacgcgcaggtgttggtgtggcaggacatggccgggtacaccagcggcaagaccgccaagttcgtcaagcgcttcggcgacatcggcgaccagctgcgcgcggcggcggccgcctacgccgccgaggtccgcgagggcaccttccccgggcccgagcacagcttctga

SEQ ID NO: 101257 - protein, 283 aa, Nocardia farcinica
MSVSDSETPAYGAAQPAQPRRKTRIPHLRQMKADGERWAMLTAYDYSSARLFEEAGIPVLLVGDSAANVVYGYDTTVPITVDELIPLVRGVVRGAPHALVVADLPFGTYEGSAQQALAAATRFMKEGGAHAVKLEGGERVAEQIALLTAAGIPVMAHIGFTPQSVNTLGGFRVQGRGDGAEQLIADAIAVQEAGAFSVVMEMVPAELAGQVTRKLTIPTIGIGAGPDCDAQVLVWQDMAGYTSGKTAKFVKRFGDIGDQLRAAAAAYAAEVREGTFPGPEHSF

SEQ ID NO: 101258 - DNA, 813 bp, Oceanobacillus iheyensis
  CDS (1)..(813): transl_table=11
atgaaggccttgaaagatttcatgcggatgaagcatgaaggagaaaaaatttcgatgttgactgcttatgattatccgagtgcaaagcaagcggaagctgctgaaatagatatgattcttgtcggtgattccctagggatgacggtacttggctacgaaagcactgtcgatgtaactctcgacgatatgaagcatcacgcgcgtgcagtgcgccgtggcgcaaaggatacgtatgttgtcgttgatatgccttttggtaccatcggcattgatgcaagtaccgatacagcttttgccattgaattataccgagacactcatgcaaacgctataaaaatcgaaggcgcacatgccgctcctgttattaaaaaatgccatgatatcggtattcctgtcgttgcccatcttgggttgacgccgcagagttacggcatcacaggctatcaactacaagcaacctctaaagaagcagccaaacagctgattgaggatgctaaacttgttgaaaaaagtggtgcgattatgcttgtcttagaagcaataccaagtgaccttgcccatgtaattaccgagtcgcttacgattccggttatcgggataggcgcaggtgtaggaacgaatggacaagtccttgtgtatcatgacgtacttaattatggtgtcgagcataagccaaaatttgtaaagcgttatggtgatttttctattggtgtagaatccataaaaaactttcatgacgaggtgaagcgacaagcgtttcctactgaagaatacacatacaagaaacaaattatgaacgaggtagacgaatga

SEQ ID NO: 101259 - protein, 270 aa, Oceanobacillus iheyensis
MKALKDFMRMKHEGEKISMLTAYDYPSAKQAEAAEIDMILVGDSLGMTVLGYESTVDVTLDDMKHHARAVRRGAKDTYVVVDMPFGTIGIDASTDTAFAIELYRDTHANAIKIEGAHAAPVIKKCHDIGIPVVAHLGLTPQSYGITGYQLQATSKEAAKQLIEDAKLVEKSGAIMLVLEAIPSDLAHVITESLTIPVIGIGAGVGTNGQVLVYHDVLNYGVEHKPKFVKRYGDFSIGVESIKNFHDEVKRQAFPTEEYTYKKQIMNEVDE

SEQ ID NO: 101260 - DNA, 792 bp, Photorhabdus luminescens subsp
  CDS (1)..(792): transl_table=11
atgaaaccaatgaccatgactgatctgaatcagctcaagaaagaaaaacgtaaattcgcgactattaccgcttatgacgccagctttgcccacctgtttgccgagcaaggtatcgatgtcatgctggttggtgactcactgggtatgactgtgcaaggggctgataccaccattccagtgacggttgaagatattgtctatcatactcgctgtgtccgtgccggaacaccttatacttttatcattgccgatatgcccttcatgagttatgccacgccagagcaaagttgtgaaaacgctgccaagcttatgcgtgctggcgctaacatggtgaaacttgaaggcggtagctggttatacgataccattaacatgcttaccgagcgttctgtacccgtttgcgcccatttagggctaactcctcaatcagtccatattcttggcggttataaagttcagggacgtgatgaagtatcagcgaatcaattgataaaagatgccattaccttagaaaaggcaggcatacaactgctagtactagaatgcgtacccgttgatttagctaaacgtatcaccgatgaattacagatcccggtaattggtattggtgccggtaatgtgactgatgggcaagttttagtgatgcatgacacactgggcattaccgtaagcccccctaaatttgtgaaaaacttccttgaagaagcagggaatatacgtgatgccattcgcctatataaagaacaggtggaaagtggtatttaccctggtaaagaacactcattttattaa

SEQ ID NO: 101261 - protein, 263 aa, Photorhabdus luminescens subsp
MKPMTMTDLNQLKKEKRKFATITAYDASFAHLFAEQGIDVMLVGDSLGMTVQGADTTIPVTVEDIVYHTRCVRAGTPYTFIIADMPFMSYATPEQSCENAAKLMRAGANMVKLEGGSWLYDTINMLTERSVPVCAHLGLTPQSVHILGGYKVQGRDEVSANQLIKDAITLEKAGIQLLVLECVPVDLAKRITDELQIPVIGIGAGNVTDGQVLVMHDTLGITVSPPKFVKNFLEEAGNIRDAIRLYKEQVESGIYPGKEHSFY

SEQ ID NO: 101262 - DNA, 795 bp, Photobacterium profundum
  CDS (1)..(795): transl_table=11
atgaaaaaaataacaatcaacgacctgatgacatggaagcatgaaggtcgtaaatttgcatcgataacagcatatgatgcaagttttgctcaattatttgagcaacaggaagtccccgtactgctagttggcgattcattgggaatggttttacaaggtaaaccagataccctgccagtcagcgtaagtgacattgcttaccatactcgatgtgtgcgcgctggtagccctaacactcttttaatggctgatatgccatttatgagctacagcaccccagagcaagcgtgtgagagcgctgcagagcttatgcgagctggcgctaacatggtcaaactggaaggtggtgcatggttagctgaaaccattacaaaactcaccgagcgtgcagttccagtatgtgctcatctaggccttactccacaatctgtaaatatttttggtggatacaaagttcaaggtcgcgattctgatcacgcagcacagatggtaaaagatgctattttattgaaaaatgctggtgctcagatcattttgctggaatgtgtacccgcaagccttgcagagcgtatcaccaaggcggttgaagtaccggttattgggattggcgctggtaacgtaacagatggtcagatcctagtgatgcacgatatgtttggtatttctgccaactacatgccgcgcttttcaaaaaattatctcgctgaaactggcgacatgcgtacagctgtcagcaaatacctagaagaggttgaggccggtacttttcctgggccccaacacacctttgagtaa

SEQ ID NO: 101263 - protein, 264 aa, Photobacterium profundum
MKKITINDLMTWKHEGRKFASITAYDASFAQLFEQQEVPVLLVGDSLGMVLQGKPDTLPVSVSDIAYHTRCVRAGSPNTLLMADMPFMSYSTPEQACESAAELMRAGANMVKLEGGAWLAETITKLTERAVPVCAHLGLTPQSVNIFGGYKVQGRDSDHAAQMVKDAILLKNAGAQIILLECVPASLAERITKAVEVPVIGIGAGNVTDGQILVMHDMFGISANYMPRFSKNYLAETGDMRTAVSKYLEEVEAGTFPGPQHTFE

SEQ ID NO: 101264 - DNA, 822 bp, Porphyromonas gingivalis
  CDS (1)..(822): transl_table=11
atgtccacgtaccaaccggaagatactcgtaaggtaactacacatcgcctcatcgagatgaagagccgtggggagaaaatctccatgctcacagcttatgactactcaatggctaagctggtcgatgaggccggtatggatgtcattcttgtaggtgattcggcttcgaacgttatggccggcaatgtcaccaccctgcccatcactctcgatcagatgatctaccacggcaagtctgtggtcaaggccgtcaagcgtgctcttgtggtcgtagatcttcctttcggatcctatcagggcaactccaaagaagccttgtgctcggccatccgtgtgatgaaggagacacatgccgactgtatcaaactcgaaggaggagaagaggtgcgcgagtccattgtgcgaatcctctcggccggtattcccatcatgggacacctcggactgatgcctcagagcatcaataagtttggcacctacaatgtccgcgccaaggaagaggccgaagccgagaagctgcttcaggatgctcacctcttggaagaactcggatgcttcgctctcgtcctcgaaaaaataccggccgaactggctacacgtgtagcttcggagctgagcattccggttatcggcatcggtgccggaggtggtgtggacggtcaggtgctggtgatgcacgacatgctcggtatcacggaggggttcagtccccgtttcctgcgccgttatgccaatctggccaacgagatagatcgggcactcaagcattatatcgctgatgtgaagagtatggacttccccaataaggacgagcagtactga

SEQ ID NO: 101265 - protein, 273 aa, Porphyromonas gingivalis
MSTYQPEDTRKVTTHRLIEMKSRGEKISMLTAYDYSMAKLVDEAGMDVILVGDSASNVMAGNVTTLPITLDQMIYHGKSVVKAVKRALVVVDLPFGSYQGNSKEALCSAIRVMKETHADCIKLEGGEEVRESIVRILSAGIPIMGHLGLMPQSINKFGTYNVRAKEEAEAEKLLQDAHLLEELGCFALVLEKIPAELATRVASELSIPVIGIGAGGGVDGQVLVMHDMLGITEGFSPRFLRRYANLANEIDRALKHYIADVKSMDFPNKDEQY

SEQ ID NO: 101266 - DNA, 801 bp, Pseudomonas fluorescens
  CDS (1)..(801): transl_table=11
atgccagacattaccctgaccaccttgcagagcctcaagctcaaaggtgaaaaaatcaccatgctgacctgctatgacgccaccttcgcccacgccagctgccaggccgggattgaagtgctgctggtgggcgactccctgggcatggttcttcaagggaatgacagcaccctgcccgtcaccaccgatgaacttgcgtaccacaccgccagcgtcaagcgtggcaacgatggcgccttcatcatcgccgacctgccgttcatgggttacgcgacgcttgaacagaccttccagaatgccggcaagctgatgcaagccggtgcgcacatgatcaaagtcgaaggtgcggtgtggcttgccgagtcgatccgcctgctggctgagcgcggcgtgccggtgtgcgcgcacatgggcctgacaccacagtcggtgaacctcctcggcggctacaaggtacagggccgtaatgaggcccaggcgcgccagatgcgcgccgatgccatcgccttggaacaagccggcgcggcaatgatcctgctcgaatgcgtgccaagcgaactggcggcagaaatcacccaggccgtgaaagtgccggtgatcggtattggcgcgggttccgccaccgatggccaggtactggtgttgcacgacatgctcggcctgtcgatcaccggtcgcgtgccgaagttcgtgaaaaacttcatgaccggccaagccagcatccacgacgcattgagcgcctacgtcgctgaagtcaaaggcgtgaccttccctggcgccgaacacggattctctgcatga

SEQ ID NO: 101267 - protein, 266 aa, Pseudomonas fluorescens
MPDITLTTLQSLKLKGEKITMLTCYDATFAHASCQAGIEVLLVGDSLGMVLQGNDSTLPVTTDELAYHTASVKRGNDGAFIIADLPFMGYATLEQTFQNAGKLMQAGAHMIKVEGAVWLAESIRLLAERGVPVCAHMGLTPQSVNLLGGYKVQGRNEAQARQMRADAIALEQAGAAMILLECVPSELAAEITQAVKVPVIGIGAGSATDGQVLVLHDMLGLSITGRVPKFVKNFMTGQASIHDALSAYVAEVKGVTFPGAEHGFSA

SEQ ID NO: 101268 - DNA, 801 bp, Pseudomonas putida
  CDS (1)..(801): transl_table=11
atgcctgaagtaacccttaccacccttaacggcctcaaggccaagggtgaaaaaatcaccatgctgacctgctacgacgcgaccttcgccaaggccgccagccaggccggcgttgaagtgttgctggtgggcgactcgctggggatggtcctgcagggccacgacagcaccttgccggtcaccacggcggagatggcctaccacaccgccagcgtcaaacgcggcaacgacggcgcgctgatccttaccgacctgccgttcatggcccatgccacccccgagcaggcctttgccaacagcgccacactgatgcaggccggcgcccacatggtcaagatcgaaggcgcagcctggctggccgaaaccatccgcttgctggccgaacgtggtgtaccggtgtgcgcgcacatgggcctgaccccgcaaaccgtcaacgtgctgggcggctacaaagtgcagggccgccaggaggcccaggcccggcagatgcgcgccgacgccattgccctggaacaggccggtgcggccatgctgctgctcgagtgcgtacccagcgaactggcggcggaaatcaccaatgccgttggcatcccggtaatcggcattggcgccggcagcgccaccgatggccaggtactggtactgcacgacatgctcggcctgtcgctgagcggccgggtaccgaagttcgtgaagaacttcatgcagggccaaccggatatccatagcgccctcgtcgcttacgtcgaggcggtcaagcaagtcagtttcccaggcagcgaacacgggttcagtgcatga

SEQ ID NO: 101269 - protein, 266 aa, Pseudomonas putida
MPEVTLTTLNGLKAKGEKITMLTCYDATFAKAASQAGVEVLLVGDSLGMVLQGHDSTLPVTTAEMAYHTASVKRGNDGALILTDLPFMAHATPEQAFANSATLMQAGAHMVKIEGAAWLAETIRLLAERGVPVCAHMGLTPQTVNVLGGYKVQGRQEAQARQMRADAIALEQAGAAMLLLECVPSELAAEITNAVGIPVIGIGAGSATDGQVLVLHDMLGLSLSGRVPKFVKNFMQGQPDIHSALVAYVEAVKQVSFPGSEHGFSA

SEQ ID NO: 101270 - DNA, 801 bp, Pseudomonas syringae pv
  CDS (1)..(801): transl_table=11
atgccgaacataaccgttacgtcgctgctggccatgaagcacaagggtgagaaaatcaccatgctgacctgttacgacgcaaccttcgcccacacggcctgccaggcgggtgtcgaagtgctgctgataggcgactcgctgggcatggttttacaggggcacgacagcaccttgccggtcaccaccgccgagaccgcctatcacgtggcctgtgtgaaacgcggcaatcagggcgcgctgattcttgccgacctgccgttcatggccaacgccacgctggaacagaccttcatcaacagcaccacgctgatgcaggccggtgcgcacatgatcaaggtcgagggcgctgcgtggctgggcgaatcgatccgcctgctggcagagcgcgggatcccggtgtgcgcgcacatgggcctgacaccgcagtcagtcaatgtgctgggcggttacaaggttcagggccgactggaagcgcaggcgcggcagatgcgcgccgacgccatcgccctggaacaggcaggcgccgccatgatcctgctggagtgcgtgccgagcgagctggccgaagaaatcacccacgcggtaaagattccggtcatcggcattggcgcaggcagcgccaccgacggccaggtgctggtgttgcacgacatgctgggcctgtccatcaccggacgcgtacccaagttcgtgaaaaacttcatgatcggtcagcccgacattcagtcggccattcaggcctacgtcagcgccgtcaaagacgtcagttttccggctattgaacacggattctcggcatga

SEQ ID NO: 101271 - protein, 266 aa, Pseudomonas syringae pv
MPNITVTSLLAMKHKGEKITMLTCYDATFAHTACQAGVEVLLIGDSLGMVLQGHDSTLPVTTAETAYHVACVKRGNQGALILADLPFMANATLEQTFINSTTLMQAGAHMIKVEGAAWLGESIRLLAERGIPVCAHMGLTPQSVNVLGGYKVQGRLEAQARQMRADAIALEQAGAAMILLECVPSELAEEITHAVKIPVIGIGAGSATDGQVLVLHDMLGLSITGRVPKFVKNFMIGQPDIQSAIQAYVSAVKDVSFPAIEHGFSA

SEQ ID NO: 101272 - DNA, 849 bp, Pyrococcus abyssi
  CDS (1)..(849): transl_table=11
atgagggagataacccctagaaaaattatcgagatgaagggaaaagaaaagatagcgatgataaccgcttacgattacccatcggctcttctcgctgacaaagctgggttcgacatagtctttgttggagattccctggggatggtagtgtatggagaaccaaatactctcaacgtgagcatggagcagatggtattccacacgagagccgtagcaagggcagttaagagagccctagttctagctgacatgccctttggaagctatgaggtgagcgttgaagaaggaattaagaatgcgataaagctaatacaggctggagctgatgccgttaaaattgaaggaggctacgatcacaaaaagttagttaaaaggcttgttaggatgggcattccagttatggggcatactggattaacgcctcaacgctacttaaggcttgggggttataggattatgggttccacggaggaggaggtcgaggagataataagggatgcaaaagccctagaaaaggcgggagcctttgctgtggtcttggagttcgttcttgcagatgttgctaagctcgtgactgaagaagtctccataccgacgataggaataggctctgggccctatgtggatgggcaagttttagtttggcacgacgttctcggcctctacgaggagtcaccacccttcgttaagaggtacgcgaacttgagggatgaaatattgggggcaatctccgaattcaaaaaagatgtaaaggaaggaaaattcccaggaagggagcattactgggagttccaggataaggaagaatttaagaggataaaggagagcgttttgaggaaggttgactaa

SEQ ID NO: 101273 - protein, 282 aa, Pyrococcus abyssi
MREITPRKIIEMKGKEKIAMITAYDYPSALLADKAGFDIVFVGDSLGMVVYGEPNTLNVSMEQMVFHTRAVARAVKRALVLADMPFGSYEVSVEEGIKNAIKLIQAGADAVKIEGGYDHKKLVKRLVRMGIPVMGHTGLTPQRYLRLGGYRIMGSTEEEVEEIIRDAKALEKAGAFAVVLEFVLADVAKLVTEEVSIPTIGIGSGPYVDGQVLVWHDVLGLYEESPPFVKRYANLRDEILGAISEFKKDVKEGKFPGREHYWEFQDKEEFKRIKESVLRKVD

SEQ ID NO: 101274 - DNA, 789 bp, Pyrobaculum aerophilum
  CDS (1)..(789): transl_table=11
gtgtccgccaggaggcgggttacggattttgtaaagggaaaagggccgtatgtgtgggtcacagcttacgactacccaacagctaaaatagtagacgaggccggcgtagacggaatactagtgggcgactcgttgggaatggtggtgttgggcttgcccaatacactcggcgtaactctcgcggatatgataagacatacccaggcagtagcccgcgcgcggccaagggcgttagtagtcgcagacatgccgtttatgagttacgagaccgggcccagagacgcgctgaggaacgcgtctaaattaattaaagccggggcagacgcagttaagctggagggaggcgctgaatacgcccgtattgtagaaaagctcgtaaaagcggggataccggtaatgggccacattggccttaacccacagcgcgtcttagccctaggcggctttaaaatggtgggccggacggaggaacagaggcgtaagctactagacgacgcaaaggcgttaagagacgccggggccttctcccttgtgatagaattcgtccccgcgtctgtggcaaaagaaattacagaggccgtagacatacccactatatgcatcggcgcggggccccactgcgacgggcagatactggttctacacgatataataggccttacggagaggcctccctctttcgccaagagatatgccaacgtcgccgatgtgatacgaagcgcagttaagcagtatgtaaatgaggtgaagacgggccaattcccctctaaagaacactttaaagagtag

SEQ ID NO: 101275 - protein, 262 aa, Pyrobaculum aerophilum
MSARRRVTDFVKGKGPYVWVTAYDYPTAKIVDEAGVDGILVGDSLGMVVLGLPNTLGVTLADMIRHTQAVARARPRALVVADMPFMSYETGPRDALRNASKLIKAGADAVKLEGGAEYARIVEKLVKAGIPVMGHIGLNPQRVLALGGFKMVGRTEEQRRKLLDDAKALRDAGAFSLVIEFVPASVAKEITEAVDIPTICIGAGPHCDGQILVLHDIIGLTERPPSFAKRYANVADVIRSAVKQYVNEVKTGQFPSKEHFKE

SEQ ID NO: 101276 - DNA, 852 bp, Pyrococcus furiosus
  CDS (1)..(852): transl_table=11
atgagagaaatcacccccaagagaattatggaaatgaagggaaaagaaaagatcactatgataacagcctatgattatccctcagcacttcttgcagataaggcaggttttgacatagtctttgtcggtgactcccttggaatggttgtctatggagagcaaaacaccctcaacgttacaatggatcagatgattttccatactagggcagttgccaaagccgtgaagagggcattggttttggcagacatgcccttcggcagctatgaagtttctgttgaagagggagtgaagaacgccataaagctaattcaggccggagcagatgcagttaagatagaggggggctatgaccatagaaaacttgtcaaaaagctggtaaggatgggaatcccagttatgggccacacagggcttactccccagagatacctaaggctcggtggttacagaataatgggagagaatgaagaggaagttgaggaaatattgagggatgcaaaagctttggaaaaagctggggcctttgccgtcgttctggaatttgtcctagccgacgtggcaaagctagttactgaagaggtctcaatccccaccataggaattggctctggaccctacgttgatggccaagttttggtttggcacgatgttttggggctatatgaaagttcaccccccttcgccaagaggtatgcgaaccttagagaagaaatactgagggcaatatcggagtttagaaaagaggttaaagaaggaaaattcccaggaaaggagcactactgggaataccaagataaagaaacatttaataggattaaagagaacgtcatgagaaagcttaggctttag

SEQ ID NO: 101277 - protein, 283 aa, Pyrococcus furiosus
MREITPKRIMEMKGKEKITMITAYDYPSALLADKAGFDIVFVGDSLGMVVYGEQNTLNVTMDQMIFHTRAVAKAVKRALVLADMPFGSYEVSVEEGVKNAIKLIQAGADAVKIEGGYDHRKLVKKLVRMGIPVMGHTGLTPQRYLRLGGYRIMGENEEEVEEILRDAKALEKAGAFAVVLEFVLADVAKLVTEEVSIPTIGIGSGPYVDGQVLVWHDVLGLYESSPPFAKRYANLREEILRAISEFRKEVKEGKFPGKEHYWEYQDKETFNRIKENVMRKLRL

SEQ ID NO: 101278 - DNA, 852 bp, Pyrococcus horikoshii
  CDS (1)..(852): transl_table=11
atgagagagatcactccaaaaagaataagggagatgaagggaaaggaaaagataaccatgataacagcttacgattatccttcagcgttactagcggataaggccgggttcgatatagttttcattggtgactcccttggtatggttgtttatggagaaccaagtacccttaacgtcacgatggagcagatgattttccatactagggccgttgctaaagccgtgaagagggccctagttttggccgatatgccctttggcagttacgaagttagcgttgaggagggaattaagaacgccataaagctagttcaagctggggccgatgccgttaagattgaaggtggctacgatcatagaaagctcgttaaaaaactcgttaggatcggaattccagttatgggacatacgggattaactccccagaggtacctaaggcttggaggttatagaataatggggggaactgaggaggaggttgaggagatactcagggatgcaaaagctttggaaaaagctggggcatttgccattgttttggagtttgtcttagcggatgttgctaaactagtgacggaggaagtatcgattccaacgataggaataggatcaggaccctatgtggatggacaagtcctagtttggcacgatgtcttgggtttatatgagagttctccaccttttgccaagagatatgctaacctgaaggaagagatattaagggccatctcaaccttcagggaagaggttaaggaggggaaattcccaggaagagagcattactgggagtttcaagataaggaagagttcaaaaggattaaagacaatgtcatgaaaaagctcaatctctag

SEQ ID NO: 101279 - protein, 283 aa, Pyrococcus horikoshii
MREITPKRIREMKGKEKITMITAYDYPSALLADKAGFDIVFIGDSLGMVVYGEPSTLNVTMEQMIFHTRAVAKAVKRALVLADMPFGSYEVSVEEGIKNAIKLVQAGADAVKIEGGYDHRKLVKKLVRIGIPVMGHTGLTPQRYLRLGGYRIMGGTEEEVEEILRDAKALEKAGAFAIVLEFVLADVAKLVTEEVSIPTIGIGSGPYVDGQVLVWHDVLGLYESSPPFAKRYANLKEEILRAISTFREEVKEGKFPGREHYWEFQDKEEFKRIKDNVMKKLNL

SEQ ID NO: 101280 - DNA, 855 bp, Pyrococcus kodakaraensis
  CDS (1)..(855): transl_table=11
atgagggagataacgccgaggaagataatcgagatgaaggggaaggaaaagatagcgatggtaacggcttacgattatccctccgctcttctcgccgacaaggctggcatggacatagtcttcgtcggagactcgctcgggatggttgtctacggcgagcctaacactctcaacgtcagcatggaacagatggtcttccacacgcgggcagttgccaaggccgtaaagagggctctagttctcgcggacatgcccttcggaagctacgaggtcagcgtcgaagaaggcgttaagaacgcgatgaggctaattcgggctggagctgatgcggtaaagatagaaggcggctacgatcacaaaaagctcgttaaaaagctcgtccgcatgggaatcccagtcatgggccatacggggcttactccacagcgctacctccgccttgggggctacagactgatgggtgagactgaggaagagatcgaggagattctgcgcgatgccaaggcccttgaaaaggccggcgccttcgctgtggttcttgagttcgttcttgcagatgtggcaaagctcgtgacggaggaggtttcaatcccgaccataggcatcggggcggggcctcacgttgacggccaggtcttggtgtggcacgacctcctcggaatctacgagaacgttcccccatttgtcaagaagtatgccgatttagccagcataattcagctcgccctcgagaactaccgcggggaagtcaaagagggtagattcccggctaaagagcactactgggagttcctcgacaaggacgacttcgagagaaagaagatgaaggcccttgaacgcctggaggacgaatga

SEQ ID NO: 101281 - protein, 284 aa, Pyrococcus kodakaraensis
MREITPRKIIEMKGKEKIAMVTAYDYPSALLADKAGMDIVFVGDSLGMVVYGEPNTLNVSMEQMVFHTRAVAKAVKRALVLADMPFGSYEVSVEEGVKNAMRLIRAGADAVKIEGGYDHKKLVKKLVRMGIPVMGHTGLTPQRYLRLGGYRLMGETEEEIEEILRDAKALEKAGAFAVVLEFVLADVAKLVTEEVSIPTIGIGAGPHVDGQVLVWHDLLGIYENVPPFVKKYADLASIIQLALENYRGEVKEGRFPAKEHYWEFLDKDDFERKKMKALERLEDE

SEQ ID NO: 101282 - DNA, 825 bp, Ralstonia solanacearum
  CDS (1)..(825): transl_table=11
atgagcagctatctccaggaatccacccgcaaggccgtgaccgtcacctcgctgcagggcatgcgcgcggcgggcgagcgcatcgccatgctgacggcctacgatgccagcttcgccgccctgatggagcgcagcggcgtggacgtggtgctggtcggcgattcgctgggcaacgtggtgcagggccagaagaccacgctgcccgtcacgctcgaccacatcgtctaccacaccgaatgcgtggcgcgcggcacgaccaaggcgctgctcatgtcggatctgcccttcggcacctacggcacgcccgagcaagccttccacagcgccgtgcgcgtgatgcaggccggcgcgcagatggtcaagctcgaaggcggcgagtggctggcgcccaccctccgtttcctggtcgaacgcagcattccggtgtgcgcgcacatcggcctgacgccgcaatcggtgcatgccttcggcggcttcaaggtccagggccggggcgacgaggccgccgcgcagctcaaggccgatgcgctggccgtgcaggacgccggcgcgcagatggtcctcatggaagccattcccgccacgctggccggcgaggtgacgcgcctgctggcggtccccaccatcggcatcggcgccgggcccgagtgctcgggccaggtgctggtgatgcacgacatgctgggcgtgttccccggccaccggcccaagttcgtgcgcaacttcatggacggcctgaccaccatcgacgccgccgtcacggcctatgtgacggcggtcaaggacggcaccttccccggcccggagcacagcttcaccgcctga

SEQ ID NO: 101283 - protein, 274 aa, Ralstonia solanacearum
MSSYLQESTRKAVTVTSLQGMRAAGERIAMLTAYDASFAALMERSGVDVVLVGDSLGNVVQGQKTTLPVTLDHIVYHTECVARGTTKALLMSDLPFGTYGTPEQAFHSAVRVMQAGAQMVKLEGGEWLAPTLRFLVERSIPVCAHIGLTPQSVHAFGGFKVQGRGDEAAAQLKADALAVQDAGAQMVLMEAIPATLAGEVTRLLAVPTIGIGAGPECSGQVLVMHDMLGVFPGHRPKFVRNFMDGLTTIDAAVTAYVTAVKDGTFPGPEHSFTA

SEQ ID NO: 101284 - DNA, 861 bp, Rhizobium loti
  CDS (1)..(861): transl_table=11
ttggccacgaaactgccgaccaccgacattcgcatcggcgcggagctgattcgccgccgtaagggcggcgtcccgttggtctgcctgaccgcctacacctatcccgtcgcccgcctgctcgacccgcatgtcgacctgcttctggtcggcgacagcgtctccatggtcctgcatggccatgcgacgacgctcggcgcctcgctggggatgatgatcgcgcatgggcaagcggtgatgcgcggctcggccagggcctgcgtggtcgtcgatatgccggccggcagctacgaggattcggcggcgcaggctgtggcctcagcgcggcgcatcgttgacgagaccggctgccaggcggtgaagcttgaaggcggcgtcgacatggccgggcagattgcggcaatcgccgccgccggcattccggtcatgggtcatatcggcctgctgccgcaatcggtggaaaaggacggcggctacaagatcaagggccgcacggatgagactgtcgcggcgctgatggcggacgcgcgcgccgtcgaaaaggccggcgcgttctccgtggtcatcgagggcaccatcgaggcggtcgccgccgacatcacacgccgcatcgccattccaaccatcggcatcggtgccagcggcgactgcgatggccagattctggtcatcgacgacatggtcgggctaaccgtcgatcgcgtgccgaaattcgtcaaggaatatgccgacctgcgcagcgtgatcgcgaacgccgccgagcgctacgcagcggaggtgcgagaccggactttccccggccctagccatgtcttttcgggttcaaaagcctcttcggacttaaacggcggggatgaatcatga

SEQ ID NO: 101285 - protein, 286 aa, Rhizobium loti
MATKLPTTDIRIGAELIRRRKGGVPLVCLTAYTYPVARLLDPHVDLLLVGDSVSMVLHGHATTLGASLGMMIAHGQAVMRGSARACVVVDMPAGSYEDSAAQAVASARRIVDETGCQAVKLEGGVDMAGQIAAIAAAGIPVMGHIGLLPQSVEKDGGYKIKGRTDETVAALMADARAVEKAGAFSVVIEGTIEAVAADITRRIAIPTIGIGASGDCDGQILVIDDMVGLTVDRVPKFVKEYADLRSVIANAAERYAAEVRDRTFPGPSHVFSGSKASSDLNGGDES

SEQ ID NO: 101286 - DNA, 822 bp, Rhizobium meliloti
  CDS (1)..(822): transl_table=11
atgagcgtccagaccacgaaacggcggctcagccccgccagcatcgaagccctgaagggtgagcgcccgatcgtcagcctgacggcctatacgacgccgatcgcacggcttctcgatcctcacgtggatttcctccttgtcggcgattcgctcggcatggtgctctacggcctcgatacgaccgtcggcgtcacgctcgacatgatgattgcgcatggccaggcggtcatgcgcggttcggagcgctgttgcgtcgtcgtcgatcttcctttcggcgcctatcaggaatccaaggagcaggccttccgcagtgccgcgcgcattctgaaggaaacgggctgcagcgcagtgaagctcgagggcggtgccgagatggccgagacggtcgaattccttgtcagccgtggcattccggtgctcggccatgtgggcttgatgccgcagctcgtcaacacgacggggggctaccgctcggtcgggcgcaacgagaaggaggtggccaagatccgccgcgacgccaaggcgatcgacgatgccggcgctttcgccatcgtggtcgagggaacggtggagccggtcgcccgagagatcactgccacgctgcgcgcgccgaccatcggcatcggtgcttcgccggcctgcgacggccagatactggtatcggacgacatgctcggtcttttcaacgatttcaagccgcgcttcgtcaagcatttcgccgagttggcaccgacgatctcaaaggcggcggaggcctatgccaatgaggtgaaggcgcgcagctttccgggcatagagcacacgtttcaagtaaagcgctga

SEQ ID NO: 101287 - protein, 273 aa, Rhizobium meliloti
MSVQTTKRRLSPASIEALKGERPIVSLTAYTTPIARLLDPHVDFLLVGDSLGMVLYGLDTTVGVTLDMMIAHGQAVMRGSERCCVVVDLPFGAYQESKEQAFRSAARILKETGCSAVKLEGGAEMAETVEFLVSRGIPVLGHVGLMPQLVNTTGGYRSVGRNEKEVAKIRRDAKAIDDAGAFAIVVEGTVEPVAREITATLRAPTIGIGASPACDGQILVSDDMLGLFNDFKPRFVKHFAELAPTISKAAEAYANEVKARSFPGIEHTFQVKR

SEQ ID NO: 101288 - DNA, 810 bp, Rhodopirellula baltica
  CDS (1)..(810): transl_table=11
atgacggaatcggaaaagaggaaatcgcgaatcacgactcgaacgctgcagcgcatgcgtgaccggggtgaacggatcacgatgctgaccgcctacgattttcccaccgcaaaaattttggatgaagccggtgttgatgttttgctggtcggtgacaccgtgggaatggtcgtgcaggggcactcgacgacccttccggtgacgatggatcaaatgatctaccacgccgaaatggtggggcgagccgcggaccacgcgatggtggtggtcgatctaccgttcccggatggtcagctcgatttgcttcacagtgtccgctgtggggctcgcgtgctgaaggaaacccagtgccatgcggtcaagttggaaggcggtgctgagcaagccgaacggatcgaagcgatggtgggggccggcattccggtgatggcccacattgggctgcgcccacagaatattcatgtggaaggcggctatcgcctgcagcgtgatatcgagcgattggtggcggacgcgaaggccgctgaagctgcgggggcgttcacagttcttattgaatgcgttcccagcgaagccgccgctgcgatcacggatgcggtgaaggttccaacgatcggcattggtgccggccgagatgtgtccggacaagttttggtgacccacgacatcctcgggctgacatcaggttacaccccaaagttcacccggttgtttgccgatgttggcaataccatccgagaggcggccaagtcgtattgtgatgaagtgaaggcagccagttttccgagcgatgccgaatcgtttgagtga

SEQ ID NO: 101289 - protein, 269 aa, Rhodopirellula baltica
MTESEKRKSRITTRTLQRMRDRGERITMLTAYDFPTAKILDEAGVDVLLVGDTVGMVVQGHSTTLPVTMDQMIYHAEMVGRAADHAMVVVDLPFPDGQLDLLHSVRCGARVLKETQCHAVKLEGGAEQAERIEAMVGAGIPVMAHIGLRPQNIHVEGGYRLQRDIERLVADAKAAEAAGAFTVLIECVPSEAAAAITDAVKVPTIGIGAGRDVSGQVLVTHDILGLTSGYTPKFTRLFADVGNTIREAAKSYCDEVKAASFPSDAESFE

SEQ ID NO: 101290 - DNA, 825 bp, Rhodopseudomonas palustris
  CDS (1)..(825): transl_table=11
atgtctgttcaatcgaccattcggcggaagaccgctcccgacatccgcgcgcgcaagggcggcgatccgatcgtgatgctgacgtcgtatcacgctcacactgcctcgctggtcgatcgttattgcgacgccattctggtcggggactcgctcggcaacgtgatgcacggcttcgagaccaccgtgccggtgacgctcgagatgatgatcctgcagggtcacgcggtgatgcgcggctcgcagcatgcgctcgtcgtggtcgacatgcctttcggttcgtatgaagcctcgaaggagcaggcctttcactccgccgcacgcatcctcaaggagacgcattgcggcgcggtgaagctcgaaggcggtgtgcggatggccgagaccatcgcgttcctcaccgagcgcggcattccggtgatgggtcacatcggtctcacgccgcagtcgatcaacacgctgggctcgttccgcgcgcagggccgcgaggagggcagctgggaaccgatcgaggccgacgcgcgtgcggttgccgacgccggcgcgttctcggtcgtggtggaagccgtcgccgagccactcggccgcaagatcaccgagatgatttcgatcccgaccatcggcatcggcgccagcgccgcctgcgatggtcaggtgctggtgctcgaagacatgctcggcctgtcgccgaagccgccgaaattcgtcaagcgctatggcgatctcggccccggcatcgaagcggcgatcaagggctatgccgaggaggtccgttcgcgggctttccctgggcccgagcacgtttacggaatgaaatcgaaggcgtga

SEQ ID NO: 101291 - protein, 274 aa, Rhodopseudomonas palustris
MSVQSTIRRKTAPDIRARKGGDPIVMLTSYHAHTASLVDRYCDAILVGDSLGNVMHGFETTVPVTLEMMILQGHAVMRGSQHALVVVDMPFGSYEASKEQAFHSAARILKETHCGAVKLEGGVRMAETIAFLTERGIPVMGHIGLTPQSINTLGSFRAQGREEGSWEPIEADARAVADAGAFSVVVEAVAEPLGRKITEMISIPTIGIGASAACDGQVLVLEDMLGLSPKPPKFVKRYGDLGPGIEAAIKGYAEEVRSRAFPGPEHVYGMKSKA

SEQ ID NO: 101292 - DNA, 795 bp, Salmonella typhi
  CDS (1)..(795): transl_table=11
atgagcaaacccactactatcgctgtgctgcagaaatgcaaacaagagaaaaagcgcttcgccaccattaccgcgtacgattacagcttcgccaaactcttcgccgatgaaggcatcaatgtgatgctggttggcgactcgctgggcatgacaattcaggggcacgactccaccctgcctgtcaccgtggaagatatcgcctaccacacccgcgcggtacgccgcggcgcgccgaactgcctgctgctctccgacctgccgtttatggcttacgccacgccggaacaggcgtttgaaaacgcggctatcgtgatgcgtgcgggggccaacatggtcaaaatcgaaggcggcgcatggttggttgatacggtgaaaatgctcaccgaacgcgccgtgccggtgtgtggccatctgggattaactccccagtcggtgaatatcttcggcggctataaaattcagggccgcggcgatgccgggcagatactgctggatgatgcgctggccttagaagcagcgggcgctcaactgctggtgctggagtgcgtgccggttgaactggcgaagcgcgtcacggaagcgctgtcgattccggtgatcggcatcggcgcgggcaacgtcaccgacggtcagatcctggtgatgcacgatgcgtttggcatcaccggcggtcatattccaaaattcgcgaaaaatttccttgccgaggcgggcgacatgcgcgccgccgtacggcagtatatggcagaagtggagtccggcgtttatccgggcgaagaacacagctttcactaa

SEQ ID NO: 101293 - protein, 264 aa, Salmonella typhi
MSKPTTIAVLQKCKQEKKRFATITAYDYSFAKLFADEGINVMLVGDSLGMTIQGHDSTLPVTVEDIAYHTRAVRRGAPNCLLLSDLPFMAYATPEQAFENAAIVMRAGANMVKIEGGAWLVDTVKMLTERAVPVCGHLGLTPQSVNIFGGYKIQGRGDAGQILLDDALALEAAGAQLLVLECVPVELAKRVTEALSIPVIGIGAGNVTDGQILVMHDAFGITGGHIPKFAKNFLAEAGDMRAAVRQYMAEVESGVYPGEEHSFH

SEQ ID NO: 101294 - DNA, 792 bp, Salmonella typhimurium
  CDS (1)..(792): transl_table=11
atgaaacccaccaccatttcactgctgcagaaatgcaagcaagagaaaaaacgcttcgcgacaattaccgcctacgactacagcttcgctaagttatttgccgacgaaggtatcaatgtgatgctggttggcgactctctgggcatgacaattcaggggcacgactccaccctgcctgtcaccgtggaagatatcgcctaccacacccgcgcggtacgccgcggcgcgcccaactgtctattgctctccgacctgccgtttatggcttacgccaccccggaacaggcatgtgaaaacgcggctatcgtgatgcgtgcgggggccaatatggtcaaaattgaaggcggcgcctggctggttgatacggtgaaaatgctcaccgaacgcgccgtgccggtttgtggtcatctggggttaacgccccagtcggtgaatatcttcggcggctataaaattcagggccgtggagatgcaggacaagtgctgctggatgacgcgctggctttagaagccgctggcgctcaactgctggtgctggagtgcgtgccggttgagctggcgaagcgcgtcacggaagcgctgtcgattccggtgatcggcatcggcgcgggcaacgtcaccgacggtcagatcctggtgatgcacgatgcgtttggcatcaccggcggtcatattccaaaattcgcgaaaaatttcctcgccgaagcgggcgacatgcgcgccgccgtacagcagtatatggctgaagtggagtccggcgtttatccgggcgaagaacacagctttcactaa

SEQ ID NO: 101295 - protein, 263 aa, Salmonella typhimurium
MKPTTISLLQKCKQEKKRFATITAYDYSFAKLFADEGINVMLVGDSLGMTIQGHDSTLPVTVEDIAYHTRAVRRGAPNCLLLSDLPFMAYATPEQACENAAIVMRAGANMVKIEGGAWLVDTVKMLTERAVPVCGHLGLTPQSVNIFGGYKIQGRGDAGQVLLDDALALEAAGAQLLVLECVPVELAKRVTEALSIPVIGIGAGNVTDGQILVMHDAFGITGGHIPKFAKNFLAEAGDMRAAVQQYMAEVESGVYPGEEHSFH

SEQ ID NO: 101296 - DNA, 804 bp, Schizosaccharomyces pombe
  CDS (1)..(804)
atgtcattaaagcaaataactatatccactcttcgtcaatggaaactagcaaataaaaaattcgcttgtattacagcatatgatgccagtttttcacgacttttcgcagaacaggggatgcctgtaatgctcgtcggtgactcccttggaatgactgctcaaggtcatagtactacattaccagtgtcagtagaagacatagcatatcatacaaaaagtgttcgaagaggtgcccctaatcgcctcttgatggctgaccttccatttatgagttacagtacatgggaggatgcttgtaaaaatgcggctactgtaatgcgtgcaggtgcaaatatagttaaaatagaaggaggagggaattggatttttgaaattgtacaaagacttacagaacgatcagtccctgttgctggacaccttggcctgactcctcagtctgtaaacatttttggaggttataaaatacagggtagggaacagtctgcagcagcacgcttaattgaaaatgcacaacagttggaaaagtttggtgcgcagctgctcgtcttagaatgtattccagagtcactagctgaacaaatcactaaaactatatccatacccactatcgggataggagccggaaagcatactgatggccaaatacttgtcatgcatgatgctttaggaattactggaggccgcccacccaaatttgctaagaattttttgtccggggctggggacattcgcacggctatccaacgttacatctacgaagtagaacaaggtctataccctgctgaagaacacagtttccaataa

SEQ ID NO: 101297 - protein, 267 aa, Schizosaccharomyces pombe
MSLKQITISTLRQWKLANKKFACITAYDASFSRLFAEQGMPVMLVGDSLGMTAQGHSTTLPVSVEDIAYHTKSVRRGAPNRLLMADLPFMSYSTWEDACKNAATVMRAGANIVKIEGGGNWIFEIVQRLTERSVPVAGHLGLTPQSVNIFGGYKIQGREQSAAARLIENAQQLEKFGAQLLVLECIPESLAEQITKTISIPTIGIGAGKHTDGQILVMHDALGITGGRPPKFAKNFLSGAGDIRTAIQRYIYEVEQGLYPAEEHSFQ

SEQ ID NO: 101298 - DNA, 795 bp, Shewanella oneidensis
  CDS (1)..(795): transl_table=11
atgtctaaagttactagctcaaccctgttgaaatacaaacaggaaggtagaaaattcaccgctctgacagcctatgatgccagctttgccagcgcgttcgacggcgaaggcatcgatgtgctactggtcggcgattctttgggaatggttctccaaggccacgatgataccctgcccgtcaccaccgccgatattgcctatcacacccgttgcgtgcgtcgcggtattgagcgctcactgctgatcgctgatatgccatttatgagttatgccacgccagaacaggcaatggaaaatgccaccacgctcatgcaagcgggtgccaatatggtcaaacttgaaggtggccactggttattggaaacagtcaccaaattgactgaacgtggcattcctgtttgtgctcacttgggcctaacaccacaatcagtaaacgtttttggtggttttaaagtgcagggccgcgacgctgaaaatgcccagcgcattatcgatgaagctaaagcgttagaagcggcaggcgcgcagttattagtggttgaatgtattcccgcatcacttgccaccgcaattactcaagccttaactattcccgttatcggcattggtgcaggcgctaccaccgacggccaaattctggtcatgcacgatgtattaggtatctccagtggttatattccacgtttttcgaaaaactacctaaaacaaactggcgagatccgttctgccgtgcgggcgtatattgaagaagtcgccaacggcagcttccccagtgcggagcacacgtttaactaa

SEQ ID NO: 101299 - protein, 264 aa, Shewanella oneidensis
MSKVTSSTLLKYKQEGRKFTALTAYDASFASAFDGEGIDVLLVGDSLGMVLQGHDDTLPVTTADIAYHTRCVRRGIERSLLIADMPFMSYATPEQAMENATTLMQAGANMVKLEGGHWLLETVTKLTERGIPVCAHLGLTPQSVNVFGGFKVQGRDAENAQRIIDEAKALEAAGAQLLVVECIPASLATAITQALTIPVIGIGAGATTDGQILVMHDVLGISSGYIPRFSKNYLKQTGEIRSAVRAYIEEVANGSFPSAEHTFN

SEQ ID NO: 101300 - DNA, 819 bp, Staphylococcus aureus
  CDS (1)..(819)
atgaaaacagtaagtcaattaatagatatgaaacaaaaggaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagacgcgaaaaatgtagaacaagctggtgcagttgcgttagtacttgaagcaattccaaatgatttagcagaagaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgactaa

SEQ ID NO: 101301 - protein, 272 aa, Staphylococcus aureus
MKTVSQLIDMKQKETKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 101302 - DNA, 819 bp, Staphylococcus aureus
  CDS (1)..(819): transl_table=11
ttgaaaacagtaagtctattaatagatatgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagatgcgaaaaatgtagaacaagctggtgcagttgcgttagtacttgaagcaattccaaatgatttagcagaggaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgactaa

SEQ ID NO: 101303 - protein, 272 aa, Staphylococcus aureus
MKTVSLLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 101304 - DNA, 819 bp, Staphylococcus aureus
  CDS (1)..(819): transl_table=11
ttgaaaacagtaagtcaattaatagatatgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagatgcgaaaaatgtagaacaagctggtgcagttgcgttagtacttgaagcaattccaaatgatttagcagaggaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgactaa

SEQ ID NO: 101305 - protein, 272 aa, Staphylococcus aureus
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 101306 - DNA, 819 bp, Staphylococcus aureus
  CDS (1)..(819): transl_table=11
ttgaaaacagtaagtcaattaatagatatgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagatgcgaaaaatgtagaaaaagctggtgcagttgcgttagtacttgaagcaattccaaatgatttagcagaggaaattagcaagcacttaacaattccagtcattggtattggtgcaggaaaaggtacagatggtcaagtattggtttatcacgatatgttaaattatggtattgaacataaagcgaaatttgtgaagcaatttgctgattttagtgttggtgtggatggtttaaagcaatacgatcaagaagttaaatctggtgcatttccatcagaagaatatacgtataaaaagaaaattatgaatgaggtgaataacaatgactaa

SEQ ID NO: 101307 - protein, 272 aa, Staphylococcus aureus
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEKAGAVALVLEAIPNDLAEEISKHLTIPVIGIGAGKGTDGQVLVYHDMLNYGIEHKAKFVKQFADFSVGVDGLKQYDQEVKSGAFPSEEYTYKKKIMNEVNNND

SEQ ID NO: 101308 - DNA, 819 bp, Staphylococcus epidermidis
  CDS (1)..(819): transl_table=11
ttgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 101309 - protein, 272 aa, Staphylococcus epidermidis
MKTLNHLNKMKASQQKISMVTAYDYPSAKQAQQAEIDMILVGDSLGMTVLGYDSTVQVTLNDMIHHGKAVKRGASDTFIVVDMPIGTVGLSDEEDLKNALKLYQNTNANAVKVEGAHLTSFIQKATKMGIPVVSHLGLTPQSVGVMGYKLQGDTKTAAMQLIKDAKAMETAGAVVLVLEAIPSDLAREISQQLTIPVIGIGAGKDTDGQVLVYHDMLNYGVDRHAKFVKQFADFSSGIDGLRQYNEEVKAGTFPSENHTYKKRIMDEVEQHD

SEQ ID NO: 101310 - DNA, 864 bp, Streptomyces avermitilis
  CDS (1)..(864): transl_table=11
atgacgcagctttcggctgcccagaagccgtccgacagcagcaaggcactgtacggaggcaagggcacgcgtcgcatcaccatccgcgacatcaccaccgccaaggaacgcggcgagaagtggcccatgctcaccgcgtacgacgcgatgaccgcgtccgtcttcgacgaggccggcatcccggtcatgctcgtcggggactcggcgggcaactgccacctggggtacgagacgaccgtgcccgtcaccctcgacgagatgaccatgctgtcggccgcggtcgtacgcggcaccagccgcgccctgatcgtcggcgacctgcccttcggctcgtaccaggagggcccggtccaggcgctgcgctcggccacccggctggtcaaggaggccggggtcggggccgtgaagctggagggcggtgagcgctcgcaccgccagatcgagctgttggtcgagtccggcatcccggtcatggcgcacatcggtctgaccccgcagtccgtgaacgccatgggctaccgcgtccagggccgcggcgaggaggcggcccagcagctgctgcgggacgccaaggcggtccaggacgcgggcgcgttcgccgtggtcctggagctggtcccggcggaactggccgcggaggtcacgcgggtcctgcacatcccgacggtcggcatcggtgccggtccggagacggacgcgcaggtgctggtctggacggacatgctcgggctgaccggcggcaaggtgccgaagttcgtgaagaagtacgccgatctgcgcgaggtcatgggcaacgcggcgaaggcgttcgccgaggacgtcgtcggcgggacgttcccgctggaggagcactccgtccactag

SEQ ID NO: 101311 - protein, 287 aa, Streptomyces avermitilis
MTQLSAAQKPSDSSKALYGGKGTRRITIRDITTAKERGEKWPMLTAYDAMTASVFDEAGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNAMGYRVQGRGEEAAQQLLRDAKAVQDAGAFAVVLELVPAELAAEVTRVLHIPTVGIGAGPETDAQVLVWTDMLGLTGGKVPKFVKKYADLREVMGNAAKAFAEDVVGGTFPLEEHSVH

SEQ ID NO: 101312 - DNA, 876 bp, Streptomyces coelicolor
  CDS (1)..(876): transl_table=11
atgacgcagctttcggctgcccagacgccgcagcccaagcccgccgacgggaacagggcgctgtacgggggcaagatcaaccgccgtatcaccgtccgggacatcaccgccgccaaggagcgcggcgagaagtggcccatgctcaccgcgtacgacgcgatgaccgcctccgtcttcgacgagtccggcatcccggtgatgctcgtcggcgactccgcgggcaactgccacctcggctacgagaccaccgtgcccgtcacactggacgagatgacgatgctctcggccgcggtagtccggggcaccagccgcgccctgatcgtgggcgacctgcccttcggctcctaccaggagggcccggtgcaggcgctgcgctcggcgactcggctggtcaaggaggccggggtcggcgcggtcaagctggagggcggcgagcgctcgcaccggcagatcgagctgctggtggagtccggcatcccggtgatggcgcacatcggcctcaccccgcagtccgtcaactccatgggctaccgggtgcagggccgcggcgaggaggcggcccagcagctgctgcgcgacgccaaggcggtccaggacgcgggcgccttcgcggtcgtcctggagctggtgccggccgagctggccgccgaggtgacccggacgctgcacatcccgacggtcggtatcggcgcgggcccggacaccgacgcccaggtgctggtgtggaccgacatgctcgggctgaccggcgggcggatgccgaagttcgtcaagcagtacgccgacctgcgcaaggtcatgggcgacgcggcgaaggcgtacgccgaggacgtcgtcggcggcacgttccccgcggacgagcactccgtccactga

SEQ ID NO: 101313 - protein, 291 aa, Streptomyces coelicolor
MTQLSAAQTPQPKPADGNRALYGGKINRRITVRDITAAKERGEKWPMLTAYDAMTASVFDESGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNSMGYRVQGRGEEAAQQLLRDAKAVQDAGAFAVVLELVPAELAAEVTRTLHIPTVGIGAGPDTDAQVLVWTDMLGLTGGRMPKFVKQYADLRKVMGDAAKAYAEDVVGGTFPADEHSVH

SEQ ID NO: 101314 - DNA, 807 bp, Sulfolobus acidocaldarius
  CDS (1)..(807): transl_table=11
atgtcagcagggaaggtatcaataagggactttctgaaaaagaaggggaaagagaaaataactatgcttacagcctacgattacccaacggcaaaaataatgtcaatgacgaatcttgatggaatcctggttggcgattccttatcgatggtcgttttagggtatgaaaatactctaaaggtttctatgaaagaaatgctagttcacttggattctgtggtcagggcgaaacctagacagttagtagtcgctgatatgccatttctatcctatgaggtttcggctaatacagcagttaagaatgcgggattgtttgtaaggcatggggcggattctgtaaaacttgaggggggagaagagatggcagatgtagtgagaaagattgtgagggcggggattccagtcatgggacatatagggcttactcctcaaaggtttttgaggatcggcggatttagggttttaggaaaaagtaaacatgaggaagagcaactcttgagggatgctgaggtactagaggaggcaggtatcttttctttggttatagaaaacacttatgcagacgtagcaaagaagattactgaaaagcttaaagtaccaactatttgcattggagcaggtccctattgtgatggtcagatattagttattcatgacgttctgggactgagcgagtttacaccatattttgctaaagcatatgttaatttgaaagaggaaatccaaaaggctgttaataaatatgttgaagaagtaagggagagtaagtttccgcagggagaaaattataaggagagggaaagttga

SEQ ID NO: 101315 - protein, 268 aa, Sulfolobus acidocaldarius
MSAGKVSIRDFLKKKGKEKITMLTAYDYPTAKIMSMTNLDGILVGDSLSMVVLGYENTLKVSMKEMLVHLDSVVRAKPRQLVVADMPFLSYEVSANTAVKNAGLFVRHGADSVKLEGGEEMADVVRKIVRAGIPVMGHIGLTPQRFLRIGGFRVLGKSKHEEEQLLRDAEVLEEAGIFSLVIENTYADVAKKITEKLKVPTICIGAGPYCDGQILVIHDVLGLSEFTPYFAKAYVNLKEEIQKAVNKYVEEVRESKFPQGENYKERES

SEQ ID NO: 101316 - DNA, 804 bp, Sulfolobus solfataricus
  CDS (1)..(804): transl_table=11
atgaaaaaggtgacaataagggatttcataaagaagaaatcaatgaaggagaaaattacgatgttaacagcttacgattaccccacagcgaaaataatatctaatactacgctagattccatactagtaggagattccttaggaatggttgttctaggatatacaaatacgcttaacgtaaccatgagagacatgatctcccatactagagcagtagcaagagctaatcctcctcagttaatagtttcagatatgccgttcctaagttatgagatagacgtgaaaagtgcagtgaagaatgcaggtcttttagttaaggctggtagtgacgcggtaaaactagagggtggagaggaaattaaagacattattagagcaatcgtaaaggctggaatacccgtaatggggcatattggtttaacccctcaaaggttcttgaggctagggggatttagaactatcggaaaaactaagcaggaagaggagcaattaataaaggatagtttagaactagaagatgcaggggtattttcaatagttatagaaaatacatacgtggatatagctaaaaggattacggaaaaactaaacgtgcctacaatctgtataggagcaggcccatattgtgatggacaagtgttagtaatacacgatttactagggttatctgaggttaccccttacttcgctaagtcatacgttaatttgaaagaaatcatctccagcgctattaatcagtatataattgacgtgaaaactaataagtttcctgaaaaacaacattataaggaaagagaaagttga

SEQ ID NO: 101317 - protein, 267 aa, Sulfolobus solfataricus
MKKVTIRDFIKKKSMKEKITMLTAYDYPTAKIISNTTLDSILVGDSLGMVVLGYTNTLNVTMRDMISHTRAVARANPPQLIVSDMPFLSYEIDVKSAVKNAGLLVKAGSDAVKLEGGEEIKDIIRAIVKAGIPVMGHIGLTPQRFLRLGGFRTIGKTKQEEEQLIKDSLELEDAGVFSIVIENTYVDIAKRITEKLNVPTICIGAGPYCDGQVLVIHDLLGLSEVTPYFAKSYVNLKEIISSAINQYIIDVKTNKFPEKQHYKERES

SEQ ID NO: 101318 - DNA, 804 bp, Sulfolobus tokodaii
  CDS (1)..(804): transl_table=11
atggaaaaggttacaataagggatttcttgaaaaagaaggaaaagaaagagaaaataataatgttaacagcctacgattatccctcagcgaagataatatctcagacgaatcttgatggtatcctagttggagactcccttggaatggtagttttaggaaaagagaacacacttaaagtgactatgagagatatgttaattcatttagacgcagtagtaaaagctaagcctccacagttaatagttgctgatatgccattcttaagctatgaaacgtcaatcaaagatgctgtaaaaaatgccggattacttgctagacacggtgctgatgcagtaaaattagaaggtggagaggaaatgagagatgttgttagggctatagtaagggctggaatacctgttatgggtcatataggattaaccccacaaagattcttaagaataggtggatatagaattttggggaaaagagaaaaagaagaggaacaattacttaaagatgcaaaaacactagaagaagctggggctttttcaatagtaatagaaaacacttactcagatgtggctaaaaagataactgaaagcattagtattccaacgatatgtataggagcaggaccatattgtgacggacaaattttagttattcatgacttacttggtctttcagattttactccttattttgcaaaaaaatatatagatttacggggactaataagaagagcaatagaggattatatttcagaggtaaaagaagggaaattcccaggaaaagaacattataaatctcgagatagctga

SEQ ID NO: 101319 - protein, 267 aa, Sulfolobus tokodaii
MEKVTIRDFLKKKEKKEKIIMLTAYDYPSAKIISQTNLDGILVGDSLGMVVLGKENTLKVTMRDMLIHLDAVVKAKPPQLIVADMPFLSYETSIKDAVKNAGLLARHGADAVKLEGGEEMRDVVRAIVRAGIPVMGHIGLTPQRFLRIGGYRILGKREKEEEQLLKDAKTLEEAGAFSIVIENTYSDVAKKITESISIPTICIGAGPYCDGQILVIHDLLGLSDFTPYFAKKYIDLRGLIRRAIEDYISEVKEGKFPGKEHYKSRDS

SEQ ID NO: 101320 - DNA, 798 bp, Synechococcus elongatus
  CDS (1)..(798): transl_table=11
gtgtatggaatgatggtgcgtcgctctgtaaccttaccccaactccaagcaaaaaaagcgctgggagaacccattaccatgctcacggcttgggattatctgtgggcacgcctgttggatgcggccggggtggatgtgatccttgtgggggattccctggggatggttgcccttggatatccaaccacattgcctgtgacccttgaccagatgattcaccatgcccaagcggtgcgccgaggcgttagccatagtttccttgtgtgtgatctgccctttttgagctaccaagaaagccctgaacaggctctgagatcggcggggcgcttaatcaaagaggcagaagtgcaagccgtgaaaatggaaggtgcctcccctgtggtccaggcagcaacgcggcgcttagtggaggctggaattccagtgctgggtcatgtgggtctattgccccaacgggtacatcagttgggaggatggcgacaacaggggaatactccccaagacgcagcagcgattctagcgggtgcccttgcccttgctgaagcaggtgtctttgcggtgattttggagcatattcctgcggccttagcgcagcagattaccgcccagttgaagattcccacaattggaattggcgcaggcccccactgtgatggtcaggtactggtgacagcagatgttttgggcttgagtccccaggtgcccccctttgctaaggtgtatgccgacttgggaacacaggcgatcgccgccattgaaaattactgccaagccgtcaaatcgcggcaatttccctga

SEQ ID NO: 101321 - protein, 265 aa, Synechococcus elongatus
MYGMMVRRSVTLPQLQAKKALGEPITMLTAWDYLWARLLDAAGVDVILVGDSLGMVALGYPTTLPVTLDQMIHHAQAVRRGVSHSFLVCDLPFLSYQESPEQALRSAGRLIKEAEVQAVKMEGASPVVQAATRRLVEAGIPVLGHVGLLPQRVHQLGGWRQQGNTPQDAAAILAGALALAEAGVFAVILEHIPAALAQQITAQLKIPTIGIGAGPHCDGQVLVTADVLGLSPQVPPFAKVYADLGTQAIAAIENYCQAVKSRQFP

SEQ ID NO: 101322 - DNA, 807 bp, Synechococcus sp
  CDS (1)..(807): transl_table=11
atgccgatcacgcctcgtcacctgcgtcagtggaagcaacagggtcgcccgattgtggcgctgaccgcttgggattttgcgatcgccagcattttggatgaggcaggcatcgatctggttcttgttggcgattccttggcaatggttgccctcgggcatcccacgacgctgcccctaagcctagaagacatgattcaccatgtgcaggccgtgcagcgtggttgccgcaatgccctgatcgtcagcgacttgccgtttttgtcctaccaaaccagcccagaagacgcgattctcgcagcaggacaactgctgaaggtgacggaggctcaagccgtcaaattagaggggggctatccgcgcctcttagaaacggtgcaacgactggtggaagtcggcattccggtgatggggcatgtggggctgactccgcaatccgtgcgccagctcggctatcgccagcagggacaaacgcccgaagcgcagcagcagattttggatcaggctctcgcgctggaggctgctggcgcgttcgcgatcgtcttggaacacattcccgatcgccttgcagccatgatcacggcgaaactctcgattccaacgatcgggattggggctggccctaattgtgatgggcaaattttggtgaccgccgatctgctaggactgacccctagccagccgccctttgcgccggcttatctcaacctgcggcaagcgatcggatctgccgtgcagcgttacgcccgagaagtgcgcgatcgccagttcctccagtctcagccagctgaacaggaaccactctcctag

SEQ ID NO: 101323 - protein, 268 aa, Synechococcus sp
MPITPRHLRQWKQQGRPIVALTAWDFAIASILDEAGIDLVLVGDSLAMVALGHPTTLPLSLEDMIHHVQAVQRGCRNALIVSDLPFLSYQTSPEDAILAAGQLLKVTEAQAVKLEGGYPRLLETVQRLVEVGIPVMGHVGLTPQSVRQLGYRQQGQTPEAQQQILDQALALEAAGAFAIVLEHIPDRLAAMITAKLSIPTIGIGAGPNCDGQILVTADLLGLTPSQPPFAPAYLNLRQAIGSAVQRYAREVRDRQFLQSQPAEQEPLS

SEQ ID NO: 101324 - DNA, 783 bp, Synechocystis sp
  CDS (1)..(783): transl_table=11
atggccattacccccacccaattgttggattggaagcgtcaacaacggcctattgtggcccttactgcctgggatacggcgatcgcctcggtgttggatgcggcgggagtggaaattattctggtgggggattccctcggaatggtggctttgggctacgaaactaccctaccggtgagcttggacaccatgattcaccacacagcggcagttaaaaggggagtacaaagagccttggtggtctgtgacctgccctttttgacctatcaggaaagtccagcccaggccatggggtcagcgggaagggttttgcaggaaaccggtgcccaggcagtgaaattagaagggggtcacccccgcatggtggaaaccgtagctcgactaacggaggtgggcattccggtgatgggtcatgtgggcttaacgccccaatcagtccatcagttgggttatcggcaacagggccaggacccggccacagcggagaaaattcttcatcaggcgatcgccttggcagaggcgggagtgtttgccattgttttagaacatattcctagcgaactagcggctagtatcactgagcagttgcccattcccaccattggcattggggcagggccccagtgtgacggccaggttttggtgacggcggatttactcggtttgacagtcaaacaaccgccctttgctccggcctatctgaatttacgacataccattacggaaacagtgcataaattcagtggagaagtgcgacaaagacaatttccccggcggggttag

SEQ ID NO: 101325 - protein, 260 aa, Synechocystis sp
MAITPTQLLDWKRQQRPIVALTAWDTAIASVLDAAGVEIILVGDSLGMVALGYETTLPVSLDTMIHHTAAVKRGVQRALVVCDLPFLTYQESPAQAMGSAGRVLQETGAQAVKLEGGHPRMVETVARLTEVGIPVMGHVGLTPQSVHQLGYRQQGQDPATAEKILHQAIALAEAGVFAIVLEHIPSELAASITEQLPIPTIGIGAGPQCDGQVLVTADLLGLTVKQPPFAPAYLNLRHTITETVHKFSGEVRQRQFPRRG

SEQ ID NO: 101326 - DNA, 813 bp, Thermotoga maritima
  CDS (1)..(813): transl_table=11
gtgaacgtcgagaagctcaagaagatgaaaggtaaggaaaagatcgtgatggtcaccgcgtacgatgctcccagcgccagaatcgcgagagatgccggcatagatgtcattctcgttggagactcccttggaaacaacgttctcgggtacgaaaacacgattcccgtaactatggaagaaatgctgatacacgtggcagccgtgaaaaggggagccccagacgctttcatagtagcagacatgcctttcctttcctaccagacttccgtggaaaaagccgtggagaacgctgggaagttcttgaaggtcggtgcgaatgccgtgaaaatagagggtggagaggaattcggtgaactcgttcaaaaactggtcgaaagcggtattccggtgatgggccacataggcctcacacctcagttcgtgaaccgtttcggtggttacagagtccaaggaaagacggaaaaaaacagagaatacctcttgaggagcgccagggagcttgaaaagaggggggcttttgctatcgttctggagctcgttgttgaggaagtcgctaaggagatcaccgaaagcgtctccattccaaccattggcatcggttcaggccgtttctgtgatggtcaggttctcgtctggcacgaccttctcggtctgaatccggacttcgcacctcgcttttccaagaaatacgcgaatctgtacgaagtcatattgaaagctctgcaagagttcagaagagaggtaaaaaagggtctgttccccaccgaagaacattcattcacagataaatctaaaggaggtgtgtcttcatga

SEQ ID NO: 101327 - protein, 270 aa, Thermotoga maritima
MNVEKLKKMKGKEKIVMVTAYDAPSARIARDAGIDVILVGDSLGNNVLGYENTIPVTMEEMLIHVAAVKRGAPDAFIVADMPFLSYQTSVEKAVENAGKFLKVGANAVKIEGGEEFGELVQKLVESGIPVMGHIGLTPQFVNRFGGYRVQGKTEKNREYLLRSARELEKRGAFAIVLELVVEEVAKEITESVSIPTIGIGSGRFCDGQVLVWHDLLGLNPDFAPRFSKKYANLYEVILKALQEFRREVKKGLFPTEEHSFTDKSKGGVSS

SEQ ID NO: 101328 - DNA, 795 bp, Vibrio cholerae
  CDS (1)..(795): transl_table=11
atgaaaaaaattaccataaacgacctgatgaaatggaagcaggaaggtcgcaaatttgctacatcaaccgcttatgatgcgagttttgctcagttatttgagagccaagaaatgcccgtcttattggtcggtgattcacttggcatggtgttacaaggagaaaccgacaccttacccgtgacggtggatgacattgcgtatcacacccgctgtgtgcgtaaaggcagccccaattgtctgctgatggctgacatgcctttcatgagctacgccacaccagaacaagcgtgtgaaaacgcggccaaactggttcgcgccggtgcaaacatggtgaaaattgaaggtggcgattggttagtcgacaccgtaaaaatgttgactgaacgtgcagtgcctgtgtgtgctcacctcggtttaacgccgcagtcggtcaatatttttggtggctacaaagtacaaggccgcgagcaagataaagcggatcgcatggtacgtgatgcgttggctctgcaagaagcgggcgcacaaattgtcctgctagagtgcgttccagccgaactcgccaaccgaattactcaaattttggatgttcccgtaataggtattggcgcgggtaatggtactgacggccaaattttggtgatgcacgatatgtttggaatttcggcgaactacatgccaaaattctcgaaaaatttcttggctgagactggcgatattcgccaagccgttgccaaatatatcgaagatgttgccagtggcgcgtttcccgatctcgcccacaccattgcctaa

SEQ ID NO: 101329 - protein, 264 aa, Vibrio cholerae
MKKITINDLMKWKQEGRKFATSTAYDASFAQLFESQEMPVLLVGDSLGMVLQGETDTLPVTVDDIAYHTRCVRKGSPNCLLMADMPFMSYATPEQACENAAKLVRAGANMVKIEGGDWLVDTVKMLTERAVPVCAHLGLTPQSVNIFGGYKVQGREQDKADRMVRDALALQEAGAQIVLLECVPAELANRITQILDVPVIGIGAGNGTDGQILVMHDMFGISANYMPKFSKNFLAETGDIRQAVAKYIEDVASGAFPDLAHTIA

SEQ ID NO: 101330 - DNA, 795 bp, Vibrio parahaemolyticus
  CDS (1)..(795): transl_table=11
atgaaaaagatgaccatcaacgaccttatcaagtggaagcaagaaggtcgtaaatttgctacttcaaccgcttacgatgcgagctttgcacaactttttgaaagccaagaaatgcccgttcttttagttggtgattcacttggtatggtattgcaaggtgaaaacgatacgctaccagtaacggtagacgacatcgtgtaccacactcgctgtgtacgtgctggcagcccgaattgcttactaatggccgatatgccattcatgagctacgcaacaccagagcaagcgtgtgagaacgcagcaaaattgatgcgcgcaggcgcaaacatggtaaaaatcgaaggcggcgactggctagttgataccgttaagatgcttactgaacgcgcagtgccagtctgtgctcaccttggtttaacccctcagtctgttaacatttttggtggttacaaaatccaaggtcgcgatcaagaaaaagcggatcgcatggtaaaagatgcgttagcgctacaagaagcaggcgctcaaatcgtcctactagaatgtgtgcctgctgaactggcagagcgcattactaaagtactcgacgtgccagtcatcggtatcggtgcgggtaacgtaacggatggtcagattcttgtaatgcatgatatgttcggcatctctgccaactacatgcctaaattctccaaaaacttccttgctgaaacaggtgatatgcgcaaagccgttgcaaaatacattgaagatgtagcaaacggtgtattcccagacgacgcacataccattgcctag

SEQ ID NO: 101331 - protein, 264 aa, Vibrio parahaemolyticus
MKKMTINDLIKWKQEGRKFATSTAYDASFAQLFESQEMPVLLVGDSLGMVLQGENDTLPVTVDDIVYHTRCVRAGSPNCLLMADMPFMSYATPEQACENAAKLMRAGANMVKIEGGDWLVDTVKMLTERAVPVCAHLGLTPQSVNIFGGYKIQGRDQEKADRMVKDALALQEAGAQIVLLECVPAELAERITKVLDVPVIGIGAGNVTDGQILVMHDMFGISANYMPKFSKNFLAETGDMRKAVAKYIEDVANGVFPDDAHTIA

SEQ ID NO: 101332 - DNA, 795 bp, Vibrio vulnificus
  CDS (1)..(795): transl_table=11
atgaaaaaaatcaccattaatgacctgattaagtggaagcaggaaggtcgtaaatttgcgacttcaacagcatacgatgcaagttttgcgcaactttttgagagccaagaaatgccagtgttactggtcggcgactctcttggtatggtgttgcaaggcaaaaatgacacgcttccagtgactgttgaagacattgcttaccacacacgctgtgttcgtgcgggtagcccaaattgtctattgatggcggatatgccatttatgagttacgccacaccagagcaagcctgtgaaaacgcggcgcaattaatgcgagcgggcgccaacatggtcaaaatcgaaggtggcgattggctggttgatacggtaaaaatgctcacagagcgtgcggttccagtgtgtgcccacctcggtttaacaccacaatccgttaatatttttggtggttacaaagtgcaaggccgcgatcaggaaaaagccgatcgcatggtcaaagatgcactggcgttgcaagcggcaggcgcacaaatcgttctacttgagtgtgtacctgctgagctagcagcacgaattactcaagtgctggatgtacccgtgattggtattggcgctggaaatgtcaccgatggccaaatcctcgtgatgcacgatatgtttggtatttcagccaattacatgccaaaattctcgaaaaatttcctggcagaaacaggagatatgcgcaaagccgtggcgctgtacatggaacaagtacaagcaggcaccttccctgatgaagcgcacaccattgcttag

SEQ ID NO: 101333 - protein, 264 aa, Vibrio vulnificus
MKKITINDLIKWKQEGRKFATSTAYDASFAQLFESQEMPVLLVGDSLGMVLQGKNDTLPVTVEDIAYHTRCVRAGSPNCLLMADMPFMSYATPEQACENAAQLMRAGANMVKIEGGDWLVDTVKMLTERAVPVCAHLGLTPQSVNIFGGYKVQGRDQEKADRMVKDALALQAAGAQIVLLECVPAELAARITQVLDVPVIGIGAGNVTDGQILVMHDMFGISANYMPKFSKNFLAETGDMRKAVALYMEQVQAGTFPDEAHTIA

SEQ ID NO: 101334 - DNA, 798 bp, Wigglesworthia glossinidia brevipalpis
  CDS (1)..(798): transl_table=11
atgaaaaaaacaaatatatatgatttatacaaattaaaagaacaaaataaaaaatttgcttctataactgcttatgatgcaacatttgcaaatttattttttaaaaaaggaattagaacaattttagtaggggattcattaggaatgacgattcaaggtcattcatcaacagttcctgtaaaaatagatgaaatgatgtatcatacaaaatgtgttagaagaggagctccttcatgtttaataatttctgatcttccttttatgagctataataatataaatgatgcattaaataattccaaaaaattaattcagtcaggagctaatatagtcaaattagaaggaggattgtgggtttcagatattattcatgaacttaatacaagatctataccagtatgcggacacataggattaactcctcaatctataaacatgcaaggatcatataaaatacaaggaagaaataataatgatgcaattaggctaatggaagaagcaatttctatagaagaatcaggagcaaaattattagttttagaatgtattatacaaaaattatctaacaacattactaaaaaattaaatattccaacaataggaatagggtctggtaaaaaaacagacggccaaatactagtaatgcaagatgttcttggtattactatagaaggcaaaattccatctttttcaaaaaattttactaaaaataaatttggaatagaaaaagctatagaattatatatagaagaagttgaaaatgaattatttccaagtgaaaatcatagttttaattaa

SEQ ID NO: 101335 - protein, 265 aa, Wigglesworthia glossinidia brevipalpis
MKKTNIYDLYKLKEQNKKFASITAYDATFANLFFKKGIRTILVGDSLGMTIQGHSSTVPVKIDEMMYHTKCVRRGAPSCLIISDLPFMSYNNINDALNNSKKLIQSGANIVKLEGGLWVSDIIHELNTRSIPVCGHIGLTPQSINMQGSYKIQGRNNNDAIRLMEEAISIEESGAKLLVLECIIQKLSNNITKKLNIPTIGIGSGKKTDGQILVMQDVLGITIEGKIPSFSKNFTKNKFGIEKAIELYIEEVENELFPSENHSFN

SEQ ID NO: 101336 - DNA, 789 bp, Wolinella succinogenes
  CDS (1)..(789): transl_table=11
atgaaaaatattaccgtctcttcgattaaaaagaagaaaaaccaagagaaaatcaccatgatcactgcctatgatgcgctttttgcgaggctttttgatggtgaagtggatattttgcttgtgggagatagtttggcgatgagctttgggggtgaggaagacaccctccctattggaatggatgagatgatctatcataccaaggctgtttgtaggggggcggaaaagtcccttgtcgtgattgatatgccctttggaagttacgacaccaaggaaaaagccctccataacgccatccgtgcctataaagagagtggtgctagcgcggtaaagcttgaagggggaattcaaaaggctgaaaccatcgcgcttttgagtgaaaatggaatcgccgttatggggcacatagggctcaagccccaatttgtgcgtgctgagggaggatacaaggtcaaaggcaaagaggagggcgaagctcaatctctcctaagagacgccaaagcgctagaagaatcaggagtctttgccctcgtgcttgaaggggtgaaggcagaggtcgcccaagaggtcgctagaagcgtgagcgtgcccgtcatcgggattgggagcggatcgcaagtggacggtcaggtgctggtgtggagcgatatgctgggattttttgaaggattcacgcctaaatttgttcgccgttatcttgagggagcgagccttatccgtcaaggggtgagggagtacgccaaagatgtgcgagaggggcgattcccttcggaggctgagagctactga

SEQ ID NO: 101337 - protein, 262 aa, Wolinella succinogenes
MKNITVSSIKKKKNQEKITMITAYDALFARLFDGEVDILLVGDSLAMSFGGEEDTLPIGMDEMIYHTKAVCRGAEKSLVVIDMPFGSYDTKEKALHNAIRAYKESGASAVKLEGGIQKAETIALLSENGIAVMGHIGLKPQFVRAEGGYKVKGKEEGEAQSLLRDAKALEESGVFALVLEGVKAEVAQEVARSVSVPVIGIGSGSQVDGQVLVWSDMLGFFEGFTPKFVRRYLEGASLIRQGVREYAKDVREGRFPSEAESY

SEQ ID NO: 101338 - DNA, 816 bp, Xanthomonas axonopodis pv
  CDS (1)..(816): transl_table=11
atgagcagccacgccgacagcaagccctggaccgtgcccgccttggcgcaggccaagcgcgagggtcgaaaactggtcatgttgaccgcgtacgacgccggtttcgcgcgcaccttcgacgccaatggcgtggacctgatcctggtcggcgattcgctcggcatggtggtgcaggggcacgattccaccttgccggtgaccaccgccgacatggtctaccacacggcttcggttgcccgtgcgctcgatcgcgccttgctggtggcggacctgtcgttccaggccgacgccacgcctgagcgtgcattggacgccgccacccagctgctgcaggctggcgcggagatggtcaagatcgaaggcgccgggcacaagctggaggtcatccgttacctggtcgagcgcgagatcccggtctgctcgcacctgggcctgaccccgcaatcggtgctgcggttcggtggctacaaggtgcaggggcgcggcgaggctggcgagcagctgcgtcgtgacgcacaggccgtggtcgacgccggtgccagcctgttggtgctggaatgcgtgccgacgccgatcgccacgcagattagtgccgagctcagcgtgcccaccatcggcatcggtgccggccccggttgcgacggccaggtgctggtgatgcacgacatgctcgggctggacagtggccaccgccggcccaagttcgtcaaggatttcctggccgaaggcggctcggttgccggcgcggtgcgcgcctatgcacaggcggtgcgcgacggcagttttcccgatgcagagcacgcgtacgccgcatga

SEQ ID NO: 101339 - protein, 271 aa, Xanthomonas axonopodis pv
MSSHADSKPWTVPALAQAKREGRKLVMLTAYDAGFARTFDANGVDLILVGDSLGMVVQGHDSTLPVTTADMVYHTASVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLLVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 101340 - DNA, 816 bp, Xanthomonas campestris pv
  CDS (1)..(816): transl_table=11
atgagcagccacgccgacagcaagccctggaccgtgcccgccttggcgcaggccaagcgcgacggtcgaaaactggtcatgttgaccgcctatgacgccgggtttgcgcgcaccttcgacgccaatggcgtggacctgatcctggtgggcgactcgctgggcatggtggtgcaggggcacgagtccacgctgccagtgaccacggccgacatggtctaccacaccgccgcggtggcccgcgtgctggagcgtgcgttgctggtggccgacttgtcgttccaggccgatgccacgccggaacgtgcgctcgatgccgccacccagctgctgcaggcgggtgcggagatggtcaagatcgaaggcgccgggcacaagctcgacgtgatccgctacctggttgagcgcgaaatcccggtgtgttcgcacctggggctcacgccgcaatcggtgctgcgcttcggcggctacaaggtgcaaggccgtggcgaagccggcgaacagctgcgtcgcgacgcccaggccgcggtcgatgccggtgccagcctgatcgtgctcgaatgcgtgccgacgccgatcgcagcgcagatcagcgccgagttgcgcgtgcccacgatcggcattggtgccggccccggctgcgatggccaggtgctggtgatgcacgacatgctgggcctggacagcggccatcgccgtcccaagttcgtcaaggatttcctggccgaaggcgggtcggtcgcgggcgccgtgcaggcctacgcgcaggccgtgcgcgatggcagctttcccgacgccgagcacgcgtacgccgcatga

SEQ ID NO: 101341 - protein, 271 aa, Xanthomonas campestris pv
MSSHADSKPWTVPALAQAKRDGRKLVMLTAYDAGFARTFDANGVDLILVGDSLGMVVQGHESTLPVTTADMVYHTAAVARVLERALLVADLSFQADATPERALDAATQLLQAGAEMVKIEGAGHKLDVIRYLVEREIPVCSHLGLTPQSVLRFGGYKVQGRGEAGEQLRRDAQAAVDAGASLIVLECVPTPIAAQISAELRVPTIGIGAGPGCDGQVLVMHDMLGLDSGHRRPKFVKDFLAEGGSVAGAVQAYAQAVRDGSFPDAEHAYAA

SEQ ID NO: 101342 - DNA, 819 bp, Xylella fastidiosa
  CDS (1)..(819)
atgagcatatataccaatagcaaaccttggacggtgcctgctttggcggaggccaagcgaaacggttctaaaatcgtgatgttgactgcttatgatgctgggtttgctcgtattcttgacgcaaacggcgtagacctagtccttgttggcgattcgttgggaatggtggtacagggccatgactcgactcttccggtgagtgtgcatgacatggtgtaccacactgcgtgtgtggctcggggggtacgtcaggcaatgcttgtggttgatttgccatttcaggctgatgcgtcgccggagcgtgcgctagaggctgccactccattactgcgggtgggggcacagatgatcaaaatcgaaggtgctgggcacaagcttgaggtgattagttacttggttgagcgtgagattccggtgtgttcgcacttggggctgactccgcaatcggtactgcgttttggaggttataaggtgcaaggacgtggtgaggaggctggggggcgtttgcgtgccgaggcacgtgcggcggtggaggctggtgctactctcttgctattggagtgtgtgccgtcgcagttggcagcgcagatcactaccgatgtatcggtgccgacgattggtatcggtgccggtgctggttgtgatggccaagtgctggtgctgcatgatctccttggcctagacagtggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 101343 - protein, 272 aa, Xylella fastidiosa
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATPLLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 101344 - DNA, 819 bp, Xylella fastidiosa
  CDS (1)..(819): transl_table=11
atgagcatatataccaatagcaaaccttggacggtgcctgctttggcggaggccaagcgaaacggttctaaaatcgtgatgttgactgcttatgatgctgggtttgctcgtattcttgacgcaaacggcgtagacctaatccttgttggcgattcgttgggaatggtggtacagggccatgactcgactcttccggtgagtgtgcatgacatggtgtaccacactgcgtgtgtggctcggggggtacgtcatgcaatgcttgtggttgatttgccatttcaggctgatgcgtcgccggaacgtgcgctagaggctgccactgcattgctgcgagtgggggcacagatgatcaaaatcgaaggtgctgggcacaagcttgaggtgattagttacttggttgagcgtgagattccggtgtgttcacacttggggctgactccgcaatcggtactgcgttttggaggttataaggtgcaaggacgtggtgaggaggctggggggcgtttgcgtgccgaggcacgtgcggcggtggaggctggggctactctcttgctattggagtgtgtgccgtcgcagttggcagcgcagatcactaccgatgcatcggtgccgacgattggtatcggtgccggtgctggttgtgatggccaagtgctggtgctgcatgatctccttggtctagatagcggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 101345 - protein, 272 aa, Xylella fastidiosa
MSIYTNSKPWTVPALAEAKRNGSKIVMLTAYDAGFARILDANGVDLILVGDSLGMVVQGHDSTLPVSVHDMVYHTACVARGVRHAMLVVDLPFQADASPERALEAATALLRVGAQMIKIEGAGHKLEVISYLVEREIPVCSHLGLTPQSVLRFGGYKVQGRGEEAGGRLRAEARAAVEAGATLLLLECVPSQLAAQITTDASVPTIGIGAGAGCDGQVLVLHDLLGLDSGHPRPKFVKDFLAHGGSVAGAVRAYANAVRDGSFPDVEHTYTS

SEQ ID NO: 101346 - DNA, 939 bp, Saccharomyces cerevisiae
  CDS (1)..(939)
atgaatataatgaaaagacaattatgcacctcctctaagcgatttttttctacagcaaaaaacgttgtcaaatataatacgattcaggatatcaggaacaaatattttactggtacgcctttgtcgatgtgtactgcgtatgacttcattactgcaacatgggttaacaaggctaattgtgatttactcttagtcggagattctttggcgatgacttcattggggtacgatagcacaattacactatccttgaatgagtttaaatatcatgttgcctctgtgtgcagagctgaaggttcttccatggtagtggtagacatgccattcggtacgtttgaatcgggcatatctgatggcttgaagaatgccatagatatcatgaaattggacagtaaagtcacctcagtcaaagttgaagtcggttcttacaccaaagacaaatatgcaatgaaatttattgaagaactgtgctcccggggtatacctgttatggctcatataggactaactccccaaaaagttcattcacttggaggttataaagtgcaaggtagcaaaagtctattacaaatgcaggagctgtatgaaaccgccatgcaactacaaaaaattggctgttggtctatcctgattgaatgtgtcccccataagatggctcagttcataacatctaaactctcagtaccaacaataggtatcggtgcaggtaacggtaccagtggacaagttctagttatatctgaccttctcgggatgcaaggcgattctgtcccaaaatttgtgaagcaagctgtaaatatgacagatattgccactcagggcttgaaggagtacattgcaagtgtagaggataggacatttcctgagagaggtactcatactttcaaagttaaggaggacttatggaatgaattcctctcttcaattaacgaaaagtaa

SEQ ID NO: 101347 - protein, 312 aa, Saccharomyces cerevisiae
MNIMKRQLCTSSKRFFSTAKNVVKYNTIQDIRNKYFTGTPLSMCTAYDFITATWVNKANCDLLLVGDSLAMTSLGYDSTITLSLNEFKYHVASVCRAEGSSMVVVDMPFGTFESGISDGLKNAIDIMKLDSKVTSVKVEVGSYTKDKYAMKFIEELCSRGIPVMAHIGLTPQKVHSLGGYKVQGSKSLLQMQELYETAMQLQKIGCWSILIECVPHKMAQFITSKLSVPTIGIGAGNGTSGQVLVISDLLGMQGDSVPKFVKQAVNMTDIATQGLKEYIASVEDRTFPERGTHTFKVKEDLWNEFLSSINEK

SEQ ID NO: 101348 - DNA, 801 bp, Yersinia pseudotuberculosis
  CDS (1)..(801): transl_table=11
gtgatgaaaaccaccaccatgagccaattacgccaatggaaacaagagaaacgtaaattcgcaacgctgacggcctatgatgccagttttgcccagttatttgctgaacagggtattcaggtgctattggtgggggattcgctcggtatgacgttacaagggttcgattccacgctgccagtgaccgttgccgatgtggcctaccatacccgtgcagtgcgccgtggtgcgcctcattgcctgttattggccgatatgccattcatgagttatgccacgccagaactggcctttacccacgcggcagagctaatgcgggccggagccaatatggtcaaactggaaggtgggagctggctgtgcgataccattcgcatgttggcagagcgcgcggtgccggtttgtgggcatctggggctcacgccacaatcggtgaatattttcggcggctataaagtacagggtcgtgaagaagtggcggccaatcaactgttgcaagatgctattgccctggaacaggcaggggctcaactgttggtactggaatgcgtgccggtagaactggcacagcgggtgaccgaagagttaaccataccggttattggtattggtgcggggaatgtcactgacggtcagattttggttatgcatgatgcactcggtattaccgggggtcatacgccaaaattcagtaaaaactttttagcacacagtgcgggcgatattcgtgccgccattaagctctatattgaagaagttgagggggggatttatcctgctgaagagcatacattccagtaa

SEQ ID NO: 101349 - protein, 266 aa, Yersinia pseudotuberculosis
MMKTTTMSQLRQWKQEKRKFATLTAYDASFAQLFAEQGIQVLLVGDSLGMTLQGFDSTLPVTVADVAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 101350 - DNA, 23 bp, Artificial sequence
  primer
atgaaaccgaccaccatctcctt

SEQ ID NO: 101351 - DNA, 25 bp, Artificial sequence
  primer
ttaatggaaactgtgttcttcgccc

SEQ ID NO: 101352 - protein, 280 aa, Artificial sequence
  Variant (2)..(7): xaa in position 2 to 7 is any amino acid
  Variant (8)..(12): xaa in position 8 to 12 is any or no amino acid
  Variant (18)..(20): xaa in position 18 to 20 is any amino acid
  Variant (22)..(24): xaa in position 22 to 24 is any amino acid
  Variant (26)..(27): xaa in position 26 to 27 is any amino acid
  Variant (28)..(28): xaa in position 28 is any or no amino acid
  Variant (31)..(31): xaa in position 31 is any amino acid
  Variant (40)..(42): xaa in position 40 to 42 is any amino acid
  Variant (43)..(43): xaa in position 43 is any or no amino acid
  Variant (45)..(47): xaa in position 45 to 47 is any amino acid
  Variant (50)..(50): xaa in position 50 is any amino acid
  Variant (54)..(55): xaa in position 54 to 55 is any amino acid
  Variant (57)..(58): xaa in position 57 to 58 is any amino acid
  Variant (60)..(62): xaa in position 60 to 62 is any amino acid
  Variant (64)..(64): xaa in position 64 is any amino acid
  Variant (67)..(71): xaa in position 67 to 71 is any amino acid
  Variant (72)..(76): xaa in position 72 to 76 is any or no amino acid
  Variant (79)..(79): xaa in position 79 is any amino acid
  Variant (84)..(84): xaa in position 84 is any amino acid
  Variant (87)..(91): xaa in position 87 to 91 is any amino acid
  Variant (92)..(92): xaa in position 92 is any or no amino acid
  Variant (94)..(96): xaa in position 94 to 96 is any amino acid
  Variant (98)..(99): xaa in position 98 to 99 is any amino acid
  Variant (102)..(107): xaa in position 102 to 107 is any amino acid
  Variant (108)..(109): xaa in position 108 to 109 is any or no amino acid
  Variant (116)..(120): xaa in position 116 to 120 is any amino acid
  Variant (121)..(126): xaa in position 121 to 126 is any or no amino acid
  Variant (128)..(129): xaa in position 128 to 129 is any amino acid
  Variant (131)..(133): xaa in position 131 to 133 is any amino acid
  Variant (138)..(138): xaa in position 138 is any amino acid
  Variant (147)..(147): xaa in position 147 is any amino acid
  Variant (149)..(151): xaa in position 149 to 151 is any amino acid
  Variant (160)..(160): xaa in position 160 is any amino acid
  Variant (161)..(164): xaa in position 161 to 164 is any or no amino acid
  Variant (166)..(167): xaa in position 166 to 167 is any amino acid
  Variant (169)..(170): xaa in position 169 to 170 is any amino acid
  Variant (173)..(174): xaa in position 173 to 174 is any amino acid
  Variant (176)..(177): xaa in position 176 to 177 is any amino acid
  Variant (180)..(182): xaa in position 180 to 182 is any amino acid
  Variant (187)..(187): xaa in position 187 is any amino acid
  Variant (190)..(191): xaa in position 190 to 191 is any amino acid
  Variant (194)..(195): xaa in position 194 to 195 is any amino acid
  Variant (198)..(199): xaa in position 198 to 199 is any amino acid
  Variant (201)..(201): xaa in position 201 is any amino acid
  Variant (202)..(203): xaa in position 202 to 203 is any or no amino acid
  Variant (206)..(206): xaa in position 206 is any amino acid
  Variant (213)..(216): xaa in position 213 to 216 is any amino acid
  Variant (222)..(223): xaa in position 222 to 223 is any amino acid
  Variant (228)..(232): xaa in position 228 to 232 is any amino acid
  Variant (233)..(238): xaa in position 233 to 238 is any or no amino acid
  Variant (242)..(242): xaa in position 242 is any amino acid
  Variant (244)..(244): xaa in position 244 is any amino acid
  Variant (246)..(249): xaa in position 246 to 249 is any amino acid
  Variant (250)..(256): xaa in position 250 to 256 is any or no amino acid
  Variant (258)..(259): xaa in position 258 to 259 is any amino acid
  Variant (262)..(263): xaa in position 262 to 263 is any amino acid
  Variant (265)..(267): xaa in position 265 to 267 is any amino acid
  Variant (269)..(272): xaa in position 269 to 272 is any amino acid
  Variant (275)..(279): xaa in position 275 to 279 is any amino acid
KXXXXXXXXXXXLTAYDXXXAXXXDXXXVDXILVGDSLGXXXXGXXXTLXVTLXXMXXHXXXVXRGXXXXXXXXXXVVXDMPFXSYXXXXXXAXXXAXXLMXXXXXXXXVKLEGGXXXXXXXXXXXIXXLXXXGIPVXGHLGLTPQXVXXXGGYKVQGRXXXXXAXXLXXDAXXLXXAGXXXLVLEXVPXXLAXXITXXLXXXIPXIGIGAGXXXXGQVLVXXDMLGXXXXXXXXXXXPKFXKXYXXXXXXXXXXXIXXAVXXYXXXVXXXXFPXXXXXF

SEQ ID NO: 101353 - protein, 53 aa, Artificial sequence
  Variant (2)..(18): xaa in position 2 to 18 is any amino acid
  Variant (19)..(19): xaa in position 19 is any or no amino acid
  Variant (21)..(21): xaa in position 21 is Ile or Val
  Variant (25)..(25): xaa in position 25 is Ala, Leu or Val
  Variant (26)..(26): xaa in position 26 is Ala, Gly or Ser
  Variant (27)..(27): xaa in position 27 is any amino acid
  Variant (28)..(28): xaa in position 28 is Ala, Thr or Val
  Variant (29)..(30): xaa in position 29 to 30 is any amino acid
  Variant (32)..(34): xaa in position 32 to 34 is any amino acid
  Variant (36)..(49): xaa in position 36 to 49 is any amino acid
  Variant (51)..(52): xaa in position 51 to 52 is any amino acid
  Variant (53)..(53): xaa in position 53 is Ala, Gly, Ser, Thr or Val
TXXXXXXXXXXXXXXXXXXLXGDSXXXXXXGXXXTXXXXXXXXXXXXXXVXXX

SEQ ID NO: 101354 - protein, 17 aa, Artificial sequence
  Variant (3)..(3): xaa in position 3 is any amino acid
  Variant (4)..(4): xaa in position 4 is Ala, Gly, Ser or Val
  Variant (6)..(6): xaa in position 6 is any amino acid
  Variant (9)..(9): xaa in position 9 is any amino acid
  Variant (12)..(16): xaa in position 12 to 16 is any amino acid
PVXXHXGLXPQXXXXXG

SEQ ID NO: 101355 - protein, 48 aa, Artificial sequence
  Variant (2)..(7): xaa in position 2 to 7 is any amino acid
  Variant (8)..(8): xaa in position 8 is any or no amino acid
  Variant (10)..(15): xaa in position 10 to 15 is any amino acid
  Variant (16)..(16): xaa in position 16 is Ala, Gly or Ser
  Variant (17)..(25): xaa in position 17 to 25 is any amino acid
  Variant (27)..(27): xaa in position 27 is any amino acid
  Variant (32)..(32): xaa in position 32 is Ala or Ser
  Variant (33)..(33): xaa in position 33 is Gly or Ser
  Variant (34)..(35): xaa in position 34 to 35 is any amino acid
  Variant (36)..(36): xaa in position 36 is Cys, Thr or Val
  Variant (37)..(37): xaa in position 37 is any amino acid
  Variant (40)..(40): xaa in position 40 is Ile or Val
  Variant (41)..(41): xaa in position 41 is any amino acid
  Variant (43)..(44): xaa in position 43 to 44 is any amino acid
  Variant (46)..(47): xaa in position 46 to 47 is any amino acid
  Variant (48)..(48): xaa in position 48 is Ala, Gly, Asn, Ser or Thr
GXXXXXXXEXXXXXXXXXXXXXXXXPXIGIGXXXXXXGQXXVXXDXXX

SEQ ID NO: 101356 - protein, 15 aa, Artificial sequence
  Variant (2)..(4): xaa in position 2 to 4 is any amino acid
  Variant (5)..(5): xaa in position 5 is Phe or Tyr
  Variant (6)..(7): xaa in position 6 to 7 is any amino acid
  Variant (8)..(8): xaa in position 8 is Ala, Asp, Glu, Gln or Ser
  Variant (10)..(13): xaa in position 10 to 13 is any amino acid
  Variant (14)..(14): xaa in position 14 is Phe or Tyr
AXXXXXXXVXXXXXP

SEQ ID NO: 101357 - DNA, 2835 bp, Escherichia coli; identical to SEQ ID NO: 740
  CDS (571)..(2712)

SEQ ID NO: 101358 - protein, 713 aa, Escherichia coli; identical to SEQ ID NO: 259

SEQ ID NO: 101359 - DNA, 2220 bp, Hafnia alvei; identical to SEQ ID NO: 288
  CDS (1)..(2220)

SEQ ID NO: 101360 - protein, 739 aa, Hafnia alvei; identical to SEQ ID NO: 289

SEQ ID NO: 101361 - DNA, 2199 bp, Escherichia coli; identical to SEQ ID NO: 290
  CDS (1)..(2199)

SEQ ID NO: 101362 - protein, 732 aa, Escherichia coli; identical to SEQ ID NO: 291

SEQ ID NO: 101363 - DNA, 1850 bp, Bacillus subtilis; identical to SEQ ID NO: 746
  CDS (312)..(1784)

SEQ ID NO: 101364 - protein, 490 aa, Bacillus subtilis; identical to SEQ ID NO: 265

SEQ ID NO: 101365 - DNA, 1449 bp, Bacillus halodurans; identical to SEQ ID NO: 748
  CDS (1)..(1449)

SEQ ID NO: 101366 - protein, 482 aa, Bacillus halodurans; identical to SEQ ID NO: 271

SEQ ID NO: 101367 - DNA, 2196 bp, Sinorhizobium meliloti; identical to SEQ ID NO: 750
  CDS (1)..(2196)

SEQ ID NO: 101368 - protein, 731 aa, Sinorhizobium meliloti; identical to SEQ ID NO: 297

SEQ ID NO: 101369 - DNA, 2196 bp, Escherichia coli; identical to SEQ ID NO: 298
  CDS (1)..(2196)

SEQ ID NO: 101370 - protein, 731 aa, Escherichia coli; identical to SEQ ID NO: 299

SEQ ID NO: 101371 - DNA, 2199 bp, Escherichia coli; identical to SEQ ID NO: 754
  CDS (1)..(2199)

SEQ ID NO: 101372 - protein, 732 aa, Escherichia coli; identical to SEQ ID NO: 301

SEQ ID NO: 101373 - DNA, 1458 bp, Zea mays.; identical to SEQ ID NO: 756
  CDS (1)..(1458)

SEQ ID NO: 101374 - protein, 485 aa, Zea mays.; identical to SEQ ID NO: 263

SEQ ID NO: 101375 - DNA, 2853 bp, Mycobacterium avium subsp. paratuberculosis; identical to SEQ ID NO: 758
  CDS (1)..(2853)

SEQ ID NO: 101376 - protein, 950 aa, Mycobacterium avium subsp. paratuberculosis; identical to SEQ ID NO: 405

SEQ ID NO: 101377 - DNA, 1458 bp, Mycobacterium avium subsp. paratuberculosis; identical to SEQ ID NO: 760
  CDS (1)..(1458)

SEQ ID NO: 101378 - protein, 485 aa, Mycobacterium avium subsp. paratuberculosis; identical to SEQ ID NO: 407

SEQ ID NO: 101379 - DNA, 2100 bp, Lactobacillus johnsonii; identical to SEQ ID NO: 762
  CDS (1)..(2100)

SEQ ID NO: 101380 - protein, 699 aa, Lactobacillus johnsonii; identical to SEQ ID NO: 409

SEQ ID NO: 101381 - DNA, 1380 bp, Listeria innocua; identical to SEQ ID NO: 282
  CDS (1)..(1380)

SEQ ID NO: 101382 - protein, 459 aa, Listeria innocua; identical to SEQ ID NO: 283

SEQ ID NO: 101383 - DNA, 2268 bp, Escherichia coli; identical to SEQ ID NO: 410
  CDS (1)..(2268)

SEQ ID NO: 101384 - protein, 755 aa, Escherichia coli; identical to SEQ ID NO: 411

SEQ ID NO: 101385 - DNA, 1380 bp, Listeria monocytogenes; identical to SEQ ID NO: 284
  CDS (1)..(1380)

SEQ ID NO: 101386 - protein, 459 aa, Listeria monocytogenes; identical to SEQ ID NO: 285

SEQ ID NO: 101387 - DNA, 2307 bp, Yersinia pestis; identical to SEQ ID NO: 302
  CDS (1)..(2307)

SEQ ID NO: 101388 - protein, 768 aa, Yersinia pestis; identical to SEQ ID NO: 303

SEQ ID NO: 101389 - DNA, 2145 bp, Salmonella enterica subsp. enterica serovar Typhi; identical to SEQ ID NO: 304
  CDS (1)..(2145)

SEQ ID NO: 101390 - protein, 714 aa, Salmonella enterica subsp. enterica serovar Typhi; identical to SEQ ID NO: 305

SEQ ID NO: 101391 - DNA, 1467 bp, Nostoc sp. PCC 7120; identical to SEQ ID NO: 774
  CDS (1)..(1467)

SEQ ID NO: 101392 - protein, 488 aa, Nostoc sp. PCC 7120; identical to SEQ ID NO: 287

SEQ ID NO: 101393 - DNA, 2163 bp, Yersinia pestis; identical to SEQ ID NO: 776
  CDS (1)..(2163)

SEQ ID NO: 101394 - protein, 720 aa, Yersinia pestis; identical to SEQ ID NO: 307

SEQ ID NO: 101395 - DNA, 2271 bp, Salmonella enterica subsp. enterica serovar Typhi; identical to SEQ ID NO: 308
  CDS (1)..(2271)

SEQ ID NO: 101396 - protein, 756 aa, Salmonella enterica subsp. enterica serovar Typhi; identical to SEQ ID NO: 309

SEQ ID NO: 101397 - DNA, 2148 bp, Escherichia coli; identical to SEQ ID NO: 780
  CDS (1)..(2148)

SEQ ID NO: 101398 - protein, 715 aa, Escherichia coli; identical to SEQ ID NO: 293

SEQ ID NO: 101399 - DNA, 1548 bp, Pseudomonas aeruginosa; identical to SEQ ID NO: 782
  CDS (1)..(1548)

SEQ ID NO: 101400 - protein, 515 aa, Pseudomonas aeruginosa; identical to SEQ ID NO: 323

SEQ ID NO: 101401 - DNA, 2175 bp, Vibrio parahaemolyticus; identical to SEQ ID NO: 400
  CDS (1)..(2175)

SEQ ID NO: 101402 - protein, 724 aa, Vibrio parahaemolyticus; identical to SEQ ID NO: 401

SEQ ID NO: 101403 - DNA, 1446 bp, Clostridium acetobutylicum; identical to SEQ ID NO: 786
  CDS (1)..(1446)

SEQ ID NO: 101404 - protein, 481 aa, Clostridium acetobutylicum; identical to SEQ ID NO: 277

SEQ ID NO: 101405 - DNA, 1464 bp, Clostridium acetobutylicum; identical to SEQ ID NO: 278
  CDS (1)..(1464)

SEQ ID NO: 101406 - protein, 487 aa, Clostridium acetobutylicum; identical to SEQ ID NO: 279

SEQ ID NO: 101407 - DNA, 2358 bp, Rhodopseudomonas palustris; identical to SEQ ID NO: 402
  CDS (1)..(2358)

SEQ ID NO: 101408 - protein, 785 aa, Rhodopseudomonas palustris; identical to SEQ ID NO: 403

SEQ ID NO: 101409 - DNA, 2256 bp, Pseudomonas aeruginosa; identical to SEQ ID NO: 792
  CDS (1)..(2256)

SEQ ID NO: 101410 - protein, 751 aa, Pseudomonas aeruginosa; identical to SEQ ID NO: 311

SEQ ID NO: 101411 - DNA, 2853 bp, Mycobacterium leprae; identical to SEQ ID NO: 794
  CDS (1)..(2853)

SEQ ID NO: 101412 - protein, 950 aa, Mycobacterium leprae; identical to SEQ ID NO: 319

SEQ ID NO: 101413 - DNA, 2196 bp, Escherichia coli; identical to SEQ ID NO: 796
  CDS (1)..(2196)

SEQ ID NO: 101414 - protein, 731 aa, Escherichia coli; identical to SEQ ID NO: 797

SEQ ID NO: 101415 - DNA, 2196 bp, Lactobacillus sp. (strain 30a); identical to SEQ ID NO: 414
  CDS (1)..(2196)

SEQ ID NO: 101416 - protein, 731 aa, Lactobacillus sp. (strain 30a); identical to SEQ ID NO: 415

SEQ ID NO: 101417 - DNA, 2202 bp, Vibrio cholerae; identical to SEQ ID NO: 312
  CDS (1)..(2202)

SEQ ID NO: 101418 - protein, 733 aa, Vibrio cholerae; identical to SEQ ID NO: 313

SEQ ID NO: 101419 - DNA, 2163 bp, Vibrio cholerae; identical to SEQ ID NO: 314
  CDS (1)..(2163)

SEQ ID NO: 101420 - protein, 720 aa, Vibrio cholerae; identical to SEQ ID NO: 315

SEQ ID NO: 101421 - DNA, 2163 bp, Haemophilus influenzae; identical to SEQ ID NO: 294
  CDS (1)..(2163)

SEQ ID NO: 101422 - protein, 720 aa, Haemophilus influenzae; identical to SEQ ID NO: 295

SEQ ID NO: 101423 - DNA, 2844 bp, Mycobacterium tuberculosis; identical to SEQ ID NO: 806
  CDS (1)..(2844)

SEQ ID NO: 101424 - protein, 947 aa, Mycobacterium tuberculosis; identical to SEQ ID NO: 321

SEQ ID NO: 101425 - DNA, 1476 bp, Streptococcus pneumoniae; identical to SEQ ID NO: 808
  CDS (1)..(1476)

SEQ ID NO: 101426 - protein, 491 aa, Streptococcus pneumoniae; identical to SEQ ID NO: 275

SEQ ID NO: 101427 - DNA, 1476 bp, Bacillus halodurans; identical to SEQ ID NO: 268
  CDS (1)..(1476)

SEQ ID NO: 101428 - protein, 491 aa, Bacillus halodurans; identical to SEQ ID NO: 269

SEQ ID NO: 101429 - DNA, 2349 bp, Sinorhizobium meliloti; identical to SEQ ID NO: 316
  CDS (1)..(2349)

SEQ ID NO: 101430 - protein, 782 aa, Sinorhizobium meliloti; identical to SEQ ID NO: 317

SEQ ID NO: 101431 - DNA, 1476 bp, Streptococcus pneumoniae; identical to SEQ ID NO: 814
  CDS (1)..(1476)

SEQ ID NO: 101432 - protein, 491 aa, Streptococcus pneumoniae; identical to SEQ ID NO: 281

SEQ ID NO: 101433 - DNA, 2307 bp, Photorhabdus luminescens (subsp. laumondii); identical to SEQ ID NO: 816
  CDS (1)..(2307)

SEQ ID NO: 101434 - protein, 768 aa, Photorhabdus luminescens (subsp. laumondii); identical to SEQ ID NO: 399

SEQ ID NO: 101435 - DNA, 1404 bp, Gloeobacter violaceus; identical to SEQ ID NO: 396
  CDS (1)..(1404)

SEQ ID NO: 101436 - protein, 467 aa, Gloeobacter violaceus; identical to SEQ ID NO: 397

SEQ ID NO: 101437 - DNA, 2259 bp, Chromobacterium violaceum; identical to SEQ ID NO: 394
  CDS (1)..(2259)

SEQ ID NO: 101438 - protein, 752 aa, Chromobacterium violaceum; identical to SEQ ID NO: 395

SEQ ID NO: 101439 - DNA, 1251 bp, Chromobacterium violaceum; identical to SEQ ID NO: 822
  CDS (1)..(1251)

SEQ ID NO: 101440 - protein, 416 aa, Chromobacterium violaceum; identical to SEQ ID NO: 393

SEQ ID NO: 101441 - DNA, 2136 bp, Shigella flexneri; identical to SEQ ID NO: 824
  CDS (1)..(2136)

SEQ ID NO: 101442 - protein, 711 aa, Shigella flexneri; identical to SEQ ID NO: 825

SEQ ID NO: 101443 - DNA, 1401 bp, Prochlorococcus marinus (strain MIT 9313); identical to SEQ ID NO: 388
  CDS (1)..(1401)

SEQ ID NO: 101444 - protein, 466 aa, Prochlorococcus marinus (strain MIT 9313); identical to SEQ ID NO: 389

SEQ ID NO: 101445 - DNA, 2271 bp, Bordetella parapertussis; identical to SEQ ID NO: 386
  CDS (1)..(2271)

SEQ ID NO: 101446 - protein, 756 aa, Bordetella parapertussis; identical to SEQ ID NO: 387

SEQ ID NO: 101447 - DNA, 1383 bp, Bacillus cereus; identical to SEQ ID NO: 382
  CDS (1)..(1383)

SEQ ID NO: 101448 - protein, 460 aa, Bacillus cereus; identical to SEQ ID NO: 383

SEQ ID NO: 101449 - DNA, 1422 bp, Bacillus cereus; identical to SEQ ID NO: 832
  CDS (1)..(1422)

SEQ ID NO: 101450 - protein, 473 aa, Bacillus cereus; identical to SEQ ID NO: 381

SEQ ID NO: 101451 - DNA, 1482 bp, Bacillus anthracis; identical to SEQ ID NO: 378
  CDS (1)..(1482)

SEQ ID NO: 101452 - protein, 493 aa, Bacillus anthracis; identical to SEQ ID NO: 379

SEQ ID NO: 101453 - DNA, 1422 bp, Bacillus anthracis; identical to SEQ ID NO: 836
  CDS (1)..(1422)

SEQ ID NO: 101454 - protein, 473 aa, Bacillus anthracis; identical to SEQ ID NO: 377

SEQ ID NO: 101455 - DNA, 2142 bp, Shigella flexneri; identical to SEQ ID NO: 384
  CDS (1)..(2142)

SEQ ID NO: 101456 - protein, 713 aa, Shigella flexneri; identical to SEQ ID NO: 385

SEQ ID NO: 101457 - DNA, 2127 bp, Escherichia coli; identical to SEQ ID NO: 334
  CDS (1)..(2127)

SEQ ID NO: 101458 - protein, 708 aa, Escherichia coli; identical to SEQ ID NO: 335

SEQ ID NO: 101459 - DNA, 1563 bp, Oryza sativa; identical to SEQ ID NO: 842
  CDS (1)..(1563)

SEQ ID NO: 101460 - protein, 520 aa, Oryza sativa; identical to SEQ ID NO: 327

SEQ ID NO: 101461 - DNA, 1641 bp, Oryza sativa; identical to SEQ ID NO: 844
  CDS (1)..(1641)

SEQ ID NO: 101462 - protein, 546 aa, Oryza sativa; identical to SEQ ID NO: 325

SEQ ID NO: 101463 - DNA, 1461 bp, Clostridium tetani; identical to SEQ ID NO: 846
  CDS (1)..(1461)

SEQ ID NO: 101464 - protein, 486 aa, Clostridium tetani; identical to SEQ ID NO: 847

SEQ ID NO: 101465 - DNA, 1416 bp, Clostridium tetani; identical to SEQ ID NO: 372
  CDS (1)..(1416)

SEQ ID NO: 101466 - protein, 471 aa, Clostridium tetani; identical to SEQ ID NO: 373

SEQ ID NO: 101467 - DNA, 2766 bp, Bradyrhizobium japonicum; identical to SEQ ID NO: 370
  CDS (1)..(2766)

SEQ ID NO: 101468 - protein, 921 aa, Bradyrhizobium japonicum; identical to SEQ ID NO: 371

SEQ ID NO: 101469 - DNA, 2517 bp, Bradyrhizobium japonicum; identical to SEQ ID NO: 852
  CDS (1)..(2517)

SEQ ID NO: 101470 - protein, 838 aa, Bradyrhizobium japonicum; identical to SEQ ID NO: 369

SEQ ID NO: 101471 - DNA, 2181 bp, Vibrio vulnificus; identical to SEQ ID NO: 366
  CDS (1)..(2181)

SEQ ID NO: 101472 - protein, 726 aa, Vibrio vulnificus; identical to SEQ ID NO: 367

SEQ ID NO: 101473 - DNA, 1314 bp, Synechococcus elongatus; identical to SEQ ID NO: 856
  CDS (1)..(1314)

SEQ ID NO: 101474 - protein, 437 aa, Synechococcus elongatus; identical to SEQ ID NO: 365

SEQ ID NO: 101475 - DNA, 2163 bp, Shewanella oneidensis; identical to SEQ ID NO: 362
  CDS (1)..(2163)

SEQ ID NO: 101476 - protein, 720 aa, Shewanella oneidensis; identical to SEQ ID NO: 363

SEQ ID NO: 101477 - DNA, 1419 bp, Oceanobacillus iheyensis; identical to SEQ ID NO: 860
  CDS (1)..(1419)

SEQ ID NO: 101478 - protein, 472 aa, Oceanobacillus iheyensis; identical to SEQ ID NO: 361

SEQ ID NO: 101479 - DNA, 2370 bp, Escherichia coli; identical to SEQ ID NO: 862
  CDS (1)..(2370)

SEQ ID NO: 101480 - protein, 789 aa, Escherichia coli; identical to SEQ ID NO: 359

SEQ ID NO: 101481 - DNA, 1488 bp, Thermoanaerobacter tengcongensis; identical to SEQ ID NO: 354
  CDS (1)..(1488)

SEQ ID NO: 101482 - protein, 495 aa, Thermoanaerobacter tengcongensis; identical to SEQ ID NO: 355

SEQ ID NO: 101483 - DNA, 1419 bp, Thermoanaerobacter tengcongensis; identical to SEQ ID NO: 866
  CDS (1)..(1419)

SEQ ID NO: 101484 - protein, 472 aa, Thermoanaerobacter tengcongensis; identical to SEQ ID NO: 353

SEQ ID NO: 101485 - DNA, 2352 bp, Fusobacterium nucleatum; identical to SEQ ID NO: 350
  CDS (1)..(2352)

SEQ ID NO: 101486 - protein, 783 aa, Fusobacterium nucleatum; identical to SEQ ID NO: 351

SEQ ID NO: 101487 - DNA, 1431 bp, Clostridium perfringens; identical to SEQ ID NO: 346
  CDS (1)..(1431)

SEQ ID NO: 101488 - protein, 476 aa, Clostridium perfringens; identical to SEQ ID NO: 347

SEQ ID NO: 101489 - DNA, 1455 bp, Clostridium perfringens; identical to SEQ ID NO: 872
  CDS (1)..(1455)

SEQ ID NO: 101490 - protein, 484 aa, Clostridium perfringens; identical to SEQ ID NO: 345

SEQ ID NO: 101491 - DNA, 2280 bp, Ralstonia solanacearum (Pseudomonas solanacearum); identical to SEQ ID NO: 874
  CDS (1)..(2280)

SEQ ID NO: 101492 - protein, 759 aa, Ralstonia solanacearum (Pseudomonas solanacearum); identical to SEQ ID NO: 349

SEQ ID NO: 101493 - DNA, 2136 bp, Salmonella typhimurium; identical to SEQ ID NO: 342
  CDS (1)..(2136)

SEQ ID NO: 101494 - protein, 711 aa, Salmonella typhimurium; identical to SEQ ID NO: 343

SEQ ID NO: 101495 - DNA, 2199 bp, Salmonella typhimurium; identical to SEQ ID NO: 878
  CDS (1)..(2199)

SEQ ID NO: 101496 - protein, 732 aa, Salmonella typhimurium; identical to SEQ ID NO: 341

SEQ ID NO: 101497 - DNA, 2142 bp, Salmonella typhimurium; identical to SEQ ID NO: 880
  CDS (1)..(2142)

SEQ ID NO: 101498 - protein, 713 aa, Salmonella typhimurium; identical to SEQ ID NO: 339

SEQ ID NO: 101499 - DNA, 2136 bp, Vibrio vulnificus; identical to SEQ ID NO: 882
  CDS (1)..(2136)

SEQ ID NO: 101500 - protein, 711 aa, Vibrio vulnificus; identical to SEQ ID NO: 331

SEQ ID NO: 101501 - DNA, 2163 bp, Pasteurella multocida; identical to SEQ ID NO: 336
  CDS (1)..(2163)

SEQ ID NO: 101502 - protein, 720 aa, Pasteurella multocida; identical to SEQ ID NO: 337

SEQ ID NO: 101503 - DNA, 2139 bp, Moritella japonica; identical to SEQ ID NO: 886
  CDS (1)..(2139)

SEQ ID NO: 101504 - protein, 712 aa, Moritella japonica; identical to SEQ ID NO: 329

SEQ ID NO: 101505 - DNA, 1479 bp, Streptomyces coelicolor; identical to SEQ ID NO: 888
  CDS (1)..(1479)

SEQ ID NO: 101506 - protein, 492 aa, Streptomyces coelicolor; identical to SEQ ID NO: 357

SEQ ID NO: 101507 - DNA, 2130 bp, Eikenella corrodens; identical to SEQ ID NO: 332
  CDS (1)..(2130)

SEQ ID NO: 101508 - protein, 709 aa, Eikenella corrodens; identical to SEQ ID NO: 333

SEQ ID NO: 101509 - DNA, 1443 bp, Bacillus subtilis; identical to SEQ ID NO: 892
  CDS (1)..(1443)

SEQ ID NO: 101510 - protein, 480 aa, Bacillus subtilis; identical to SEQ ID NO: 273

SEQ ID NO: 101511 - DNA, 1452 bp, Synechocystis sp.; identical to SEQ ID NO: 266
  CDS (1)..(1452)

SEQ ID NO: 101512 - protein, 483 aa, Synechocystis sp.; identical to SEQ ID NO: 267

SEQ ID NO: 101513 - DNA, 23 bp, Artificial sequence
  primer
atgaacatcattgccattatggg

SEQ ID NO: 101514 - DNA, 24 bp, Artificial sequence
  primer
ttatcccgccatttttaggactcg

SEQ ID NO: 101515 - protein, 637 aa, Artificial sequence
  Variant (2)..(5): xaa in position 2 to 5 is any amino acid
  Variant (7)..(20): xaa in position 7 to 20 is any amino acid
  Variant (24)..(25): xaa in position 24 to 25 is any amino acid
  Variant (27)..(57): xaa in position 27 to 57 is any amino acid
  Variant (59)..(60): xaa in position 59 to 60 is any amino acid
  Variant (62)..(65): xaa in position 62 to 65 is any amino acid
  Variant (67)..(70): xaa in position 67 to 70 is any amino acid
  Variant (72)..(75): xaa in position 72 to 75 is any amino acid
  Variant (77)..(89): xaa in position 77 to 89 is any amino acid
  Variant (91)..(105): xaa in position 91 to 105 is any amino acid
  Variant (107)..(112): xaa in position 107 to 112 is any amino acid
  Variant (115)..(115): xaa in position 115 is any amino acid
  Variant (119)..(187): xaa in position 119 to 187 is any amino acid
  Variant (190)..(190): xaa in position 190 is any amino acid
  Variant (192)..(214): xaa in position 192 to 214 is any amino acid
  Variant (216)..(216): xaa in position 216 is any amino acid
  Variant (218)..(223): xaa in position 218 to 223 is any amino acid
  Variant (225)..(289): xaa in position 225 to 289 is any amino acid
  Variant (291)..(291): xaa in position 291 is any amino acid
  Variant (294)..(299): xaa in position 294 to 299 is any amino acid
  Variant (301)..(301): xaa in position 301 is any amino acid
  Variant (303)..(304): xaa in position 303 to 304 is any amino acid
  Variant (306)..(332): xaa in position 306 to 332 is any amino acid
  Variant (336)..(336): xaa in position 336 is any amino acid
  Variant (338)..(340): xaa in position 338 to 340 is any amino acid
  Variant (342)..(354): xaa in position 342 to 354 is any amino acid
  Variant (356)..(369): xaa in position 356 to 369 is any amino acid
  Variant (371)..(457): xaa in position 371 to 457 is any amino acid
  Variant (460)..(494): xaa in position 460 to 494 is any amino acid
  Variant (496)..(497): xaa in position 496 to 497 is any amino acid
  Variant (499)..(520): xaa in position 499 to 520 is any amino acid
  Variant (522)..(615): xaa in position 522 to 615 is any amino acid
  Variant (617)..(625): xaa in position 617 to 625 is any amino acid
  Variant (630)..(634): xaa in position 630 to 634 is any amino acid
PXXXXLXXXXXXXXXXXXXXPGHXXGXXXXXXXXXXXXXXXXXXXXXXXXXXXXXXXLXXLXXXXGXXXXAXXXXAXXXXXXXXXXXXXGXXXXXXXXXXXXXXXGXXXXXXRNXHKSXXXXXXXXXXXXXXXXXXXXXXXXXXXXXXXXXXXXXXXXXXXXXXXXXXXXXXXXXXXXXXXXXXXXXTYXGXXXXXXXXXXXXXXXXXXXXXXXDXAXXXXXXFXXXXXXXXXXXXXXXXXXXXXXXXXXXXXXXXXXXXXXXXXXXXXXXXXXXXXXXXXXXXXXXXXSXHKXXXXXXQXSXXHXXXXXXXXXXXXXXXXXXXXXXXXXXXTSPXYXXXAXXXXXXXXXXXXXGXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXDPXXXXXXXXXXXXXXXXXXXXXXXXXXXXXXXXXXXIXXEXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXYPPGXXXXXPGE

SEQ ID NO: 101516 - DNA, 672 bp, Escherichia coli K12
  CDS (1)..(672)
atgatgcagttagttcacttatttatggatgaaatcactatggatcctttgcatgccgtttacctgaccgtaggactgttcgtgattactttttttaatccgggagccaatctctttgtggtagtacaaaccagcctggcttccggtcgacgcgcaggggtgctgaccgggctgggcgtggcgctgggcgatgcattttattccgggttgggtttgtttggtcttgcaacgctaattacgcagtgtgaggagattttttcgcttatcagaatcgtcggcggcgcttatctcttatggtttgcgtggtgcagcatgcgccgccagtcaacaccgcaaatgagcacactacaacaaccgattagcgccccctggtatgtcttttttcgccgcggattaattaccgatctctctaacccgcaaaccgttttattttttatcagtattttctcagtaacattaaatgccgaaacaccaacatgggcacgtttaatggcctgggcggggattgtgctcgcatcaattatctggcgagtttttcttagtcaggcgttttctttgcccgctgtgcgtcgtgcttatgggcgtatgcaacgcgttgccagtcgggttattggtgcaattattggtgtattcgcgctacgcctgatttacgaaggggtgacgcagcggtga

SEQ ID NO: 101517 - protein, 223 aa, Escherichia coli K12
MMQLVHLFMDEITMDPLHAVYLTVGLFVITFFNPGANLFVVVQTSLASGRRAGVLTGLGVALGDAFYSGLGLFGLATLITQCEEIFSLIRIVGGAYLLWFAWCSMRRQSTPQMSTLQQPISAPWYVFFRRGLITDLSNPQTVLFFISIFSVTLNAETPTWARLMAWAGIVLASIIWRVFLSQAFSLPAVRRAYGRMQRVASRVIGAIIGVFALRLIYEGVTQR

SEQ ID NO: 101518 - DNA, 639 bp, Brucella melitensis
  CDS (1)..(639)
atgcatccttacctgtttgaacttgcatcccttatggcaatcttcgtttttgccatcgtttcccccggcgctgatctggccatggtcatccggcaatcgctgctgcatggccgccgcgaggcgatcattacgagtttcggcatcggtacggcgctgatgatgcatgtcacctatacggtgctgggcctcggcctcatcatttccaggtcgatctatctgttcaatatcgtcaaatggtgcggtgtggccaatctggtctatatcggattcaaggcgctgcgtgccggcaccacgaaaatcgaggcgggtccggatttgaaggagccgcgccggaaacagggctttgccaaggctttcggcctcggctttgctgccaatgcgctgaaccccaaggccgttttcttcttcctgtcgattttctccacggtcgttcatgtccatacaccgaccgaagtgaaactcggctatggcgtggtgatggcgaccgcattgatctcgtggtttgtcggcgtcagctttttcatgacgacgccgaaaatgcgcgcggctttctcgcgcgcatcgaaatggatagacaggacgagcggcgtggtattcatcgcgcttgggctgaaacttgccactgaaaaggctatgtag

SEQ ID NO: 101519 - protein, 212 aa, Brucella melitensis
MHPYLFELASLMAIFVFAIVSPGADLAMVIRQSLLHGRREAIITSFGIGTALMMHVTYTVLGLGLIISRSIYLFNIVKWCGVANLVYIGFKALRAGTTKIEAGPDLKEPRRKQGFAKAFGLGFAANALNPKAVFFFLSIFSTVVHVHTPTEVKLGYGVVMATALISWFVGVSFFMTTPKMRAAFSRASKWIDRTSGVVFIALGLKLATEKAM

SEQ ID NO: 101520 - DNA, 633 bp, Salmonella enterica subsp. enterica serovar Typhi
  CDS (1)..(633)
atggagccgtttcatgccgttgtgcttaccgtcagtctgtttgtgttaaccttttttaatcccggcgcgaatctgtttgtggtggtgcaaaccagcctcgcatcaggacgccgggcgggagtcatcaccggcctgggcgtcgccacgggagacgccttttattccgggctggggcttttcggtctggcgacgctcattacgcaatgcgaagcggtattttctcttatcaaaattgtcggcggcgcctatttattatggttcgcctggaacagtattcgccaccaggcgacgccgcaaatgagcacgctccagacgccgattgccgccccgtggacaattttctttcgccggggattaatgaccgatttatccaatccgcaaaccgtactgttttttatcagtattttttccgtaacgcttagcgcagaaacgcccacatgggcaaggttaatggcctgggccggaattgtgctgtcatccgttatctggcgtatttttctcagccaggccttttcgctccccgcagtccgccgcgcttatggacgaatacagcgcattgccagccgtgttatcggcgccattatcgggatgtttgcgctcagacttctctatgaaggcatgacgcaccgctaa

SEQ ID NO: 101521 - protein, 210 aa, Salmonella enterica subsp. enterica serovar Typhi
MEPFHAVVLTVSLFVLTFFNPGANLFVVVQTSLASGRRAGVITGLGVATGDAFYSGLGLFGLATLITQCEAVFSLIKIVGGAYLLWFAWNSIRHQATPQMSTLQTPIAAPWTIFFRRGLMTDLSNPQTVLFFISIFSVTLSAETPTWARLMAWAGIVLSSVIWRIFLSQAFSLPAVRRAYGRIQRIASRVIGAIIGMFALRLLYEGMTHR

SEQ ID NO: 101522 - DNA, 708 bp, Agrobacterium tumefaciens
  CDS (1)..(708)
atggcagaaacacgaaaccgcgttaagcaaccgcattctccagattttacgggtgccgcgatggatttcgttccgagcctgccaacattgatcgccttcaccattgccattctgcttctggcggtgacgccgggtcctgacatgacgctctggatcagccgctcgctgcgcgaaggccgggcggcgggcttcatgacgctggtcggaaccaatatcggcatcaccgtgcatacgatgctggtcgcttttggtgtcgcggctctcatcgtcgcctcgccgaccgccttcatgatcctgaaaaccggtggtgcggcctatctggtctggctcgccatacaggcaatccgcaagggctcggatttcgtgatggtgaaaagcaccggtgaaaaagcacaggcctccctgaaatcggccttgctgaacggcatctgggtcaatctgctgaaccccaaggtcatcatctttttcatgaccttcctgccgcaatttgtcagcgcaaccgatccgcacgtcaccggcaagctgatcttcctcggcatctggtccatcatcgtggcgctgccgatcggcatcggcatcgttgtcaccgccgatattctttccgcctggctgcagcgcaaccggaaagttctgcgcggactcgattatacgatcgccggcgtcttctcgcttttcgcggtcaagattttcttcacgcaaacgcgctga

SEQ ID NO: 101523 - protein, 235 aa, Agrobacterium tumefaciens
MAETRNRVKQPHSPDFTGAAMDFVPSLPTLIAFTIAILLLAVTPGPDMTLWISRSLREGRAAGFMTLVGTNIGITVHTMLVAFGVAALIVASPTAFMILKTGGAAYLVWLAIQAIRKGSDFVMVKSTGEKAQASLKSALLNGIWVNLLNPKVIIFFMTFLPQFVSATDPHVTGKLIFLGIWSIIVALPIGIGIVVTADILSAWLQRNRKVLRGLDYTIAGVFSLFAVKIFFTQTR

SEQ ID NO: 101524 - DNA, 621 bp, Yersinia pestis
  CDS (1)..(621)
atgttgatgctatttctcaccgttgcgtttattcatctggttgctctgattagtccagggcctgacttcttttttgtatcgcaaactgccgccagccgctcacgtggtgaggcgatgatgggcgtgctggggatctcgctaggaattgttatttgggctggggtagcactgatggggttgaatctcatcttgcagaaaatggcttggctgcatcaaattattatggtcggcggtgggatgtatctgtgttggatggggtggcagctattgaaatcggcccgtgctaaacatgatgtcgccgaagaagaggtacaggtcgtcttgcctgcccgtggccgcacgtttatccgtggtctgctgaccaacctgtcgaacccaaaagccgttatctatttcggtagtgtattctcatggtttgtcggtgatgacgtgggtgcaggtgcgcgctgggggttgtttatcctgattgttggcgaaaccttcttatggttcaccgtggtggcctgcgtatttgcgttacccaccatgcgccgtggttatcagcggctttccaagtggattgatgggctggcaggtgtgttatttgccggttttggtatccaactgatattgtcccgctaa

SEQ ID NO: 101525 - protein, 206 aa, Yersinia pestis
MLMLFLTVAFIHLVALISPGPDFFFVSQTAASRSRGEAMMGVLGISLGIVIWAGVALMGLNLILQKMAWLHQIIMVGGGMYLCWMGWQLLKSARAKHDVAEEEVQVVLPARGRTFIRGLLTNLSNPKAVIYFGSVFSWFVGDDVGAGARWGLFILIVGETFLWFTVVACVFALPTMRRGYQRLSKWIDGLAGVLFAGFGIQLILSR

SEQ ID NO: 101526 - DNA, 618 bp, Agrobacterium tumefaciens
  CDS (1)..(618)
atgacgctgacgacccttctagcctatgccactgccctcttcatcgccgctgccattcccggccccggcatgacggcgatcgtggcgcgggcgctgggttcgggcttccgggaaaccttcttcatgggcctcgggctggtgctgggcgatatgatctacctgaccggcgtgatactcggcctcgccttcgtggcacagacctttcaggaggccttcatggtcctgaaattcgctggtgcggcttatcttctctatatcgcctggaagctctggactgccggcctcttgccgcaggacctgaaggcgagaaaaagcaccagcatacctatgtcgtttctgtccggcttactgatcacgctcggtaatccaaaaacgatgctgttttatgtggcgctggtgccgacgctgatcgacatccgcatgatcggcccgtcggaatatgcgacactgctggcgctgaccttcgtcgtgctgatggccgttctcctgccgtacatcctgcttgcggccaaggcacgcaatctcttgaaacggccgagcgccttgacgatcctcaaccgcacggcggcgggcattctggccggaacggcgacgatgatcgcaatccgcagcacctga

SEQ ID NO: 101527 - protein, 205 aa, Agrobacterium tumefaciens
MTLTTLLAYATALFIAAAIPGPGMTAIVARALGSGFRETFFMGLGLVLGDMIYLTGVILGLAFVAQTFQEAFMVLKFAGAAYLLYIAWKLWTAGLLPQDLKARKSTSIPMSFLSGLLITLGNPKTMLFYVALVPTLIDIRMIGPSEYATLLALTFVVLMAVLLPYILLAAKARNLLKRPSALTILNRTAAGILAGTATMIAIRST

SEQ ID NO: 101528 - DNA, 615 bp, Vibrio cholerae
  CDS (1)..(615)
atgacactgacagtgtggttatcgctatttacgatttgtattttaggggcgatgtcgccgggaccgagtttggcaatggtggctaaacacagtttggcagggggacgtaagaacggctttgcggctgcttgggctcatgcgttcgggattggggtgtatgcctttattaccctgatcggattggccgtcgtactgcatcaatctcctgtactgtttaaaaccattagctatgcgggtgccgcctatcttgcctacttgggctggaacgctttgcgttcaaaaggtggggtcgcggctaagttagagtcgggcgagtcggtcagcgtatggcaatcagctagagaagggctactgatttctctgctcagtcctaagattgcgctgttttttatcgcgttgtttagtcaatacgtcgcggtaggctcggatttgaccagtaaggctgcgattgtcatcactcccttagtggttgatggtctttggtatagcttcattactctgattttatcttcgcctcgtttactcgataaattgcgcgcccgcgccgtgctcatcgacaggctgtctggcctggtgctgattgcgttagcgatccgagtgttgtggacggtgtaa

SEQ ID NO: 101529 - protein, 204 aa, Vibrio cholerae
MTLTVWLSLFTICILGAMSPGPSLAMVAKHSLAGGRKNGFAAAWAHAFGIGVYAFITLIGLAVVLHQSPVLFKTISYAGAAYLAYLGWNALRSKGGVAAKLESGESVSVWQSAREGLLISLLSPKIALFFIALFSQYVAVGSDLTSKAAIVITPLVVDGLWYSFITLILSSPRLLDKLRARAVLIDRLSGLVLIALAIRVLWTV

SEQ ID NO: 101530 - DNA, 651 bp, Pseudomonas aeruginosa
  CDS (37)..(651)
attgtgtcgtccattctaccttggagccttccaggcatgacagagttgctagctttcctgaccatcactgtgcttgcggtgatcagccccggcgccgatttcgccatggtctcgcgcaacagcctgctgtattcccgccgcgccggcctgctcaccgcgctgggcatcggcgcgggggtaacggtacatgtcggctacagcatcctcggcgtcggcgtgctggtgcgcgagtcgctggcgctgttcaccgcgctgaagctggcgggcgccgcctacctggtgttcctcggcctgcgcatgctgctggcgcgagaggactcggtggcggaggaggcggcgggcggcgccggggtttcgtcctgggcgatgttgcgcagcggcttcctgaccaatgcgctcaatccgaagacctgcctgttcgtggtcagcctgttcatgcaggtgatcgatccgcataccgcgttgccggcgcaactgggctacggggccttcatcgcgctcgcccacgtggcctggttcggcctggtcgcctgctttctctcgagcccggcggtgcgcggccggctcctgcgtttccgccggcgcatcgaccagttcttcggcgccctgctggtcggtttcggcgtcctgctgggggcgaaaagcccatga

SEQ ID NO: 101531 - protein, 204 aa, Pseudomonas aeruginosa
MTELLAFLTITVLAVISPGADFAMVSRNSLLYSRRAGLLTALGIGAGVTVHVGYSILGVGVLVRESLALFTALKLAGAAYLVFLGLRMLLAREDSVAEEAAGGAGVSSWAMLRSGFLTNALNPKTCLFVVSLFMQVIDPHTALPAQLGYGAFIALAHVAWFGLVACFLSSPAVRGRLLRFRRRIDQFFGALLVGFGVLLGAKSP

SEQ ID NO: 101532 - DNA, 651 bp, Pseudomonas aeruginosa
  CDS (1)..(651)
atgccgaccctggggataaccgatttctggacctacgtgctgggtgtggttttcgtgatcctgttgcccggaccgaactcgttgttcgtcctcgcgacttcggcccagcgtggcgtggcgaccggctaccgggccgcctgcggcgtgttcctcggcgacgcggtgctgatgctgctgtcggcccttggcgtggcgtccctgctgaaggccgagccgatgctgttcatcggcctgaagtacctcggtgcggcctacctgttctatctcggcgtcggcatgctgcggggcgcctggcgcaagctgcgcaatcccgaagcgacggcggggcaggccgaacaggtggatgtccaccagcggttccgccaggcgctgctgctcagcctgtcgaatcccaaggcgatcctgttcttcatctccttcttcatccagttcgtcgatcccggctatgcctatccggggctgtcgttcctggtgctggcggtgatcctggaactggtcagcgccctttacctgagcttcctgattttcaccggtgtgcggctggcggcctggttccgccggcggcaacggttggctgccggcgccacttcgggcgtcggcgccctgttcgtcggctttggtgtgaagctggccaccgcaaccctgtcctga

SEQ ID NO: 101533 - protein, 216 aa, Pseudomonas aeruginosa
MPTLGITDFWTYVLGVVFVILLPGPNSLFVLATSAQRGVATGYRAACGVFLGDAVLMLLSALGVASLLKAEPMLFIGLKYLGAAYLFYLGVGMLRGAWRKLRNPEATAGQAEQVDVHQRFRQALLLSLSNPKAILFFISFFIQFVDPGYAYPGLSFLVLAVILELVSALYLSFLIFTGVRLAAWFRRRQRLAAGATSGVGALFVGFGVKLATATLS

SEQ ID NO: 101534 - DNA, 642 bp, Xylella fastidiosa
  CDS (1)..(642)
atgaattttcatcatcacttcttgcaagagaacgcagccatgcatggtctctctatttatttcatactgaccgtgctgatgtttagcatcagtccggggccagccatgatgtttgtgcttcagcaatcccagaagaacggggttaaaactggtctggctgcagtgcttgggactgagattggcgtatttatttacgtcatcctcaccgcattgggtatcagtactgttttaaaagaatacccatccatttataccggcctgcaagggataggtgcggcctatctgctttacatcgcctacctcagctggccccgtcagaatgcttcaaaccagactcctacagcgtcccgttcaagttacacaggcaccttcatacaaggagtgctgattaacctgacgaatcccaagatcgttttgttcttcctcagtctgatccctcaattcgtcccacgagatagcaatgccatgacctttatggtgtacgggttgatcttcaacacgagcggcctcttagtgaacttctctgtcgctcttctggcagacagggtcaatcgtatgcttcggagcgtcacatggtttaactacgtgccgccgattctctttattagcatcgctgttctctcaatgaaggcacgtctctaa

SEQ ID NO: 101535 - protein, 213 aa, Xylella fastidiosa
MNFHHHFLQENAAMHGLSIYFILTVLMFSISPGPAMMFVLQQSQKNGVKTGLAAVLGTEIGVFIYVILTALGISTVLKEYPSIYTGLQGIGAAYLLYIAYLSWPRQNASNQTPTASRSSYTGTFIQGVLINLTNPKIVLFFLSLIPQFVPRDSNAMTFMVYGLIFNTSGLLVNFSVALLADRVNRMLRSVTWFNYVPPILFISIAVLSMKARL

SEQ ID NO: 101536 - DNA, 621 bp, Pseudomonas aeruginosa
  CDS (1)..(621)
atgttcgccgcgttcgtccttgtcgccagtacccatttcgccgccctgctgtcgccggggccggacttcttcctgttggtgcgcgccgccctgctgcgcggccggcgccaggccgacggggtggccgccggcatcgccctggccaacctcctgagcatgctgctggtgctcggcctgttggccagcgtgccggactcggcgcacagcgccttgcgctggctgcaggcgctcggcggactgtacttcctctggctggcgggccaggcgctgcttgcgcagaggcgactggaaatgccggcgcagcgcgacgtcccgtcccgcggcggctatctgcgcgggctgcgcgacggcctgctggcgagcagcctgaatcccaagctgccgatcttctatgcggggctgttcggcgtgctggcgcgcttcagcctgccgggctgggcgctggccctgtgcctggcgtggatgagcctggcggtgctgtgctgggacatggcgctggtgcgcctgctggacaggccgcgctggcgcggctggttgcaacggcgggtaggtgcgctggaccggctgtgcggcgtcctgctgctggcgctgggcggctggctggtgctggccgccctctga

SEQ ID NO: 101537 - protein, 206 aa, Pseudomonas aeruginosa
MFAAFVLVASTHFAALLSPGPDFFLLVRAALLRGRRQADGVAAGIALANLLSMLLVLGLLASVPDSAHSALRWLQALGGLYFLWLAGQALLAQRRLEMPAQRDVPSRGGYLRGLRDGLLASSLNPKLPIFYAGLFGVLARFSLPGWALALCLAWMSLAVLCWDMALVRLLDRPRWRGWLQRRVGALDRLCGVLLLALGGWLVLAAL

SEQ ID NO: 101538 - DNA, 633 bp, Bacillus halodurans
  CDS (1)..(633)
atgttcgttgaggtattcatcgtcgggctgttagcaggaatgtctcctggcccagacttctttatcgtcatgaaaaacagcctagggtttggagcgagagttggtatcctaacttctttagggattgcttctgccctaatcgttcatattacatatacagtactgggatttgcttttttaattgaaacatatcctgctcttttttttacgattcaactattaggagctgcttatttaatttggttaggttttcatgccatacgctcatctccccctaaaaaggaagaagctgaaatcgaagaaacacaaccaatccaatcaacaaaagatagtaaatcatccatacaaggtttcaaagaagggtttattactaaccttttaaatcctaaagctgctctcttttttttaagtattttttcacaatttataacaccgcaaacggctgattgggtgaggtggatgtatggattagaagtggtggtggcagtgggattatggttttcctttttggccattttcatctcctataagcatttcagacgtttttatcaaacacactcttactggtttgatagatttctaggggcagctttgctatttttcgccattcgaattatcatcggagctttttaa

SEQ ID NO: 101539 - protein, 210 aa, Bacillus halodurans
MFVEVFIVGLLAGMSPGPDFFIVMKNSLGFGARVGILTSLGIASALIVHITYTVLGFAFLIETYPALFFTIQLLGAAYLIWLGFHAIRSSPPKKEEAEIEETQPIQSTKDSKSSIQGFKEGFITNLLNPKAALFFLSIFSQFITPQTADWVRWMYGLEVVVAVGLWFSFLAIFISYKHFRRFYQTHSYWFDRFLGAALLFFAIRIIIGAF

SEQ ID NO: 101540 - DNA, 633 bp, Agrobacterium tumefaciens
  CDS (1)..(633)
atgccgtcttttgaactgctgacagcctttttcatcaccaccgccctgtttgcctacattcccggcccagccatgctttatgcggcggcgcagactatggcgcgtggccggtttgccgggctgatggcggtgctcggcatccatgtcggctgctattttcacattttcgcggcggctgcgggcctctcggtattgtttcaggcggtgccctggctttaccttgcagtgaagctctgcggcgcgctttatctcatctggcttgggttttcgatgctgcgcagcaaactggaaggcgaggcggtcaatctgaccatcgagccgaaatcggcccgccgcgccttcatcgacagcatcatcgttgatgtgctcaacccgaagaccgcgctgttctttctggccttcctgccgcaattcgtcgacccggcggcggcctttcccgtctggctacagttcctgatcctcggcattgccgtcaatttcatcttctcctccgccgatctcgtcggcgtgcttctggcgggcgccatggtccggcgtctgaaacggtccagcgccgtgcaggctctcgcccgacgtgtcgccggaacggtactgatggggcttggtgtccatctggctttccagaaaagctga

SEQ ID NO: 101541 - protein, 210 aa, Agrobacterium tumefaciens
MPSFELLTAFFITTALFAYIPGPAMLYAAAQTMARGRFAGLMAVLGIHVGCYFHIFAAAAGLSVLFQAVPWLYLAVKLCGALYLIWLGFSMLRSKLEGEAVNLTIEPKSARRAFIDSIIVDVLNPKTALFFLAFLPQFVDPAAAFPVWLQFLILGIAVNFIFSSADLVGVLLAGAMVRRLKRSSAVQALARRVAGTVLMGLGVHLAFQKS

SEQ ID NO: 101542 - DNA, 624 bp, Bacillus halodurans
  CDS (1)..(624)
atggatcttaccagtcttttgtcgttcttaggtgtggcggttcttctgacgcttatgcctggaccagacatcttatttgtcttagcccaaagtatgtcgcaaaatcgccaagcgggcattgtcacagcgctcggactttgtacaggtctgctcgtacacattacagcagctgttgttggtatatcagcgctcatttatcagtctgctctcgcctttactgtcgtaaaatacgcaggagctgcatatttgctttatttagcatggaaggcgtttcaggaaaagggagaaggtctttcgattgacaagcaaaccacccttgcctacggagccctttataagaaaggcattattatgaatgtgttaaatccaaaagtgtccttgttttttctcgccttgcttccccaatttgtaaacagcggggcaggatctgcaccttggcaaatgcttcttttaggggttgtgtttctcattcaagcattcattattttttcattggttagttggtttgcggaaaaggtagggcagctcctcatgcgttcttcatttataaaaaatcaaatgcatcgtataaaaggcgggttactcgcgcttattggtcttcaagtggcctttagcaaaaattaa

SEQ ID NO: 101543 - protein, 207 aa, Bacillus halodurans
MDLTSLLSFLGVAVLLTLMPGPDILFVLAQSMSQNRQAGIVTALGLCTGLLVHITAAVVGISALIYQSALAFTVVKYAGAAYLLYLAWKAFQEKGEGLSIDKQTTLAYGALYKKGIIMNVLNPKVSLFFLALLPQFVNSGAGSAPWQMLLLGVVFLIQAFIIFSLVSWFAEKVGQLLMRSSFIKNQMHRIKGGLLALIGLQVAFSKN

SEQ ID NO: 101544 - DNA, 633 bp, Haemophilus influenzae
  CDS (1)..(633)
atgatgctaaatttaatcattgtgcatttatttggattaatgacgccagggcctgatttcttttatgtaagtcgaatggcggcaagtaactctcgtcgtaatacagtttgtggcattttaggcataacgcttggcatcgccttttggggaatgctttctatgttgggattggcggtgttgttcgttaccattccagcattacatggcgttattatgttgctaggtggtagttacctagcatatctcggttttttaatggctcgcagtaaaaaatacgctaaatttgaatcgcactctgatactgaatttaatcaacaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttgcagtgattgtggtagaaacattttgttatttttatgtgatttcattgattttttcacgtaatattgccaagcgtttatacagtcaatacagccgttatattgataatatggcaggtattgtatttttattttttggttgtgtgcttgtttataacggcatcaacgaaataattcattaa

SEQ ID NO: 101545 - protein, 210 aa, Haemophilus influenzae
MMLNLIIVHLFGLMTPGPDFFYVSRMAASNSRRNTVCGILGITLGIAFWGMLSMLGLAVLFVTIPALHGVIMLLGGSYLAYLGFLMARSKKYAKFESHSDTEFNQQTTIKKEILKGLLVNLSNAKVVVYFSSVMSLVLVNITEMWQIILAFAVIVVETFCYFYVISLIFSRNIAKRLYSQYSRYIDNMAGIVFLFFGCVLVYNGINEIIH

SEQ ID NO: 101546 - DNA, 639 bp, Escherichia coli
  CDS (1)..(639)
atgttcgctgaatacggggttctgaattactggacctatctggttggggccatttttattgtgttggtgccagggccaaataccctgtttgtactcaaaaatagcgtcagtagcggtatgaaaggcggttatcttgcggcctgcggtgtatttattggcgatgcggtattgatgtttctggcatgggctggagtggcgacattaattaagaccaccccgatattattcaacattgtacgttatcttggtgcgttttatttgctctatctggggagtaaaattctttacgcgaccctgaagggtaaaaatagcgaggccaaatccgatgagccccaatacggtgctatttttaaacgcgcgttaattttgagcctgactaatccgaaagccattttgttctatgtgtcgtttttcgtacagtttatcgatgttaatgccccacatacgggaatttcattctttattctggcggcgacgctggaactggtgagtttctgctatttgagcttcctgattatatctggtgcttttgtcacgcagtacatacgtaccaaaaagaaactggctaaagttggcaactcactgattggtttgatgttcgtgggtttcgctgcccgactggcgacgctgcaatcctga

SEQ ID NO: 101547 - protein, 212 aa, Escherichia coli
MFAEYGVLNYWTYLVGAIFIVLVPGPNTLFVLKNSVSSGMKGGYLAACGVFIGDAVLMFLAWAGVATLIKTTPILFNIVRYLGAFYLLYLGSKILYATLKGKNSEAKSDEPQYGAIFKRALILSLTNPKAILFYVSFFVQFIDVNAPHTGISFFILAATLELVSFCYLSFLIISGAFVTQYIRTKKKLAKVGNSLIGLMFVGFAARLATLQS

SEQ ID NO: 101548 - DNA, 633 bp, Bacillus subtilis
  CDS (1)..(633)
atgcacagcttactcgcatacataccgatcgctgccatgatggttatcataccgggggcagatacgatgcttgtgatgaaaaatacgcttaggtatggtccgaaagccggccgttataacattctcggattggcgacaggactttccttttggacggtgattgccattttaggattatcagtggtaatcgcaaagtcagtgattcttttcacaacgatcaaatatttgggagcggcatacttaatttatttaggtgtaaaaagtttttttgctaaaagtatgttttcgttagatgacatgcaatcccaagcaaaaaatatggcaagttctccgaaacgttattataaaacttcctttatgcagggatcactcagtaacattctcaatcctaaaactgttttggtgtatgttacaatcatgccccaatttatcaatttgaacggaaatataaaccagcagctcatcattttagcttcaatcctaaccttattagcggtgttgtggttcctgtttcttgtttatattattgattacgcaaaaaaatggatgaaaaactcgaagttccagaaagtgtttcaaaaaattaccggaataatattagtaggtttcggcatcaaaactggtttgagttaa

SEQ ID NO: 101549 - protein, 210 aa, Bacillus subtilis
MHSLLAYIPIAAMMVIIPGADTMLVMKNTLRYGPKAGRYNILGLATGLSFWTVIAILGLSVVIAKSVILFTTIKYLGAAYLIYLGVKSFFAKSMFSLDDMQSQAKNMASSPKRYYKTSFMQGSLSNILNPKTVLVYVTIMPQFINLNGNINQQLIILASILTLLAVLWFLFLVYIIDYAKKWMKNSKFQKVFQKITGIILVGFGIKTGLS

SEQ ID NO: 101550 - DNA, 669 bp, Vibrio cholerae
  CDS (1)..(669)
atgaacgaaatgtccattttagccaccttagccggtgtgcattttattgccttattaagcccggggcctgatgtcgccttagtggtgcaaaacgctacacagcacgggcgtaaaactggcgtgatgatcgcgttaggtttgtcgtgcggcattttagtccatttgattttgagcctgtccggcattagctacttagtcaaacagcagccaatgctgtttaacctgttacaactggccggcggcagctacttgctttatttaggggccggcgctttgcaatcagtgatggcgcaaaaaaacgctagcacaccgacgcacagccctgcgccctccattctcggcaaccgccgtcaagccttcacaaaaggcatgatgaccaatctcttgaatcccaaagctctcgtgttttttgtcagcctgttatctagcctgatcccagccagcatgtctgtgtctggcaaggtgagtgccgctgcgattttggttggcttatccctaacttggttctcctgtttagcttggctgcttaccacgtctgccatgcaacaacgcatgcagcgcattacgcgatccgtcgatagcatatgcgctgcggtgtttatcttggccggtggcgtgattttatggcaagcaagccgcgctatagcacaaaccttcggatggctatga

SEQ ID NO: 101551 - protein, 222 aa, Vibrio cholerae
MNEMSILATLAGVHFIALLSPGPDVALVVQNATQHGRKTGVMIALGLSCGILVHLILSLSGISYLVKQQPMLFNLLQLAGGSYLLYLGAGALQSVMAQKNASTPTHSPAPSILGNRRQAFTKGMMTNLLNPKALVFFVSLLSSLIPASMSVSGKVSAAAILVGLSLTWFSCLAWLLTTSAMQQRMQRITRSVDSICAAVFILAGGVILWQASRAIAQTFGWL

SEQ ID NO: 101552 - DNA, 651 bp, Pseudomonas aeruginosa
  CDS (1)..(651)
atgccgaccctggggataaccgatttctggacctacgtgctgggtgtggttttcgtgatcctgttgcccggaccgaactcgttgttcgtcctcgcgacttcggcccagcgtggcgtggcgaccggctaccgggccgcctgcggcgtgttcctcggcgacgcggtgctgatgctgctgtcggcccttggcgtggcgtccctgctgaaggccgagccgatgctgttcatcggcctgaagtacctcggtgcggcctacctgttctatctcggcgtcggcatgctgcggggcgcctggcgcaagctgcgcaatcccgaagcgacggcggcgcaggccgaacaggtggatgtccaccagccgttccgcaaggcgctgctgctcagcctgtcgaatcccaaggcgatcctgttcttcatctccttcttcatccagttcgtcgatcccggctatgcctatccggggctgtcgttcctggtgctggcggtgatcctggaactggtcagcgccctttacctgagcttcctgattttcaccggtgtgcggctggcggcctggttccgccggcggcaacggttggctgccggcgccacttcgggcgtcggcgccctgttcgtcggctttggtgtgaagctggccaccgcaaccctgtcctga

SEQ ID NO: 101553 - protein, 216 aa, Pseudomonas aeruginosa
MPTLGITDFWTYVLGVVFVILLPGPNSLFVLATSAQRGVATGYRAACGVFLGDAVLMLLSALGVASLLKAEPMLFIGLKYLGAAYLFYLGVGMLRGAWRKLRNPEATAAQAEQVDVHQPFRKALLLSLSNPKAILFFISFFIQFVDPGYAYPGLSFLVLAVILELVSALYLSFLIFTGVRLAAWFRRRQRLAAGATSGVGALFVGFGVKLATATLS

SEQ ID NO: 101554 - DNA, 615 bp, Pseudomonas aeruginosa
  CDS (1)..(615)
atgctggaaacctcgctcttcgtagccaccctcgccaccctgggcatgctctcgcccggcccggacttcttcctcatcatccgcaacgcggcgcgctaccagcgctcggcggcgatgatgacctcgctgggggtgatcctcggcgtggccacccacatggcctactgcgtcgccggcctggcggtgctgatcaccaccacgccgtggctgttcaacgcgctgaagtacaccggcgcggtctacctgatctggatcggcatccaggccctgcgctcgcgcggcggcggcacgctcgacctggcggtcggcggcgtgcagcgcgtcggccactggagcgcgttcctccagggctacctgtgcaacctgctcaaccccaaggccacgctgttcttcctcgccgtgttcacccaggtgctgagcctggactccagcttcgccgagaagctctggtacgccggcatcatcgtcggcctcgccgtactctggtggccgctgctggtggtgctgatccagagcgcggtggtgcgccgcagcctggccagggcccagggggtggtggacaagctgctcggcggcctgctgatcgccctcggggtcaaggtcgccctgagttag

SEQ ID NO: 101555 - protein, 204 aa, Pseudomonas aeruginosa
MLETSLFVATLATLGMLSPGPDFFLIIRNAARYQRSAAMMTSLGVILGVATHMAYCVAGLAVLITTTPWLFNALKYTGAVYLIWIGIQALRSRGGGTLDLAVGGVQRVGHWSAFLQGYLCNLLNPKATLFFLAVFTQVLSLDSSFAEKLWYAGIIVGLAVLWWPLLVVLIQSAVVRRSLARAQGVVDKLLGGLLIALGVKVALS

SEQ ID NO: 101556 - DNA, 642 bp, Pseudomonas aeruginosa
  CDS (1)..(642)
atgcaggaattgtctgtcttgctgaccctggcggcggtgttcgccgtcgccctggtcagccccggtcccgatgtcgccctggtggtgcgcacgtccctgcaccaggggcggcgggccggcctggccagcgcgctggggctggcctgcgggattctcctgcataccaccctggtgctgaccggcgtgtcgctgctgctcagccgtacgcctgtgctgttcgccatcctgcaggcgctcggcgcgctgtacctggcctggctcggcgtcggcgcgctgcgtgcctggctgcggcgcggcgacggccagccgggccggctcgacggggcgctgccgccgtcgcccctggggccctggctgcgcggggtggcgaccaatctgttcaatcccaaggcgctggtgttcttcatcgccttgctcggcagcctgattcccgcgcagatgtcgctcggcggcaagctggcggtggcggcgctgctgttcggcatgggcgcctgctggttcggcctgctcagcctgacccttacccgcccggccctgcaggcccgcctgttgcgcgcggtgccctggctggacgcggcctgcggggtggtgttcctgctggtggcggcggcgatcctcgagcatctcgtccgctctgcctga

SEQ ID NO: 101557 - protein, 213 aa, Pseudomonas aeruginosa
MQELSVLLTLAAVFAVALVSPGPDVALVVRTSLHQGRRAGLASALGLACGILLHTTLVLTGVSLLLSRTPVLFAILQALGALYLAWLGVGALRAWLRRGDGQPGRLDGALPPSPLGPWLRGVATNLFNPKALVFFIALLGSLIPAQMSLGGKLAVAALLFGMGACWFGLLSLTLTRPALQARLLRAVPWLDAACGVVFLLVAAAILEHLVRSA

SEQ ID NO: 101558 - DNA, 822 bp, Agrobacterium tumefaciens
  CDS (1)..(822)
atgggcgccgcggttttgagcagtggcggcctcttcgacaaagtatgtcgaggaggtcgcaccgctacgagcagccacccgttcgtccgctggatgacagggcggcttgatcttcgaagattgagcttgatacctcctgattttggtggcttgctcgacacattagacaagggagactcaatcatgccgctggagaactggctggccttcgtggccgcatccgccatcatgctcgccattccgggaccgacgatcctgctggtgatttcttatgcgcttggccatggtcgcaaggcgagcacggcgacggtgacgggcgtggcgctcggtgatttcaccgccatgacggcctcgatgctggggcttggcgcgctgcttgccacgtcggctgcacttttcaccggcctgaaatggatcggtgctgcttacctcatctatctcggcatcaagctgtggcgttcgccggttggtggcgaaggcgcggatggccaaggcgtgacgggccgtgaaaggccgctcaaaatcttcctgcatgcctatatcgtcacggcgctgaaccccaagagcatcgtgttcttcgtggccttcctgccgcagtttctggtgccgacattgccgttttggccgcaggtgctgattttcgaagcgacgttcctggtgcttgccaccgtgaatgcggcgctttatggacttctggcaagtgccgcccgtaacacgatccgcaagccgaaggttcagcgcatcgtcaaccgcacgggcggcggtctcctgattggcgccggtctcattgcctttggctggaagagggcggtttcggcgtga

SEQ ID NO: 101559 - protein, 273 aa, Agrobacterium tumefaciens
MGAAVLSSGGLFDKVCRGGRTATSSHPFVRWMTGRLDLRRLSLIPPDFGGLLDTLDKGDSIMPLENWLAFVAASAIMLAIPGPTILLVISYALGHGRKASTATVTGVALGDFTAMTASMLGLGALLATSAALFTGLKWIGAAYLIYLGIKLWRSPVGGEGADGQGVTGRERPLKIFLHAYIVTALNPKSIVFFVAFLPQFLVPTLPFWPQVLIFEATFLVLATVNAALYGLLASAARNTIRKPKVQRIVNRTGGGLLIGAGLIAFGWKRAVSA

SEQ ID NO: 101560 - DNA, 639 bp, Vibrio cholerae
  CDS (1)..(639)
atggttatccagaatttcgaagctttttttatcgctattactattttgactttaacaccggggctagatactgctttggtgatccgtaacacttcgcgggctgggtttgccgatggatgcacgaccagcttgggtatctgttttggcttattcgttcacgccactttttctgctattggtatctctgcgattcttgctcaatcggctgagctatttcaaatcgttaaaatggtgggagcggcttatctgatttggttgggtatttcgagcctacgatcattaatgaaaacagggcagggcattgaggttgctagcctagctcatgcacaatttcgcttaacccgatcgctgcgtgaaggtttcctctcgaatgtgctgaacccgaaaactgccgtcttttacttagcttttctgcctcaatttattaatcctgactattcaccgttagcgcaatctttgctgatggcgttgattcattttgcgattgcgatggtatggcaatgtggtttagccggtgctttgagtagcgctaaaaaccttctgaaaaacgcttcttttatgcgttggatggaaggtacaacgggagttgttttggtcgcattaggtatcaaactgctcttagagaaacctcaagcctag

SEQ ID NO: 101561 - protein, 212 aa, Vibrio cholerae
MVIQNFEAFFIAITILTLTPGLDTALVIRNTSRAGFADGCTTSLGICFGLFVHATFSAIGISAILAQSAELFQIVKMVGAAYLIWLGISSLRSLMKTGQGIEVASLAHAQFRLTRSLREGFLSNVLNPKTAVFYLAFLPQFINPDYSPLAQSLLMALIHFAIAMVWQCGLAGALSSAKNLLKNASFMRWMEGTTGVVLVALGIKLLLEKPQA

SEQ ID NO: 101562 - DNA, 633 bp, Pseudomonas aeruginosa
  CDS (1)..(633)
atggacacgagcgctttcctgattgccctggcggtggtttacctggtccccggaccggacatgctcctgctgttccagaccggcgcccggcagggccgtcgcgcggcgctggtcaccgccctcggcctggccctggctcgggcctgccatgtgctgatggccgcgaccgggctggcgctgctgttccgtaccgctccctggaccttcgacctggtgcgtctgctcggcgccgtctacctcgcctggcttggcctgcagatgctgcgcggtggcggactggccttgccgaccagcgacgcgggctccgcgccggtggtccctcacgccgaccgccgggccttgctgcgcggactcctgaccaacctgctgaaccccaaggccctgctgttctgttcggtgctgctgccgcagttcgtcagtcccgaggccggttcgctggccgtccagttcgccgcgctcggtacggtcctggttctggttggcctggccttcgactgcgcctatgcgctggccggtggccgcctgggccgctggctggcgtcccggccgcgggcacagcgcctgcagcagtggggcttcggtgggttgttgatagggttcggggtaaggctggcgctgctgcgccagctctga

SEQ ID NO: 101563 - protein, 210 aa, Pseudomonas aeruginosa
MDTSAFLIALAVVYLVPGPDMLLLFQTGARQGRRAALVTALGLALARACHVLMAATGLALLFRTAPWTFDLVRLLGAVYLAWLGLQMLRGGGLALPTSDAGSAPVVPHADRRALLRGLLTNLLNPKALLFCSVLLPQFVSPEAGSLAVQFAALGTVLVLVGLAFDCAYALAGGRLGRWLASRPRAQRLQQWGFGGLLIGFGVRLALLRQL

SEQ ID NO: 101564 - DNA, 627 bp, Bacillus halodurans
  CDS (1)..(627)
atgtttgaagcatcaacatttttgctatttatgggttcagcgattatgttaattatcattcctggaccggacttagtatttacgatcacacaaggaatgacaaatgggagaaaagctggagtgattacggctatggggctaagtttagggaacatcgtacacactttagcagcagtattaggtttatcgcttattatacaaacgtcagttgttgtatttaccatttttaaattagcaggtgcgatgtatttattttatcttgcgtataaagctctaaagcatcgaaaggaagaaatccgagttaattctgaaaaaaccaatgatttaaaggggctttttcttcgagggttgataatgaatgtcttaaatccaaaagttgcgattttttacctcaccttccttccgcaatttgtgaattatcaatcggcgaacatttctctacaactatgtattttaggattaatttttattattatgacagccattatttttagcatattcggttatttctcaggcacgtttcgagatcgattattgaagaattcacgcttcaatgaatatatgaacatcgcagcaacaattatcttcataggattagggctgaaattaatgacgacccagttatga

SEQ ID NO: 101565 - protein, 208 aa, Bacillus halodurans
MFEASTFLLFMGSAIMLIIIPGPDLVFTITQGMTNGRKAGVITAMGLSLGNIVHTLAAVLGLSLIIQTSVVVFTIFKLAGAMYLFYLAYKALKHRKEEIRVNSEKTNDLKGLFLRGLIMNVLNPKVAIFYLTFLPQFVNYQSANISLQLCILGLIFIIMTAIIFSIFGYFSGTFRDRLLKNSRFNEYMNIAATIIFIGLGLKLMTTQL

SEQ ID NO: 101566 - DNA, 627 bp, Caulobacter crescentus
  CDS (1)..(627)
atgaccacgcctgaggccctgatcgccttcaccctggccgcaggtctcttgaccctgacgccgggcctggacaccgcgctggtgatccgcacggccgccgccgaaggcccgcgtcgcgccgccggcgcggcgatcgggatcggactgggatgtctgatctggggcgcggccgcctcgttcggagtcggcgccctgctgaccgcgtcccaaaccgcctacacggtgctgaaatgggtcggcgcgctttatctggcctggacgggcctgcggatgatcctgaagccgcgcgaggcgtttgagcccggcgagaccagggccgtggacgcaggtccgatggcggcgctgcgccggggtctgctgaccaacctgcttaatcccaaggtcgggatcttctacgtctcgtttctgccccagttcatgccggtcggcgttgatccggcgcgctttggccttctgctgacgacgatccatgtcgtggagggcctgttgtggttcgcactcttgatcgcggccaccgtcccgatcgcaggacttttgcgactgccgggggtggtccgttggctggaccggaccaccggcctggtgttcgtggcgttcggactgcgcctggcgctggaccggcgctag

SEQ ID NO: 101567 - protein, 208 aa, Caulobacter crescentus
MTTPEALIAFTLAAGLLTLTPGLDTALVIRTAAAEGPRRAAGAAIGIGLGCLIWGAAASFGVGALLTASQTAYTVLKWVGALYLAWTGLRMILKPREAFEPGETRAVDAGPMAALRRGLLTNLLNPKVGIFYVSFLPQFMPVGVDPARFGLLLTTIHVVEGLLWFALLIAATVPIAGLLRLPGVVRWLDRTTGLVFVAFGLRLALDRR

SEQ ID NO: 101568 - DNA, 639 bp, Caulobacter crescentus
  CDS (1)..(639)
atgccgcacgccgcctggcccgtcgatcccgccgcgatcgcgccgttcctgttggcgattgtcctgatcgagctcacgccggggccgaacatgggctacctggcgggcctttcggcggttgaggggcgccgcgccggagttgtgacgatcgccgggatcacggcgggccttctggtctacatgctggcctcggtggcggggctgacagagattctccgctttaaccgcccgctctatgaagtccttcgctgggcgggggtcgcctatatcttctggctggcgttcgacgcctggcgcggtgagaagccgaccgattttcaaggcgaggacgggcgggcgtggatccacttccgacgcgggctggtggcgaacctgctcaaccccaaagccgccttgttctacgtgacgctcttgccaggcttcatccagaccggccatgcctcgccgactgtccaggccctgatcttgggcggggcccacatcgccgtcagcatcgcggttcacggcgcgatcgttctgtcttcagacggcttggcgcggcgtttgatcctcgagggctccagccccagaacccgcaggctcttcgccgtggccttggtggccaccgcgatctggatcgccgtcgagaccggacgctga

SEQ ID NO: 101569 - protein, 212 aa, Caulobacter crescentus
MPHAAWPVDPAAIAPFLLAIVLIELTPGPNMGYLAGLSAVEGRRAGVVTIAGITAGLLVYMLASVAGLTEILRFNRPLYEVLRWAGVAYIFWLAFDAWRGEKPTDFQGEDGRAWIHFRRGLVANLLNPKAALFYVTLLPGFIQTGHASPTVQALILGGAHIAVSIAVHGAIVLSSDGLARRLILEGSSPRTRRLFAVALVATAIWIAVETGR

SEQ ID NO: 101570 - DNA, 639 bp, Yersinia enterocolitica
  CDS (1)..(639)
atggatgaaatccacgtcatcatattgaccatcgggctatttgtactcacatttattaatcccggcgctaatttacttgttgtggttcaaaccagtctcagctctggtaagaatgcaggtttactcaccggcttgggtgtggccttaggggatgcgatttactcaggattggggttatttggtatggcagcgctgattgctgaagggggagcactgttctcggcaattaagatcggcggcggtttgtatctggtttggtatgcctacaatatggtgcgccatcgtcaagagctgcacatgggcatgggtgctgtcgctacttcgtcaattacgccttggtatgtgttcttccgccgtgggctgttaactgatttatccaacccgcaaactgtgctgttttttatcagtattttctcggtaaccctcaccccgaccacaccagcatgggccaaaatggtcgcctggctcggcattgttgtggcctcaatcctctggcggtcattgctgagtatggcattctcccgcccggcagtacgccgcgcgtatggcaaggttcagcacttgttaagcggtattatcggagtcgctgtcggagcctttgggctacgcttaatttatgaagggataacccgccgctga

SEQ ID NO: 101571 - protein, 212 aa, Yersinia enterocolitica
MDEIHVIILTIGLFVLTFINPGANLLVVVQTSLSSGKNAGLLTGLGVALGDAIYSGLGLFGMAALIAEGGALFSAIKIGGGLYLVWYAYNMVRHRQELHMGMGAVATSSITPWYVFFRRGLLTDLSNPQTVLFFISIFSVTLTPTTPAWAKMVAWLGIVVASILWRSLLSMAFSRPAVRRAYGKVQHLLSGIIGVAVGAFGLRLIYEGITRR

SEQ ID NO: 101572 - DNA, 615 bp, Yersinia pseudotuberculosis IP 32953
  CDS (1)..(615)
atgcttgaaacctcgttattcgtcgcgacactcgcgacattgggaatgatctcccccggacctgatttttttctggtgatcaaaaacgctgcccgctatcgccgcactgccgccatgatgacggcacttggtgtaattttgggtgttgcaacgcatatgtcttactgcgtggccggtctggcggtcgttatcacgactacaccatggttattcaatttgctgaaatatgccggggcctgctacctgatctggattggtattcaagcactgctgtcacggggagaaagtaagtttagtattgataatactgcacagtatcccatctcgctcaaagccgcatttttgcaaggttacctctgcaacttattgaatcccaaagcaactcttttcttcctcgccgttttcacgcaaatattgcagataaactccggcataggagaaaaactctggtatgcctcaatcatctggatactgtccgcaatctggtggcctgtgctggtgatcctgatccaaagcgcgccagtacgccgtggtttagccaaaacacaaaaagtggtcgataaagtgttaggcggcctgttgatcggccttggcatcaaagtcgcattaggctaa

SEQ ID NO: 101573 - protein, 204 aa, Yersinia pseudotuberculosis IP 32953
MLETSLFVATLATLGMISPGPDFFLVIKNAARYRRTAAMMTALGVILGVATHMSYCVAGLAVVITTTPWLFNLLKYAGACYLIWIGIQALLSRGESKFSIDNTAQYPISLKAAFLQGYLCNLLNPKATLFFLAVFTQILQINSGIGEKLWYASIIWILSAIWWPVLVILIQSAPVRRGLAKTQKVVDKVLGGLLIGLGIKVALG

SEQ ID NO: 101574 - DNA, 615 bp, Desulfotalea psychrophila
  CDS (1)..(615)
atgtcagccgagagtgcagtgtcatttttatgtattatttttgtctttgccattactcccgggccgggtgtctttgccctcttggccaggtctctctcctctgggattaagccctctattcatctggccttaggtatggctctcagtgatgtctgttatctggtttttgcctgtttggggcttgccgttattgcagaacagtgggctggcctctttatgcttattcgtattgccggtgctttttatctgctctatctgggttggaagatgtggaacgcctctcccgcggccatggtaaaagacagtggtagtgcgcctaaggcggttagaggtctgcttcagggctttatgatctcagcctcaaatcccaaggttattttcttttatatagcatttttacccactattctggatcttaacagtttgacaacctttgatatagctttggcctcggtgataacacttctgggccttatgctggggctgatgacggttgccatctctgcctcctcggccagacgattttttacctcgaccacggcggttaaaaagctgaaccgtacctccggtggaattatgataggggcaggctgctacctcggtcttcatggctaa

SEQ ID NO: 101575 - protein, 204 aa, Desulfotalea psychrophila
MSAESAVSFLCIIFVFAITPGPGVFALLARSLSSGIKPSIHLALGMALSDVCYLVFACLGLAVIAEQWAGLFMLIRIAGAFYLLYLGWKMWNASPAAMVKDSGSAPKAVRGLLQGFMISASNPKVIFFYIAFLPTILDLNSLTTFDIALASVITLLGLMLGLMTVAISASSARRFFTSTTAVKKLNRTSGGIMIGAGCYLGLHG

SEQ ID NO: 101576 - DNA, 615 bp, Erwinia carotovora
  CDS (1)..(615)
atgctagaaacatcgctgtttgtcgcgactatcgccacgctggggatgctttctcccggccccgactttttcctcgtcatcaggaatgcggcgcgctacccacgtgctgccgcaatgatgaccgcctttggcgtaatctgcggcgtagcaacccacatggcgtactgcgtcgccgggctagccgtcgtcatcaccaccacaccgtggctgtttaatgtactgaaatatgcgggcgccgcctacctaatctggatcggtattcaggcactattcacgcgcggcggaagcaaaatggacgtatcaaacctgacacagcaaagtgtcagcttgaaaaaagcattcctgcaaggctatctctgcaacctgcttaacccgaaagccacactattctttctggcgatgttcacccaggttctgaacattcactccggcatcggtgaaaaactgtggtacgccatgattatctggctgctttctctcgtctggtggccgctgttggtggtgcttttccaaagtgagccggtacgccgaggattggctaaagtgcagaaactggtagataagctgctgggaacggtgttgatcgcgctgggtatcaaagtggcgttgggctga

SEQ ID NO: 101577 - protein, 204 aa, Erwinia carotovora
MLETSLFVATIATLGMLSPGPDFFLVIRNAARYPRAAAMMTAFGVICGVATHMAYCVAGLAVVITTTPWLFNVLKYAGAAYLIWIGIQALFTRGGSKMDVSNLTQQSVSLKKAFLQGYLCNLLNPKATLFFLAMFTQVLNIHSGIGEKLWYAMIIWLLSLVWWPLLVVLFQSEPVRRGLAKVQKLVDKLLGTVLIALGIKVALG

SEQ ID NO: 101578 - DNA, 648 bp, Erwinia carotovora
  CDS (1)..(648)
atgtttatcaatccccttttttccgccgattctctctttcctgcccattttcctgctctggcactggcgcattttgtggcgctattgagcccgggtccggatttctttctgctgacggcctacgccattcgctaccgactgcgcggcagcgcgggaatctgtctaggcatcgcgttgggcaacggtatttatattctgctggcggcgatcggctgggctggtattcagcactcgccgacgctttttaccgccatcgaattggccggtgccgcttacctgatctggattggctatcagttactgaaaagccgttctatcccgtcgtttcaggccgaacagcagtccgacagttgcccaacgctgcgtaaacaaatcctattggggctcggttcgtcgctgttgaatcctaaaaacatgctgttctatatcagcctgatgaccagtatccttgggccacaggtaacaccaacacagcaattcgtcagcggtagctggatgttttctatcgtgctggtgtgggatctgctcatcgcggcacttatcgctcgcccattgattcagcagcgtttaacacgctggcttaacccgattgagcgcggtgctggcgtcattttgctctttttcggtctgctgcttttatttcggtaa

SEQ ID NO: 101579 - protein, 215 aa, Erwinia carotovora
MFINPLFSADSLFPAHFPALALAHFVALLSPGPDFFLLTAYAIRYRLRGSAGICLGIALGNGIYILLAAIGWAGIQHSPTLFTAIELAGAAYLIWIGYQLLKSRSIPSFQAEQQSDSCPTLRKQILLGLGSSLLNPKNMLFYISLMTSILGPQVTPTQQFVSGSWMFSIVLVWDLLIAALIARPLIQQRLTRWLNPIERGAGVILLFFGLLLLFR

SEQ ID NO: 101580 - DNA, 624 bp, Erwinia carotovora
  CDS (1)..(624)
atgacgttgaccgaatcgctgattgcttttacgtttgccgcgacgctgctgaccttaacgccgggtttggataccgcgctgattttacgcactgctaccgttgaaggcagtaagaaagcttttcatgccgcgtttggaattaacgtcggctgcctgatttggggcgcgatggtggcgtttggtttgggaacgttgattgccgcgtcggagctggcctataacatcctgaaatggtgcggtgcggcttatctttgctggctgggtctgcaaatgatcctgaaacccagaaccgaactggtgatggcggcgtcacaaactgcgccgaagcatcaaaactggtttctccgcggcatgttgggcaacgtattaaacccgaaaatcggcgtgttctatgtttcattcctgccgcagtttatccccgctggtcattcggtcgtgctatggacctacctgcttgttcttattcatgtctttattggcacgctgtggtcgtccacgctgattgccgcaacgcgcccgctgtcgcgttttttgcgtcgcggctcggtggttaaatggatggatcgaacaacaggcgtggtctttttagcgttcgccgcacgtctggcgttctcgcggcggtag

SEQ ID NO: 101581 - protein, 207 aa, Erwinia carotovora
MTLTESLIAFTFAATLLTLTPGLDTALILRTATVEGSKKAFHAAFGINVGCLIWGAMVAFGLGTLIAASELAYNILKWCGAAYLCWLGLQMILKPRTELVMAASQTAPKHQNWFLRGMLGNVLNPKIGVFYVSFLPQFIPAGHSVVLWTYLLVLIHVFIGTLWSSTLIAATRPLSRFLRRGSVVKWMDRTTGVVFLAFAARLAFSRR

SEQ ID NO: 101582 - DNA, 609 bp, Photobacterium profundum
  CDS (1)..(609)
atggaaattgtaggtttattgttattgggtatcttaatcgttataagccctggggctgattttgttttagtggtaaaaaatagtttagccaatggtcgtcgtgctggcttattaacagcgtgtggcattagcactgcgattggtatacatgtcggttactcaatgctgggagtcggttacttaatctcacagaatgaggttttattttcactggttaaatatgcaggcgcggggtacctgttctatttgggaattactgcattgtttacccgcacgtctgtgatgttagagaaagggcatacgacggatctgtctggtgctgcgtattggcgacaaggctttttctgtaatttgtttaacccaaaaacgatgttgttcttcataagcttattcagtcaaattatcaccgctgaaggcagtagccctgtgttggcagtattgtatggtgggtatcttgcactacttcactgtctatggtttggtcttgtggcttatgctttatcttcacctgcatttgaaggttatgtgaatcagtggaaacaacaaattcaacaattatgtggtgtggggctaatgggattaagcgtggcgttggtattaaaaagttag

SEQ ID NO: 101583 - protein, 202 aa, Photobacterium profundum
MEIVGLLLLGILIVISPGADFVLVVKNSLANGRRAGLLTACGISTAIGIHVGYSMLGVGYLISQNEVLFSLVKYAGAGYLFYLGITALFTRTSVMLEKGHTTDLSGAAYWRQGFFCNLFNPKTMLFFISLFSQIITAEGSSPVLAVLYGGYLALLHCLWFGLVAYALSSPAFEGYVNQWKQQIQQLCGVGLMGLSVALVLKS

SEQ ID NO: 101584 - DNA, 621 bp, Photobacterium profundum
  CDS (1)..(621)
atggacgattaccctgtattactatccgctatggcgatatgcttatttggtgtgatgagccctgggccttcatttgtcgctataaccaacaaagctcttacatccgaacgagagcaagtgttgtggttaacttttggtatcgccttagtcaatgctctgtgggcgatattggcaatgtttggtttaaaagcattgatgctacagttaccttggctattacttctaattcgagttttcggtgctgtctatttaatttggtttggcctacgtttactaagaatgccttcaacgtcacttgagccttcatcaaaaggtggcgcgactaaaaatgcttctcgacgaacttcttttggagaaggattgctagcaaattttagtaaccctaaatcccttcttttttacagctcggtattttccgttgcagttcctgaatcggcgacacaaagcctactgattgcattagtctttgtcgtcttcactatttcgattgcttggtatggcagccttgctgttgtactgacaacaagccgtattcgtagattatatttaaatgctcaaaacgttattcaaaaaacgtgcggtggcttattaattatttttggaggtagacagttgttttaa

SEQ ID NO: 101585 - protein, 206 aa, Photobacterium profundum
MDDYPVLLSAMAICLFGVMSPGPSFVAITNKALTSEREQVLWLTFGIALVNALWAILAMFGLKALMLQLPWLLLLIRVFGAVYLIWFGLRLLRMPSTSLEPSSKGGATKNASRRTSFGEGLLANFSNPKSLLFYSSVFSVAVPESATQSLLIALVFVVFTISIAWYGSLAVVLTTSRIRRLYLNAQNVIQKTCGGLLIIFGGRQLF

SEQ ID NO: 101586 - DNA, 645 bp, Photobacterium profundum
  CDS (1)..(645)
atgccaataacagaatggatagcatttgttgtcgcgatctcaatacttaccatcacaccaggattagacactgtacttgtaatcaggaataccagccgaggtggctggaaagatggggtaaccagtagctttggtatttgcagcggcttatttgtgcatgcaacgctttctgccgtgggtatatcctttatcttggtacaatctgcgtggttatttcaaacggttaaaattattggtgcggcataccttatctaccttggtatttgtagcttacgaagcggctggaaagcaggttctttagggattgtggcaaatcaaataagtgacaatcaattcaatatgaagcgatctttttctgaaggctttctgtcaaatgtgctaaaccctaaaacagctattttttatctcgcttttttgcctcagtttattaaccccgaaggatcggctattacacaatctttcattcttgcaggcatccattttattttggcgatggtgtggcaatcatcattagccttcgtcatagagcgagcaaaaagctggttagcaaagcccaaaacaaatcagtggcttcaatctttaactggctgtgtaatggtcgggctaggcttacagctattattgagcaaaaacgttcgcctttaa

SEQ ID NO: 101587 - protein, 214 aa, Photobacterium profundum
MPITEWIAFVVAISILTITPGLDTVLVIRNTSRGGWKDGVTSSFGICSGLFVHATLSAVGISFILVQSAWLFQTVKIIGAAYLIYLGICSLRSGWKAGSLGIVANQISDNQFNMKRSFSEGFLSNVLNPKTAIFYLAFLPQFINPEGSAITQSFILAGIHFILAMVWQSSLAFVIERAKSWLAKPKTNQWLQSLTGCVMVGLGLQLLLSKNVRL

SEQ ID NO: 101588 - DNA, 657 bp, Photobacterium profundum
  CDS (1)..(657)
atgaacgaagtcaccactttatttaccttagttaccgtccacgttattgcgctaatgagcccagggcctgattttgccttagtggtacaaaacgcaggacgttacggacgccaaacgggcattgcgatcgccctgggtttgtctctgggcattttactgcattcaattttaagcctgacaggtgccagcttattgatccaccagcagcccaccctgtttgccttactgcaagccgctggcggtttatacctactgtggttgggtattggtgctgttaggagcgtactaatgcccatttttcgtcccacagcgcacactgaaacagttacagccccacagcgcattattgctaatcgaaaacaagcgctcgtgaaagggttcacgaccaatatcttgaaccccaaagcgttagtattcttcatcagcctactctcgaccatagtgccagttgatatgtcgacatccggaaaaataaccgcaattgcgattttatggatcacatcatttctatggttcgccatgttggcgtggttactgacgggaaaacgtctgcaacagaaaatccagcaatggacaccttatatcgacggtatctgcggcgtactgtttgtgactatcggcagtatgatcttgttgaacctcttagttgcgcggtaa

SEQ ID NO: 101589 - protein, 218 aa, Photobacterium profundum
MNEVTTLFTLVTVHVIALMSPGPDFALVVQNAGRYGRQTGIAIALGLSLGILLHSILSLTGASLLIHQQPTLFALLQAAGGLYLLWLGIGAVRSVLMPIFRPTAHTETVTAPQRIIANRKQALVKGFTTNILNPKALVFFISLLSTIVPVDMSTSGKITAIAILWITSFLWFAMLAWLLTGKRLQQKIQQWTPYIDGICGVLFVTIGSMILLNLLVAR

SEQ ID NO: 101590 - DNA, 654 bp, Photobacterium profundum
  CDS (1)..(654)
atgcttgttaatttaccgccatgcaaaaggagcaaaagcatgacactgagtatttggttttcgttattaatgatctgtatgttgggggcaatgtcgccaggaccaagtttagcggttgtggctaagcatagccttgcgagcggaaggctgcatggcgttgttacatcgtgggcgcatgcaatcggtgttggcgtgtatgcattactcaccctattgggtttagcggtggtattaaagcaatcacctactgtatttacatttatttcttatgcaggggcggcttatctagcttaccttggggtaaatgcactgcgctcgaaaggtggtgtggcagcgaaactctctgcggggaaaaaagcacgcttacgtgaagcggcccgtgatggcttgatgatttcactgttaaaccctaagctggctttattctttttagcgctatttagtcagtttgttgctgttggtactgaaataaccagccgttccatcattgtagctacgccattactggttgatggtttatggtatacctttattgcttttgtattatcgaatccgaaagtattagataagctgcgtactaaagctaagttgatcgaccaattatctggtgttgttcttattcttttggcaatacgagtggttattcaagcgtag

SEQ ID NO: 101591 - protein, 217 aa, Photobacterium profundum
MLVNLPPCKRSKSMTLSIWFSLLMICMLGAMSPGPSLAVVAKHSLASGRLHGVVTSWAHAIGVGVYALLTLLGLAVVLKQSPTVFTFISYAGAAYLAYLGVNALRSKGGVAAKLSAGKKARLREAARDGLMISLLNPKLALFFLALFSQFVAVGTEITSRSIIVATPLLVDGLWYTFIAFVLSNPKVLDKLRTKAKLIDQLSGVVLILLAIRVVIQA

SEQ ID NO: 101592 - DNA, 654 bp, Photobacterium profundum
  CDS (1)..(654)
atggatgagtcgtttaaatggagagacaaaatgacaattgaagtctggttaacctttttgcttgcagctatagtgttgagtgtttcgcctggtgcgggggctgttaatacgatggcaaatacaatgaagtatggtttcaaagcaagtttaatcgcaaacctaggcttacaagtgggcagtgcatttaatattgtgatggttggtttggggttaggtgcgttgcttgcacaatcagaattggcgttttcgattattaagtgggtaggtgtcgcttatcttatttttcttggttatcaaaagtttaatgaagttagtaaactcgatttaggtgaattgaaagcgcaaaaacctgaaccattcaagttgtttactaagtccgttattgtgaatattactaatcctaaaagtattgtttttttggtcgcattattaccacaattcatgaataccaatgagtctcaaattaatcaaattatgctgttgggcgcaacaatgctagtggtggatacagtggtaatgattggctattccttactggcaacgcgtttagcacacttaattaaaaatgagcgtcatgtgcgtattcaaaatagaatttttggcagtatgtttatgggcgctggctctttattggcagttgcaagccataactaa

SEQ ID NO: 101593 - protein, 217 aa, Photobacterium profundum
MDESFKWRDKMTIEVWLTFLLAAIVLSVSPGAGAVNTMANTMKYGFKASLIANLGLQVGSAFNIVMVGLGLGALLAQSELAFSIIKWVGVAYLIFLGYQKFNEVSKLDLGELKAQKPEPFKLFTKSVIVNITNPKSIVFLVALLPQFMNTNESQINQIMLLGATMLVVDTVVMIGYSLLATRLAHLIKNERHVRIQNRIFGSMFMGAGSLLAVASHN

SEQ ID NO: 101594 - DNA, 630 bp, Photobacterium profundum
  CDS (1)..(630)
atggattatttattgattgttagtcatgtcgttcttatctggatattagcggttgttacaccgggggctaatgtgctgcttaccatcaacaccgccctacattatgatcgtaatcttgcaatgttttcagcctttggtgttagctccgcgatattgttatgggcgctctttggaggttcaggacttgtcattctattttctcttttccctcaattattttgggttatgaagttctgtggtggaagctatttactttacctaggcatacgccaaatttatcgagcacgaatagataaaaatagggcaaatacgacagatgttcaccaagcagtatttccctcaaaacgaaaggtctttttatctgcatttattaccagcattttaaacccaaaaactggtttctttgtcgttagtttattcagtgtttcaatgcctcaagaaattagtgtggggttgatgtttactattatgttaataatgtcatcaattacattatgctggcaccttacgcttgctgcgattttttcgcacaactcagcgaaaggagcatatagccgaatatcaagcatcgttgattatattaccggtggtctatttgcaatgtttggcttaagaatcatgatgtcttag

SEQ ID NO: 101595 - protein, 209 aa, Photobacterium profundum
MDYLLIVSHVVLIWILAVVTPGANVLLTINTALHYDRNLAMFSAFGVSSAILLWALFGGSGLVILFSLFPQLFWVMKFCGGSYLLYLGIRQIYRARIDKNRANTTDVHQAVFPSKRKVFLSAFITSILNPKTGFFVVSLFSVSMPQEISVGLMFTIMLIMSSITLCWHLTLAAIFSHNSAKGAYSRISSIVDYITGGLFAMFGLRIMMS

SEQ ID NO: 101596 - DNA, 648 bp, Photobacterium profundum
  CDS (1)..(648)
atgattgatttatctattcttccagtgtatttaaccgctgttgttgctctactactgatccctgggcccgacatgttacttatcgccagctctagcttaagctacggaaaaaaagtcgggatctttgcaagccttgggaatgcgacagcaggtttagtgctgactttactggctgcaatgggtgtatctgcattaattgccatgaacccaatcgcattacaagtattgcgtttattaggcggagcatatttattaaagatgggctgggactgtatgcgtactaacccagtcgatgctccagaaatagaacaacaaacaggtttagcaaaaacactgtatctccgagctgttatcagtaatttgcttaatcccaaagcactgatcttcttcgtattatttctaccacaatttgtatcgactcaatcgacagcaacatctggcgagcaaatgctggttcttggtttgttattgaatgtgctgggcttaatctttaatttattcttagtgtcgatggtaggaagtcttggtaagtcattgttgaaaaatgaaaagttccgtactaatcagcataaagtgatgggtttggtctttttcatactggcaatatggcttttagcatcacaggtgccaacacccgtaatacactaa

SEQ ID NO: 101597 - protein, 215 aa, Photobacterium profundum
MIDLSILPVYLTAVVALLLIPGPDMLLIASSSLSYGKKVGIFASLGNATAGLVLTLLAAMGVSALIAMNPIALQVLRLLGGAYLLKMGWDCMRTNPVDAPEIEQQTGLAKTLYLRAVISNLLNPKALIFFVLFLPQFVSTQSTATSGEQMLVLGLLLNVLGLIFNLFLVSMVGSLGKSLLKNEKFRTNQHKVMGLVFFILAIWLLASQVPTPVIH

SEQ ID NO: 101598 - DNA, 618 bp, Photobacterium profundum
  CDS (1)..(618)
atggatattgaagtttggttggcatatttagcgacagcagtggtatttagcgttgcaccaggctcgggcacagtgaactcgatcagtaacggcatggtttatggttttcgtaaatcattagcgtcgatagtcggcctacaagcgggattggcctttcatattatactggttggggttggccttggggcgattgttgctcaatctgagatggcattttccgtcatcaaatgggtgggggtgatttatcttgtttggctaggcgtgcagaaatggcgagaaaaagccgttattagtctcgatacacccgccgacaatgtgtctgctcaatcattatttcgccaagccgtatttgtgaatatgaccaaccctaaaacgattatttttctggtggccttatttccacagtttattaatccgaatgaaccgcaaatgatgcagcttattattttgggtgcgacaacagtcttggtcgataccagcgttatgctgtgttatgtatcactagcttctaaactgacagggtatatacgatcttctcgtgtgatgaacacgttgaaccgtgtgtttggctcgatgtttattggttgtggtgcattgctcgcatcagcacgtgcttaa

SEQ ID NO: 101599 - protein, 205 aa, Photobacterium profundum
MDIEVWLAYLATAVVFSVAPGSGTVNSISNGMVYGFRKSLASIVGLQAGLAFHIILVGVGLGAIVAQSEMAFSVIKWVGVIYLVWLGVQKWREKAVISLDTPADNVSAQSLFRQAVFVNMTNPKTIIFLVALFPQFINPNEPQMMQLIILGATTVLVDTSVMLCYVSLASKLTGYIRSSRVMNTLNRVFGSMFIGCGALLASARA

SEQ ID NO: 101600 - DNA, 618 bp, Rhodopseudomonas palustris
  CDS (1)..(618)
atgtctctcgaaatgtacctgaccttcgtcaccgcctgcatcgtgctcgctctgctgccagggccggtggtgacgctggtgatcgccaacggcctgcgtcacggcacacgtgccgcgttgctcaatatcgccggcgcgcagctcgggctcggtctggtgatcgcgctggtcgctgcagggctgaccacgttgatggcgacgatgggatattggttcgactgggtacggtttctcggcgcggcgtatcttgtctggctcggcatcggtctgatccgcaggccggtcgaaggtctgtcgaccgatcagccgccgcctccgccgcgcggcggcttcttcctgcagggcttcttcgtgctgctggcgaatccgaaggtgctggtgttcttcggcgcgttcatcccgcagttcgtcgacatgcagcgcgagacggtgccgcaggtggcgctgctcggcgtcaccttcatggtgatcgcggcgatgacagatgcgatctacgcgctgctcgccggccgcgcccgcacgatgttctcggcccagcgcacgcggctgctgtcgcggatctccggcggcttcatgatcggcggcggcatctggctggcgctcagccgggcgaagtaa

SEQ ID NO: 101601 - protein, 205 aa, Rhodopseudomonas palustris
MSLEMYLTFVTACIVLALLPGPVVTLVIANGLRHGTRAALLNIAGAQLGLGLVIALVAAGLTTLMATMGYWFDWVRFLGAAYLVWLGIGLIRRPVEGLSTDQPPPPPRGGFFLQGFFVLLANPKVLVFFGAFIPQFVDMQRETVPQVALLGVTFMVIAAMTDAIYALLAGRARTMFSAQRTRLLSRISGGFMIGGGIWLALSRAK

SEQ ID NO: 101602 - DNA, 633 bp, Rhodopseudomonas palustris
  CDS (1)..(633)
atgctcggcattcacgacttctggctgttcgtcgcctccgggctgctgctcaatgtcacgcccgggcctgacacagccttcatcgtcggccgcggcctgcagttcggctggcgcggaggggcggctgcggcgctcggcgtcggcaccggctgcctagtgcatgtcgctgccgccgctgtcggactgtctgccctgctgatggcgtcgacgctggcgttcagcgtgctcaagtgggtcggcgccgcctatctgatctggctgggggcccggatgctgctgtcgaagcccagcgatttcaccgccaacgcaggcgctgccccgacgctgtcgattcccgcggtgtttcgccagggcatgctcaccaatgtgctgaaccccaaggtggcgctgttctttctcgccttcctgccgcagttcgtcgccgccgatgcgcccaacaaggcgctggcgtttctggtgctcgggctgatcttcgtggtcaacggcacgctgtattgcctggcgctcgcggccttcgcggcgcgtgcggccgatcggctgcgccgctccggcacggtgctgcaatggatcaatcgcggccttggcgcgctgttcgtcgcgctcggcatccgggtggcgctggctcgcacttga

SEQ ID NO: 101603 - protein, 210 aa, Rhodopseudomonas palustris
MLGIHDFWLFVASGLLLNVTPGPDTAFIVGRGLQFGWRGGAAAALGVGTGCLVHVAAAAVGLSALLMASTLAFSVLKWVGAAYLIWLGARMLLSKPSDFTANAGAAPTLSIPAVFRQGMLTNVLNPKVALFFLAFLPQFVAADAPNKALAFLVLGLIFVVNGTLYCLALAAFAARAADRLRRSGTVLQWINRGLGALFVALGIRVALART

SEQ ID NO: 101604 - DNA, 639 bp, Corynebacterium diphtheriae
  CDS (1)..(639)
atggggcttagccaattacttaccctcgtgggcctcaacgtggtgggaatgcttacccctggccctgatattttccttgttacccgcattgccaccaagtcgcgtcgccatgcgtacgccactgtggccggcatagccactggattattagtgtgggtcacgttgacggttttcggcgcaacggccgtgctcaccgcgtacccctcggtacttagcgctatccaactcgtgggtggtacgtggcttttatggatgggtacgaaattggtgcgggtggcgcgtcgccagctgggggagggggttgcggttgcctcgactatcgacgctctcctgggaaccccagcacagtgttatcgccaaggactagccaccaacctttcgaaccctaaagtggtgttgtattttgcggcgatcattgcaccgtttcttcccacgaacccgagtttgctgactgcgctgtcggtgatcgtggtgattgtgttgagcaaccttgtgatgttctcactgttagccactgtcattagtaccaatgcgctgcggcgggcctttttgaaggctgggccgtggattgatctggttgccggttgtttcttcatcatcgctggtatcgggcttatcatcgcagctacccgctcatag

SEQ ID NO: 101605 - protein, 212 aa, Corynebacterium diphtheriae
MGLSQLLTLVGLNVVGMLTPGPDIFLVTRIATKSRRHAYATVAGIATGLLVWVTLTVFGATAVLTAYPSVLSAIQLVGGTWLLWMGTKLVRVARRQLGEGVAVASTIDALLGTPAQCYRQGLATNLSNPKVVLYFAAIIAPFLPTNPSLLTALSVIVVIVLSNLVMFSLLATVISTNALRRAFLKAGPWIDLVAGCFFIIAGIGLIIAATRS

SEQ ID NO: 101606 - DNA, 642 bp, Xenorhabdus nematophilus
  CDS (1)..(642)
atgatcagttttgaattaatgtctgtatttatactattggcgttgctctcttacctgactccaggccctgattgggctgttatcagtaaaggggtattcagggacaagagagaagggatgatcactgcatttggtgtgcaatcaggattattttttcatcttgttctaggatcattaggtgccacggttattctggcaacttcgaaaacagcgttcagtatattgcagataattggagccttttatcttgtttatctgggaagctcggggttaagagagatttatctcaataaaaatcaacaacagttaatgactgtttcacaagatatatctcagcagaaaagaaatccttttttaatcgggcttttggctaatatatttaaccccaaagtagccatattttttatcagtatactacctcaatttattaatccatcactgcctcctcttagacaagttatcatactcgggatgattgatattatcattggcgtattttggtggattatatttgtttatgctctatcttatattcagcgtgtatttttaaaagggaaattccaagttattattgagtctataactaatgtttttttgcttttatttggatttattatgttagtaggtgccattttgatgtaa

SEQ ID NO: 101607 - protein, 213 aa, Xenorhabdus nematophilus
MISFELMSVFILLALLSYLTPGPDWAVISKGVFRDKREGMITAFGVQSGLFFHLVLGSLGATVILATSKTAFSILQIIGAFYLVYLGSSGLREIYLNKNQQQLMTVSQDISQQKRNPFLIGLLANIFNPKVAIFFISILPQFINPSLPPLRQVIILGMIDIIIGVFWWIIFVYALSYIQRVFLKGKFQVIIESITNVFLLLFGFIMLVGAILM

SEQ ID NO: 101608 - DNA, 699 bp, uncultured bacterium 582
  CDS (1)..(699)
atgcaaattgaccatattttggctttcaacgccgcacttttaattgcgcttatgagccccggacctgcttttttgctcgtactgcgcacgggggtgagctgcggaaaatcagctggtctggcccaaggggcgggtcaaggcgttgccgccgctttctggacgctggcggcacttgcggggttagagggtgtttttcatctgtttccatgggcctatagtgcggtaaagatcgttggcgcactgtatttgatgtatttggcgtggcgtctctggaaacaggccgccgaccctgttttgcccttttcagacccccaccacgataccgcccaccaaggtactgtccggcaaatatcgcacaccgaaggggccatagggggttctaagcgcatttggtcgctgacggtgttacggtcgcattttgtgcacggcgttttgatcaacctgaccaatccaaaatcggttatgttcgccgcggttgtgctgattgtggtctttccgcccaatctgggattggcagaaaaagcatttatcgttggcaatcatctggcgcttgaatgggtgttttatttttgcctgacgtggcttgtcagccgacccgccgtgacccgccgctatttcaaggccaaacagctgtttgatcgctgtgctgcgggtgtcatggcggccttgggactgcgcctgcttttgagcccccgctaa

SEQ ID NO: 101609 - protein, 232 aa, uncultured bacterium 582
MQIDHILAFNAALLIALMSPGPAFLLVLRTGVSCGKSAGLAQGAGQGVAAAFWTLAALAGLEGVFHLFPWAYSAVKIVGALYLMYLAWRLWKQAADPVLPFSDPHHDTAHQGTVRQISHTEGAIGGSKRIWSLTVLRSHFVHGVLINLTNPKSVMFAAVVLIVVFPPNLGLAEKAFIVGNHLALEWVFYFCLTWLVSRPAVTRRYFKAKQLFDRCAAGVMAALGLRLLLSPR

SEQ ID NO: 101610 - DNA, 627 bp, Agrobacterium vitis
  CDS (1)..(627)
atggagcatttacctgaaattggacttgctttcggggcctttgcgctcggaatgttcagtcccggccccaatattttatcggtcatcggcacttcgatggccgtaaatcgtaaagcaggcattgccttagcactcggcatttcagccggatctctactgtgggcgtctatgacagcgattggactgacggcgctgatcaccgcttatgcatctgtgctgacggtcatcaagatcgcgggcggtttgtatcttctctggcttgccttcaaagcttttcgctcggcggcgtccgcaaagccaaacttagacgcctccgtcctagccgcagggaacctgtatgtattctttttgcgcggcttggctattcagctgaccaaccctaaagctgccctgacgtggattgcaatcatgtcgcttggtcttgcggattccgcacccacatccacagcgctcattattgtgattggaaccacgattctatcggttgtcgggcatactgtatatgctgtcgccttctccaccaagcgcgttgtggcattatacgacagagcacgtcgttggattgacacagctttgggcgtcttcttcaccgtggcaggaataaagcttcttacaagccgcccataa

SEQ ID NO: 101611 - protein, 208 aa, Agrobacterium vitis
MEHLPEIGLAFGAFALGMFSPGPNILSVIGTSMAVNRKAGIALALGISAGSLLWASMTAIGLTALITAYASVLTVIKIAGGLYLLWLAFKAFRSAASAKPNLDASVLAAGNLYVFFLRGLAIQLTNPKAALTWIAIMSLGLADSAPTSTALIIVIGTTILSVVGHTVYAVAFSTKRVVALYDRARRWIDTALGVFFTVAGIKLLTSRP

SEQ ID NO: 101612 - DNA, 633 bp, Bacillus cereus
  CDS (1)..(633): k means g or t/u
atgattgaaaattattttcttttcatcattatgtctattkgtcttattattttacctggtcctgatactgcaatggctacgaaaaacacattagttgctggtaaggtaggcggggtgaaaacagtgttcggtacatgtgttgcactattgattcatactttagcagcagtaatcggactttccgcacttattgtaaagtcagctcttttattttctattttcaagtacgttggagctctatatttaatttatattggtattaaagcccttttagcagtaagaaataaagaaggcgtcaatacgaacgatatatctttgaataacgcaaacgagcatacttcttgctttcgccaagggtttcttacaaatttattaaaccctaaaatcgcagtcttctttttaacatttttaccgcaatttttaaatccaaatcataatacgtttatccaacttcttataatgggccttacttacctagttttaacagttatttggttcgctttttatatatttttaattgataaaattagtgcttttatgaaaaaaccgaagacacaacgttatattcaagggttaacgggaattgtcttaattggttttggtattaaactagcttttgaaaaaagcaattaa

SEQ ID NO: 101613 - protein, 210 aa, Bacillus cereus
  misc_feature (14)..(14): Xaa can be Gly or Cys
MIENYFLFIIMSIXLIILPGPDTAMATKNTLVAGKVGGVKTVFGTCVALLIHTLAAVIGLSALIVKSALLFSIFKYVGALYLIYIGIKALLAVRNKEGVNTNDISLNNANEHTSCFRQGFLTNLLNPKIAVFFLTFLPQFLNPNHNTFIQLLIMGLTYLVLTVIWFAFYIFLIDKISAFMKKPKTQRYIQGLTGIVLIGFGIKLAFEKSN

SEQ ID NO: 101614 - DNA, 621 bp, Geobacter sulfurreducens
  CDS (1)..(621)
atgacaaatctcagtgtgttccttgtttccgttgtcctcgtcaccgttgcgccggggcccgatatcatccaggttctcacccggggagtaagccaggggcggatggccggcttggctgccgcggccggtttcagcaccggctgtatcttccacacgaccctggcggcagtgggggtgtcggccctcattcggtcctccgacgtggcattcaccctgatcaagcttgccggggcctgttatctggtctacatcggcatcggggcgctgcggaaccggggggcatccctggtgggcgagccggccggcttcgacgccttgggggtcatctaccgccagagcatcgtggcaaacatcctcaatcccaaggtaaccctcttttttctcgcgttcctgccccagttcgtgtcccccgcgtcggccactccaggctttcagctcatggggctcggcatcatcttcatggtcgtcaccatcatcatctttggctccgtggccctttttgcggggctcatcggggactggctccgacgtcggcctgccgttgccggacggctccaggccctggccggcgttaccttcatcggcctcggcatccgcgtggcattgcccgatgtccgctga

SEQ ID NO: 101615 - protein, 206 aa, Geobacter sulfurreducens
MTNLSVFLVSVVLVTVAPGPDIIQVLTRGVSQGRMAGLAAAAGFSTGCIFHTTLAAVGVSALIRSSDVAFTLIKLAGACYLVYIGIGALRNRGASLVGEPAGFDALGVIYRQSIVANILNPKVTLFFLAFLPQFVSPASATPGFQLMGLGIIFMVVTIIIFGSVALFAGLIGDWLRRRPAVAGRLQALAGVTFIGLGIRVALPDVR

SEQ ID NO: 101616 - DNA, 618 bp, Bacillus anthracis str
  CDS (1)..(618)
atggatttaaatatatggattacagttttattagttggcacgataggagtaatttctcctggtcctaactgggcagttattataaaaaatagtctgtattcaaggagcttaggtgtatcaacagttgcaggtattgccactggaagcctcattcatattgtttattgtttaattggtataggagtaattatctccaaatctatcttgctatttaatacattaaaatggataggagttgcatatttactatatatcgggattaaattattgagatcaaaaaaacaaagtccagctgctataatcaaaaacaatgaatctactacatggaaggcatttcgttcaggatttttaacagacatgctaaatcctaaagccactctattttatttagcaatattcactcaagtaatagaaccaaatacaaatatttttgtacaatctgtgtatggattaactgtgtggagtgtagagattttgtggcatatggtattggttttcttccttacgcataaatcagttcgtaattatttcttatctatttcacattggattgaacgtgtgactggaactgcattaattttactaggaattcgtcttgcttttttaaagaatgattaa

SEQ ID NO: 101617 - protein, 205 aa, Bacillus anthracis str
MDLNIWITVLLVGTIGVISPGPNWAVIIKNSLYSRSLGVSTVAGIATGSLIHIVYCLIGIGVIISKSILLFNTLKWIGVAYLLYIGIKLLRSKKQSPAAIIKNNESTTWKAFRSGFLTDMLNPKATLFYLAIFTQVIEPNTNIFVQSVYGLTVWSVEILWHMVLVFFLTHKSVRNYFLSISHWIERVTGTALILLGIRLAFLKND

SEQ ID NO: 101618 - DNA, 627 bp, Wolinella succinogenes
  CDS (1)..(627)
atgttggatattcacgatttttggctctttgtcttgtcggggctattgctcaacctcacgccgggcgtggataccctttatgtgttatctagctcattggcgcgaggatttaagggcggcttcatcgcttcgttggggattggcatggggtgtctcgtccatgtcatggcggcgactgtggggttgtcggcaattttgatggcatcagctacaacttttatggtcgtgaagacgataggagcgctctaccttgtctatcttggggtgaaattgattcttcttcgctcaactccctccctggtggagaagagcgcgacacgctccttgagggtaattttttggcaagggtttttgactaatgttcttaatcccaaagttgcactcttttttctcgcctttttgcctcagtttgtcgatgcgcaggggtcacataaagtgcttagtatgctttttttgggagctgtgttcacctttaatggagtgctttggagcatttttcttgcatggagtgccacgacattcacgcacaagctccaacgccatgctcttatcatggcgtggttttataaaatcattggagcactttttatctatcttggggtgcggctttggctgcagaaagcgtaa

SEQ ID NO: 101619 - protein, 208 aa, Wolinella succinogenes
MLDIHDFWLFVLSGLLLNLTPGVDTLYVLSSSLARGFKGGFIASLGIGMGCLVHVMAATVGLSAILMASATTFMVVKTIGALYLVYLGVKLILLRSTPSLVEKSATRSLRVIFWQGFLTNVLNPKVALFFLAFLPQFVDAQGSHKVLSMLFLGAVFTFNGVLWSIFLAWSATTFTHKLQRHALIMAWFYKIIGALFIYLGVRLWLQKA

SEQ ID NO: 101620 - DNA, 615 bp, Photorhabdus luminescens
  CDS (1)..(615)
atgctggaaacatcactagtcgtcatcattatctcaacgttgggtatgctctctcccggccccgatttctttctggtagtcaaaaatgccatacgttatcagcgttctgctgccatgatgacagttgcgggcttaatcgccgctatcacttgtcatatggcttactgtgtcgccgggttagctattgttatcaccacaacgccgtggctatttaatctgatgaaatatgccggagcggcttatcttatttggatcgggatcaatagcttgctttctcgcggaggcaacagcattctcccagacaatcagccacgacagattatcactttcaaaaaagcgtttatgcaggggttcttatgtaatttgctcaaccccaaagcaacgttgttcttcctggcaatatttactcagttgctaaatgtcaattctggtgttggtgaaaaattatggtatgcctctattatctggggattgtcagtcatctattggccaatattagtcatattgattcaaagtgcaccggtacgccgcggattagctaaggctcagaagattatcgataaattactaggcattgttttgattggattaggtgtcaaagtagcactgggataa

SEQ ID NO: 101621 - protein, 204 aa, Photorhabdus luminescens
MLETSLVVIIISTLGMLSPGPDFFLVVKNAIRYQRSAAMMTVAGLIAAITCHMAYCVAGLAIVITTTPWLFNLMKYAGAAYLIWIGINSLLSRGGNSILPDNQPRQIITFKKAFMQGFLCNLLNPKATLFFLAIFTQLLNVNSGVGEKLWYASIIWGLSVIYWPILVILIQSAPVRRGLAKAQKIIDKLLGIVLIGLGVKVALG

SEQ ID NO: 101622 - DNA, 648 bp, Vibrio vulnificus
  CDS (1)..(648)
atggcttactgtgaatcatcacaggagaagattatgacattcacagtttggttatcactttttacgatctgcattttgggcgcgatgtcgccggggccaagtttagcgattgtcgctaagcatgcgttagcgggtgggcgagcgaatggtttggccaccagttgggcacacgcttttggcattgggatatacgctttcgtgaccttaattggtttggcggtggtgttacagcaatccccactcttgttcaaaaccattagttacgcaggtgcgggctatttagcctacttgggttacaacgcgttgcgctctaaaggcggtgtggcggccaagttggaatcgggggagcaaacgacggttttgcagtcggccaaagaaggctttttgatttctattctcagtccgaaaattgcactgtttttcatcgcactgtttagccagtttgtggcgctggggaatgagctgagtaatcaagtgattatcgtagcgacgccatttatcgttgatggcctctggtatacctttatcaccttggtgttatcgagctcaaaagtggtggacaaaattcgctccaaagcacagttgatcgatcgcctgtcaggcgtggtgctgattttgctggcagctcgtgtggtgctgacggtgtaa

SEQ ID NO: 101623 - protein, 215 aa, Vibrio vulnificus
MAYCESSQEKIMTFTVWLSLFTICILGAMSPGPSLAIVAKHALAGGRANGLATSWAHAFGIGIYAFVTLIGLAVVLQQSPLLFKTISYAGAGYLAYLGYNALRSKGGVAAKLESGEQTTVLQSAKEGFLISILSPKIALFFIALFSQFVALGNELSNQVIIVATPFIVDGLWYTFITLVLSSSKVVDKIRSKAQLIDRLSGVVLILLAARVVLTV

SEQ ID NO: 101624 - DNA, 672 bp, Vibrio vulnificus
  CDS (1)..(672)
atgaacgaactgacgattttactgacgctggcaagcgtccactttattgctttgatgagccccggccccgacatggcactggtcgtgcaaaacgcaagccgctatggccgccaaacgggcctttttattgccctcggtttgtctgttggcattttgctgcattctctattaagcctgacgggcgtgagttacttggtccaccagcaaccgatgttgtatgccttattgcaactgctgggtggcagctatttgctctatttgggcattggcgcgttacgttccgtattacgtcattggcgtcagccatcggtgaatcccaccaccactcaacggcagtggacgctgaacacgaaacgccaagcctttctcaaaggctttgccaccaacattctcaatcccaaggcgttagtgttttttgtcagtctgctatcgagcttaatcccagcaaccatgtcgctctctggcaaggccacagcggtgatgattttatttgcgttgtcatttctttggtttgccagcttagcgtgggcgctctctggccgccgaatgcaacagcatttacacaaagcgagtgtctatattgatggcatttgcggcgttttattctgcttaattggcgcgggtatcctctacaacacggtgattcatcaagtcatcagccaagttgcatag

SEQ ID NO: 101625 - protein, 223 aa, Vibrio vulnificus
MNELTILLTLASVHFIALMSPGPDMALVVQNASRYGRQTGLFIALGLSVGILLHSLLSLTGVSYLVHQQPMLYALLQLLGGSYLLYLGIGALRSVLRHWRQPSVNPTTTQRQWTLNTKRQAFLKGFATNILNPKALVFFVSLLSSLIPATMSLSGKATAVMILFALSFLWFASLAWALSGRRMQQHLHKASVYIDGICGVLFCLIGAGILYNTVIHQVISQVA

SEQ ID NO: 101626 - DNA, 627 bp, Wolinella succinogenes
  CDS (1)..(627)
atgagtgaattttggcaaggatggtggctcatcggggcgattcacctccttgcagccgcttcgccaggccccgattttctctttgccacgcgccacacgttgcgctatgggagagggagtggcctatggtgttcgtttggaatcacgctgggactctctgtccatcttctctactccctcttgggattggccgcgttgattgcggcttcagaaggaatcatgagcgcgattcgctatttagggggcggctatttgatctatttgggaatcaaaggcgtgagggcgcgctcggtgaactttgagcatggcgtggcggagagtgcaagcaagcccaagccgtggaagagtgtcgcgcttggctttggctgcaacctctttaaccccaaagcccctctctacttcctttcgctctttaccgtggtgctttctccttgcatgcctctttcgtggtggctagggtatggagtctggatcatggggctacaaatgggatggttttcgcttcttgtttatggaatttcgcacacgaaagtgcggaggatgctgggacgctttgggggttggatcgagcgacttctagggggagcgatgatttttttgggtctaaaattatgggtaagccgttga

SEQ ID NO: 101627 - protein, 208 aa, Wolinella succinogenes
MSEFWQGWWLIGAIHLLAAASPGPDFLFATRHTLRYGRGSGLWCSFGITLGLSVHLLYSLLGLAALIAASEGIMSAIRYLGGGYLIYLGIKGVRARSVNFEHGVAESASKPKPWKSVALGFGCNLFNPKAPLYFLSLFTVVLSPCMPLSWWLGYGVWIMGLQMGWFSLLVYGISHTKVRRMLGRFGGWIERLLGGAMIFLGLKLWVSR

SEQ ID NO: 101628 - DNA, 627 bp, Photorhabdus luminescens
  CDS (1)..(627)
atgctagaagtgtcccaaatagtaacctatacagcggcattgactgttgctgcggcgataccaggcccgggaatggcagcattggttgccagaagtgtgagtaatggcgcgttagcgggatttagtgtgttgtttggcctgattattggtgatctcacttatttatcctttgcggtttttggcttgtccattatcgcgagcagttttgacaccttatttgttgtggtgagatggggtgccgcattatatttgggttatctggcgtggcagttctggtttgccgatcatcaatccattggtgaagaccaacccattaagaaaaaagagttggctgcggcttggttatctggtctcactctaacattaagtaaccctaaaacgatcgccttctatctcgcactattacctttggtgattaacatggaatctatctcgttgcaaaactgggggctcatgttagtaccactgacggtttttgtcttattcagcgtaggagcggtatttattctcggcgctctcagtattcgacatctgttatcaagccaacgggcacaacggattttatttaaaggcgcggctattattatgttcgtaaccgctgtaactatgctgttcaaatccaattaa

SEQ ID NO: 101629 - protein, 208 aa, Photorhabdus luminescens
MLEVSQIVTYTAALTVAAAIPGPGMAALVARSVSNGALAGFSVLFGLIIGDLTYLSFAVFGLSIIASSFDTLFVVVRWGAALYLGYLAWQFWFADHQSIGEDQPIKKKELAAAWLSGLTLTLSNPKTIAFYLALLPLVINMESISLQNWGLMLVPLTVFVLFSVGAVFILGALSIRHLLSSQRAQRILFKGAAIIMFVTAVTMLFKSN

SEQ ID NO: 101630 - DNA, 636 bp, Photorhabdus luminescens
  CDS (1)..(636)
atgtataactattggggggaatttctaggactggcggtgattcattttctggcagtagtagcaccggggccagatttcgcggttaccatacgacaaagtgtgaggtttggtcgctgggctgggatgtgtacggcagtgggtatcggagcgggaatatcagtacatgtcatctatacactagtgggggttagtgcattaatgcataccactccgtggttaatggaattagcaaaacttgttggcggaacttacatcatatggctcggtatcaaatttatcaggagtaagcctaccgatttggctgtcttagagaatgagggaattgttcaagcttcacagagtagatggaaagcatttctgatggggtttatgacaaacgcccttaatcctaaggcgacgttgttctttttggccgttttcacgactgtggtgagtagcaatacacctatcctgatacaaatgttttatggggtttggatgtgtgtggtcaatgcggtatggtttgtattggtcagtgttattttttctaatacattgattcgtaataaatttatacggaaagggtattggttcgagcgggtgatgggactggtgctgatcggatttgctgttcggttattatttatgtctgtttga

SEQ ID NO: 101631 - protein, 211 aa, Photorhabdus luminescens
MYNYWGEFLGLAVIHFLAVVAPGPDFAVTIRQSVRFGRWAGMCTAVGIGAGISVHVIYTLVGVSALMHTTPWLMELAKLVGGTYIIWLGIKFIRSKPTDLAVLENEGIVQASQSRWKAFLMGFMTNALNPKATLFFLAVFTTVVSSNTPILIQMFYGVWMCVVNAVWFVLVSVIFSNTLIRNKFIRKGYWFERVMGLVLIGFAVRLLFMSV

SEQ ID NO: 101632 - DNA, 630 bp, Chromobacterium violaceum
  CDS (1)..(630)
atgcccaccttgtccactctgctgctgttctccctcgcctgtctcgcgctggccgccacgcccggccccgacatgctgctgatcgccagccgcagcgcagggcagggcctgcgcgccggcttcgccaccttgttcggcatccagctgggcacctattgccacgcgctgctggcggcgctgggtctggcccagctgttcgtgctggtgccggtggcctacgacgcggtgcgcgtcgccggcgccgcctacctgctttacctggcctggaccaccttgcgcagcaacagcgtgctgcgcgcggccgatcccgccgccgccaaccggccgctggcgcgcatcgcgctgcaggggctgaccaccaatctgctcaatcccaagatggcgctgttcgtgctggcgctgtttccgcagttcgtcgagccgcaggccggtccggtggcgctgcagattatgttgctggctacggtactgaacgcggtcggctttgtcgtcaacgcgctggtgatcgtcgccagcagccgcatgggccggatgctggccggcggcgcgagcgggcgctggccgcaatacctgctggcgacggtgtttggcgggctggctgtgcgcctgctggcggcggggcagaaataa

SEQ ID NO: 101633 - protein, 209 aa, Chromobacterium violaceum
MPTLSTLLLFSLACLALAATPGPDMLLIASRSAGQGLRAGFATLFGIQLGTYCHALLAALGLAQLFVLVPVAYDAVRVAGAAYLLYLAWTTLRSNSVLRAADPAAANRPLARIALQGLTTNLLNPKMALFVLALFPQFVEPQAGPVALQIMLLATVLNAVGFVVNALVIVASSRMGRMLAGGASGRWPQYLLATVFGGLAVRLLAAGQK

SEQ ID NO: 101634 - DNA, 651 bp, Chromobacterium violaceum
  CDS (1)..(651)
atgttgggcattaccgaccttaccacctacctgatcggcacgctgatcgtgatcctgctgccgggcccgaacgccatgtacgtgttgtcggtggcggcgcagcgcggcaagcgcgcgggcttcgccgccgccggcggcgtggtcagcggcgacttcatcctgatgacgctggcggccaccggcgcggccggcctgctgcaggccaacccggcgttgttcgcggtggtcaagtacatcggcggcggctacctggcctggctgggcgtcaacatgctgaagtccggcatcctggcctggcgccgcgcgcgccgcggcgacgagtcgccgacgaggccgtcggcgctgtccggcggccatccttaccgcaaggcgctgctgatcagcctgatgaacccgaaggccatcctgttcttcgtgtccttcttcgtgcagttcgtcgatccggtctacccgcatccggcggtcaccttcgccgcgctgggcgccatcgtccagtgctgcagcatcgccaacctgtcgatgctgatcctgctgggcgacaagctggccgcggccttccgccgccgccgcaagctgacggcggcgctgggcggctcggtgggcgcggttttcgtcgggttcggggccaagctggcggcggccagcctgtaa

SEQ ID NO: 101635 - protein, 216 aa, Chromobacterium violaceum
MLGITDLTTYLIGTLIVILLPGPNAMYVLSVAAQRGKRAGFAAAGGVVSGDFILMTLAATGAAGLLQANPALFAVVKYIGGGYLAWLGVNMLKSGILAWRRARRGDESPTRPSALSGGHPYRKALLISLMNPKAILFFVSFFVQFVDPVYPHPAVTFAALGAIVQCCSIANLSMLILLGDKLAAAFRRRRKLTAALGGSVGAVFVGFGAKLAAASL

SEQ ID NO: 101636 - DNA, 624 bp, Chromobacterium violaceum
  CDS (1)..(624)
atgacctggaccatttggctgcaattcgccggcgtgtgcatgctgggcgcgatgtcgcccggccccagcctggcgatggtattgcagcagaccgcccgcggcggacgcggcggcggcctggccgccgcgatgggccacgcgctgggcgtgggcctgtacgcgttggccgccgcccaggggctggcgatggtgatggcggcacatccgctgctgttcaagatcatctccagcctcggcgccgcctatctggtgtggctgggcgtgcagggcctgcgggcggcgtcccgcccggcgcgggccgccagcggcgaaaccgccgccgccgcgccgacctcggcctggcgcgccgcgcgcaccggcctggccgtgtcgctgtccaaccctcatttggcggtgatgttcgtcgccctgctcagccagttcgtcactgccgacatgcccgccagcggccaagcgctgctgatcgccaccgcgatggggctggacttcggctggtacgcgctgctgacgctgctgatttcccacccgtccatcctgagcggcctgcaccgcaagagccggtggatagacggctgcggcggcgcgctgatgctgctgctgggcctgcgcatcctagtggtgtga

SEQ ID NO: 101637 - protein, 207 aa, Chromobacterium violaceum
MTWTIWLQFAGVCMLGAMSPGPSLAMVLQQTARGGRGGGLAAAMGHALGVGLYALAAAQGLAMVMAAHPLLFKIISSLGAAYLVWLGVQGLRAASRPARAASGETAAAAPTSAWRAARTGLAVSLSNPHLAVMFVALLSQFVTADMPASGQALLIATAMGLDFGWYALLTLLISHPSILSGLHRKSRWIDGCGGALMLLLGLRILVV

SEQ ID NO: 101638 - DNA, 618 bp, Chromobacterium violaceum
  CDS (1)..(618)
atgctgtccctgtccgtactgtcgctctaccttgccgccctggtcgccgtctatgtcctgcccggaccggacatggccctggtgatggccacatcggcgagccgtggcgtcggcgccggcctgttgaccgcgctcggcatcgccgcctcgcgcttcctgcatgtgatgatgtccggcctggggctggccgccctgatggcgacccacccgctgctgttcgacgcggtgcgctggataggcacggcctatctgctgtggctggcatggaaggtggtgcgcgcccagcctgcgccggaaggcgcgcccacggtgacggaatcgggccgcgcggcgatcgcgcgcggctttctgaccaatctgctcaaccccaaggccttgatgttctgcgcgctgttcctgcctcagttcgtgtcgccggcgcacggcgcggtgctgccgcaattcgcgctgctcgcggccatcctggtggcggtcgggctgtgtttcgacaccgcctatgccttcgccgcctgcggcctcgcccgccgcctgaaaggccgccgcgccacggcgaaactgcagaaaggcttgctcggcggcgtgttcgtggcgatggctgggcggttgcttctcggctga

SEQ ID NO: 101639 - protein, 205 aa, Chromobacterium violaceum
MLSLSVLSLYLAALVAVYVLPGPDMALVMATSASRGVGAGLLTALGIAASRFLHVMMSGLGLAALMATHPLLFDAVRWIGTAYLLWLAWKVVRAQPAPEGAPTVTESGRAAIARGFLTNLLNPKALMFCALFLPQFVSPAHGAVLPQFALLAAILVAVGLCFDTAYAFAACGLARRLKGRRATAKLQKGLLGGVFVAMAGRLLLG

SEQ ID NO: 101640 - DNA, 636 bp, Chromobacterium violaceum
  CDS (1)..(636)
atgctcgtcaccctgccgcaactggccgcctttctcgctgccgccatgctgatcaccgtcacccccgggcccgacaacctgatggtgctgagccagggcatctcccgcggccgccgccagggcatggccttcggcctgggctgcgcgctgggttgcctgaaccacacgctgctggccgcgctgggcgtcagcgcgctgatcgccgcctcgccgctcgccttcgccgcgctcaagatcgccggcggcgcttacctggtttacctgggctggggcgccatacgcagctccggcgccagcttcgacgcggacgcccaggtcggcggcccccagggatcgctggccgccaccttccgccgcggcctgatcgccaacgcgatcaatcccaaggtggtgctgttcttccttgccttcctgccgcagttcgtcaatccggcgcaaggccctgtcggcctgcagaccgccatcctgggcgcgctgttcacgctgcagggcgcgctgatcttcggcgcgcttggctatttttccggccacgtctgccagtggctggcgaaaagccgcaaagccagccagcggcttgatcgcgtggccggcaccgttttcatcgcgctgggcctgcgcctgattctggcgcgctga

SEQ ID NO: 101641 - protein, 211 aa, Chromobacterium violaceum
MLVTLPQLAAFLAAAMLITVTPGPDNLMVLSQGISRGRRQGMAFGLGCALGCLNHTLLAALGVSALIAASPLAFAALKIAGGAYLVYLGWGAIRSSGASFDADAQVGGPQGSLAATFRRGLIANAINPKVVLFFLAFLPQFVNPAQGPVGLQTAILGALFTLQGALIFGALGYFSGHVCQWLAKSRKASQRLDRVAGTVFIALGLRLILAR

SEQ ID NO: 101642 - DNA, 612 bp, Chromobacterium violaceum
  CDS (1)..(612)
atggccgcggcgttcgcggtgtatctggttgggacggcgagcccggggcccagcaatctggccatcatgggcgtggcgatggagcaggggaggagccgagccttgtcgctggcggcgggcgtggcgctgggctctgtctgctggggcgtgttcgccgctttgggcttcgcggaattgatgcggggcagcctggcgttggcgtggtgcttgaagctgttgggcggcgcctacctgctgtatctggcctggcagtctgccaggcaggcggcttgcgccgccgatgccgcgggggaagggcggcggctggccgggctgtcgcatggacaggcgctgcggcgggggctgctgatgcatctgggcaaccccaaggccatcttggtttggctgtcgctggtgtcgctggcctctcccgcctccggcgggggagagcatggcgcgcgggtggtggcgggctgcgcgctgattgctgtctgcgtgtttgcttcctatgcgctgctgttctccaccgccgccgcgcggcgggcctatctgcggctgaggcgatggctgcatggcgcgctggcgctggctttcgcttacgcgggcgtcaggatgctgaggggaggggcgtga

SEQ ID NO: 101643 - protein, 203 aa, Chromobacterium violaceum
MAAAFAVYLVGTASPGPSNLAIMGVAMEQGRSRALSLAAGVALGSVCWGVFAALGFAELMRGSLALAWCLKLLGGAYLLYLAWQSARQAACAADAAGEGRRLAGLSHGQALRRGLLMHLGNPKAILVWLSLVSLASPASGGGEHGARVVAGCALIAVCVFASYALLFSTAAARRAYLRLRRWLHGALALAFAYAGVRMLRGGA

SEQ ID NO: 101644 - DNA, 630 bp, Chromobacterium violaceum
  CDS (1)..(630)
atgtcctggcaaacctggctgttgttcgtcaccaccgtgttcttcgtctccgccacgcccggccccaacatgctgctggcgatgacgcatggcatccattacggcgtgcgccgcacgctgatgacctgcttcgggctgatgacggcgctgggcctgatcatgctggggtcggtggccggcctcggcgcgctgctggcgacgtccgaactcttgttctccatcgtcaagtacgccggcgcgctgtacctggtctacctgggcgtcaagacctggcgcagcctgccgcagccggtggccgagctgcgcgaggacgacagcggcaggcacggcccgtgggcgttgttccgccgcggcttcctggtggccatgagcaaccccaaggccttcatcttcttcaccgcgctgtttccccagttcatgaacgcgcaccagccgcaggggccgcagctggccatcctggcggccacgttttacctgatagagtcctgctggcagctgacctatgccagcagcggcgcccggctcgcgcgctggctgaacagcgcgcggcggctgcggctggtcaaccgcttcagcggcggcgccttcgtcggcgccggcctgctgctgaccggcctgtctcgacaataa

SEQ ID NO: 101645 - protein, 209 aa, Chromobacterium violaceum
MSWQTWLLFVTTVFFVSATPGPNMLLAMTHGIHYGVRRTLMTCFGLMTALGLIMLGSVAGLGALLATSELLFSIVKYAGALYLVYLGVKTWRSLPQPVAELREDDSGRHGPWALFRRGFLVAMSNPKAFIFFTALFPQFMNAHQPQGPQLAILAATFYLIESCWQLTYASSGARLARWLNSARRLRLVNRFSGGAFVGAGLLLTGLSRQ

SEQ ID NO: 101646 - DNA, 627 bp, Bordetella parapertussis
  CDS (1)..(627)
atgctgcctttcgacaccttgaccgcgtttttcggcatcgccgtcctgctggcgctgacgcccggcccggacaatctgttcgtgctgatgcaatcggccatctggggccgggccgcggggctgttcgtcgtgctggggctatgcaccggcctgctgggccacaccgccgcggtggcggtcgggctggccgccgtattcgccgcctcgccggccgccttcacggcgctgaagctggcaggggccgcctacctggcctacctcgcctggcaggtattgcgcgcgcccgcgggcggcggcggcggacagcggcccgagccgctggcgcgcggcgcgctgtaccggcgcggcatcatcatgaacctcgccaatcccaaggtgctgttgttcttcttcgcgttcctgccccagttcacgcggcccgaggctgggcccatgggctggcagatcgtcgagctgggtgcggtcttcatgctggccacgctgctggtgttcggcgcgatcgccgtgttctcgggcggcttcggccgcttgctgcagcgctcggcgcgcgcccagcgctggctcaaccgcctggccgggctggtattcatcggcctggcgctgcggctggcaaccgccagccgctag

SEQ ID NO: 101647 - protein, 208 aa, Bordetella parapertussis
MLPFDTLTAFFGIAVLLALTPGPDNLFVLMQSAIWGRAAGLFVVLGLCTGLLGHTAAVAVGLAAVFAASPAAFTALKLAGAAYLAYLAWQVLRAPAGGGGGQRPEPLARGALYRRGIIMNLANPKVLLFFFAFLPQFTRPEAGPMGWQIVELGAVFMLATLLVFGAIAVFSGGFGRLLQRSARAQRWLNRLAGLVFIGLALRLATASR

SEQ ID NO: 101648 - DNA, 645 bp, Bordetella parapertussis
  CDS (1)..(645)
atgcgtgccgccatgcccgaaccgacccaactgcttgccttcgccctgatctgcctgggcatgacgctcacgcccggccccaacatgatgtacctggtgtcgcgctcgctgtcgcagggctaccgcgccgggctggtttcgctggccggcgtggcgctcgggctggtgttctacgtgctgtgcgccgtgctgggcatcacggcgctgctgatggcggtgccgctggcctacgaagcgctgtgcgtggccggcgccatctacctgatgtacatggcctggcaggcgctgcgcccgggcgggcagtcgccattccaggtgcgcgccctggcgcccagcccgccgcgccgcctgttcgccatggggctgttcaccgccctgctcaatcccaagatcgccgtgctgtacctgtcgctgctgccgcagttcatcgacccgcagcaaggcagcgtcctgacccagtcgctggccctgggcttcacccaggtcggcatcagcatctgcgtcaacgcgctgttcaccgtcatggctggcgccatcgcggtattcctggcgcgccggcccatgtggatggtggcgcagcgctggctgatgggttcggtgctggccggcctggcggtgcgcatggccctggacgcccgccgctga

SEQ ID NO: 101649 - protein, 214 aa, Bordetella parapertussis
MRAAMPEPTQLLAFALICLGMTLTPGPNMMYLVSRSLSQGYRAGLVSLAGVALGLVFYVLCAVLGITALLMAVPLAYEALCVAGAIYLMYMAWQALRPGGQSPFQVRALAPSPPRRLFAMGLFTALLNPKIAVLYLSLLPQFIDPQQGSVLTQSLALGFTQVGISICVNALFTVMAGAIAVFLARRPMWMVAQRWLMGSVLAGLAVRMALDARR

SEQ ID NO: 101650 - DNA, 747 bp, Bordetella bronchiseptica
  CDS (1)..(747)
atgcgaagcgtaccgcaccccgtcattaccgcgggcaatcagctcatgcggcagcgggtttgcccgtatgatgccagtgacggcccgccacgggcgggcgcttgccctcgagccgccaccatgctgcctttcgacaccttgaccgcgtttttcggcatcgccgtcctgctggcgctgacgcccggcccggacaatctgttcgtgctgatgcaatcggccatctggggccgggccgcggggctgttcgtcgtgctggggctatgcaccggcctgctgggccacaccgccgcggtggcggtcgggctggccgccgtattcgccgcctcgccggccgccttcacggcgctgaagctggcaggggccgcctacctggcctacctcgcctggcaggtattgcgcgcgcccacgggcggcggcggcggacagcggcccgagccgctggcgcgcggcgcgctgtaccggcgcggcatcatcatgaacctcaccaatcccaaggtgctgttgttcttcttcgcgttcctgccccagttcacgcggcccgaggccgggcccatgggctggcagatcgtcgagctgggcgcggtcttcatgctggccacgctgctggtgttcggcgcgatcgccgtgttctcgggcggcttcggccgcttgctgcagcgctcggcgcgcgcccagcgctggctcaaccgcctggccgggctggtattcatcggcctggcgctgcggctggcaaccgccagccgctag

SEQ ID NO: 101651 - protein, 248 aa, Bordetella bronchiseptica
MRSVPHPVITAGNQLMRQRVCPYDASDGPPRAGACPRAATMLPFDTLTAFFGIAVLLALTPGPDNLFVLMQSAIWGRAAGLFVVLGLCTGLLGHTAAVAVGLAAVFAASPAAFTALKLAGAAYLAYLAWQVLRAPTGGGGGQRPEPLARGALYRRGIIMNLTNPKVLLFFFAFLPQFTRPEAGPMGWQIVELGAVFMLATLLVFGAIAVFSGGFGRLLQRSARAQRWLNRLAGLVFIGLALRLATASR

SEQ ID NO: 101652 - DNA, 624 bp, Bacillus cereus
  CDS (1)..(624)
atgagtacattggtagcttttgcaattgtttcgcttagcatggtttgttcacctgggcctaatatgatttacctcatttcccgttccattacgcaaggacgtatggcgggatttatttctttattgggcatcatgctcggatttgtaatctatataatcgcaactatgtttggacttacagttctattcgttgctgttcccgctgtatatgaagcagtaaagtgggcaggtgctgcttacttactctggctcgcctggaattcgattaaaccgggtgctacatctattatggaacctcgtatgatttctaatgagccaccaaggaaattatttctgatgggactcatgacgaatcttctgaatccaaagattgctattttgtatgtatcacttctacctcaatttgaagatccagagaagggatcgttgctttttcaaggtgcagttttgggacttgcgcaaatcactgttagctttatagttaaccttgtaattgtatgtacagcaagtaaaattgcaaaatggtttggcacacgcccaacgtggttacgagtgcagcgttggcttatggcaagtgttttaacggggcttgctgtacgtcttgcttttgaacgtcgacagtaa

SEQ ID NO: 101653 - protein, 207 aa, Bacillus cereus
MSTLVAFAIVSLSMVCSPGPNMIYLISRSITQGRMAGFISLLGIMLGFVIYIIATMFGLTVLFVAVPAVYEAVKWAGAAYLLWLAWNSIKPGATSIMEPRMISNEPPRKLFLMGLMTNLLNPKIAILYVSLLPQFEDPEKGSLLFQGAVLGLAQITVSFIVNLVIVCTASKIAKWFGTRPTWLRVQRWLMASVLTGLAVRLAFERRQ

SEQ ID NO: 101654 - DNA, 633 bp, Bacillus cereus
  CDS (1)..(633)
atgatagaaaattatcttcttttcatcattatgtctatttgccttatcattttacctggtccagatacagcaatggctacgaaaaatacattggttgctggtaaagtcggtggagtgaaaacagtgtttggtacatgtattgcactattaattcatactttagctgctgtaattggtctttctgcacttattgtaaagtcagctcttttattttctattttcaagtacgttggggctctctatttaatatatatcggtattaaagcccttttagcagtaagaaacaaagaaaacttagatacaaatgatctatctttgaataatgaaaacgaacatacttcttgctttcgccaaggatttcttacaaatttattaaaccctaaagtagcagtcttctttttaacttttttaccacaatttttaaatccaaatcataatacatttattcaacttcttgtaatgggccttacttacctcgttttaacagtcatttggtttgcattttatatatttttaattgataaaattagtgcttttatgaaaaaaccgaagacgcaacgttatattcaagggctaacaggagtcgtcctaattggatttggtattaaactagcttttgaaaaaaataattaa

SEQ ID NO: 101655 - protein, 210 aa, Bacillus cereus
MIENYLLFIIMSICLIILPGPDTAMATKNTLVAGKVGGVKTVFGTCIALLIHTLAAVIGLSALIVKSALLFSIFKYVGALYLIYIGIKALLAVRNKENLDTNDLSLNNENEHTSCFRQGFLTNLLNPKVAVFFLTFLPQFLNPNHNTFIQLLVMGLTYLVLTVIWFAFYIFLIDKISAFMKKPKTQRYIQGLTGVVLIGFGIKLAFEKNN

SEQ ID NO: 101656 - DNA, 633 bp, Bacillus anthracis
  CDS (1)..(633)
atgattgaaaattattttcttttcatcattatgtctatttgtcttattattttacccggccctgatactgcaatggctacgaaaaacacattagttgctggtaaagtgggcggagtgaaaacagtgttcggtacatgtattgcactattgatccatactttagcagcagtaatcggtctttctgcacttattgtaaagtcagctcttttattttctattttcaagtacgttggagctctatatttaatttatattggtattaaagcccttttagcagtaagaaataaagaaggcgtcgatacgaacgatatttctttgcataatgaagacgaacacacttcttgctttcgtcaagggtttcttacgaatttattaaaccctaaagttgcagtcttctttttaacatttttaccgcaatttttaaatccaaatcataatacgtttatccaacttctcgtaatgggccttacttacctcattttaacagttatatggttcgctttttatatatttttaattgataaaattagtgcttttatgaaaaaaccgaagacacaacgttatattcaagggttaacaggaattgtcttaattggttttggaattaaactagcttttgaaaaaagcaattaa

SEQ ID NO: 101657 - protein, 210 aa, Bacillus anthracis
MIENYFLFIIMSICLIILPGPDTAMATKNTLVAGKVGGVKTVFGTCIALLIHTLAAVIGLSALIVKSALLFSIFKYVGALYLIYIGIKALLAVRNKEGVDTNDISLHNEDEHTSCFRQGFLTNLLNPKVAVFFLTFLPQFLNPNHNTFIQLLVMGLTYLILTVIWFAFYIFLIDKISAFMKKPKTQRYIQGLTGIVLIGFGIKLAFEKSN

SEQ ID NO: 101658 - DNA, 627 bp, Bacillus anthracis
  CDS (1)..(627)
atggaaaattatttattgtttatccttacagcaatgctaattataataatgcctggtcctggtttcgcactagttacaaaaaatactatctcgtatggcacaaatggtggaataaagactgtcttaggaacgatatctggaatgatgattcatacaataatggctacgctaggactctcggccattctaatgaaattttctatgttatttatatttattaaatatgctggggctttgtatttaatttacttagctatcaagtcaattaaaagtgccttttctaaaaaagaagatatgcaagtttcggtggaaatgaacgctaaggatattgggacgattaaaagttttagacaaggatttacaacggcaatcttaaacccaaaaacggctgtatttttcttaagctttctcccacaatttattgtgaataatcaaagtcatttcttccaatttcttttgttaggactcacatttacgactttgaccgcaatatggtatttgctttatatctcgctaatacgtcaattaagaacttttttaagaaaagaaagagtgaaccgtacaatagagggtattacgggcgcagtattattagtatttggggttagattatttttccaaaaataa

SEQ ID NO: 101659 - protein, 208 aa, Bacillus anthracis
MENYLLFILTAMLIIIMPGPGFALVTKNTISYGTNGGIKTVLGTISGMMIHTIMATLGLSAILMKFSMLFIFIKYAGALYLIYLAIKSIKSAFSKKEDMQVSVEMNAKDIGTIKSFRQGFTTAILNPKTAVFFLSFLPQFIVNNQSHFFQFLLLGLTFTTLTAIWYLLYISLIRQLRTFLRKERVNRTIEGITGAVLLVFGVRLFFQK

SEQ ID NO: 101660 - DNA, 654 bp, Streptomyces avermitilis
  CDS (1)..(654)
atgtttggtgtcaccgatctccccacctacctcgcaggccttgtcctgatcgtcctgctccccggtccgaactcgctgtacgtgttgtccgtcgccgcccgcaagggcgtacgcgccggatacacggcagccgcgggcgtctggtgcggtgacaccgtgctgatgacgctgtccgcggccggagtcgcctcgctgctccaggcgaacgccctgctgttcgggatcgtgaagtacgccggggccgggtatctgacctggctcgcgttcggcatgctgcgggccgcgtgggagatgtggcggacccgccgggaccgggcggacgcggcccgggcacccgtcgcgccggtcgccggagagcggcccttccggcgggcgttcgtcgtcagcctcttcaacccgaaggcgatcctgttcttcgtcgccttcttcgttcagttcgtcgacccggggtacgcctacccggccctgtccttcgtcgtcctcggcgccttcgcccagctggcgagcttcctgtacctcaccgcgctgatcttcagcggcacgaagctggcggccgccttccgccgacgcaagcggctctccgcgggggccacgaccgccgcgggcgccctcttcctgggcttcgccgtgaagctgacactggccggcgcctag

SEQ ID NO: 101661 - protein, 217 aa, Streptomyces avermitilis
MFGVTDLPTYLAGLVLIVLLPGPNSLYVLSVAARKGVRAGYTAAAGVWCGDTVLMTLSAAGVASLLQANALLFGIVKYAGAGYLTWLAFGMLRAAWEMWRTRRDRADAARAPVAPVAGERPFRRAFVVSLFNPKAILFFVAFFVQFVDPGYAYPALSFVVLGAFAQLASFLYLTALIFSGTKLAAAFRRRKRLSAGATTAAGALFLGFAVKLTLAGA

SEQ ID NO: 101662 - DNA, 621 bp, Shigella flexneri
  CDS (1)..(621)
atgttgatgttatttctcaccgtcgccatggtgcacattgtggcgcttatgagccccggtcccgatttcttttttgtctctcagaccgctgtcagtcgttcccgtaaagaagcgatgatgggcgtgctgggcattacctgcggcgtaatggtttgggctgggattgcgttgcttggcctgcatttgattatcgaaaaaatggcctggctgcatacgctgattatggtaggcggtggcctgtatctctgctggatgggttaccagatgctacgcggtgcactgaaaaaagaggctgtatctgcgcctgcaccacaggttgagctggcgaaaagcgggcgcagtttcctgaaaggcttactgaccaatctcgccaatccgaaagcgattatctattttggttcggtattctcattgtttgtcggcgataacgttggcactaccgagcgctggggcattttcgcgttgattattgtcgaaacactggcgtggtttaccgtcgttgccagtctgtttgccctgccgcaaatgcgccgtggttatcaacgtctggcgaagtggattgatggttttgccggggcgttatttgccggatttggcattcatttgattatttcgcggtga

SEQ ID NO: 101663 - protein, 206 aa, Shigella flexneri
MLMLFLTVAMVHIVALMSPGPDFFFVSQTAVSRSRKEAMMGVLGITCGVMVWAGIALLGLHLIIEKMAWLHTLIMVGGGLYLCWMGYQMLRGALKKEAVSAPAPQVELAKSGRSFLKGLLTNLANPKAIIYFGSVFSLFVGDNVGTTERWGIFALIIVETLAWFTVVASLFALPQMRRGYQRLAKWIDGFAGALFAGFGIHLIISR

SEQ ID NO: 101664 - DNA, 615 bp, Vibrio parahaemolyticus
  CDS (1)..(615)
atgacactaacagtttggttatcactttttacagtctgtttattaggggctatgtcgccagggcctagcttagcgatcgttgctaaacatgctttggctggtggacgaatgaatggtttggcaacggcatgggcgcatgcttttgggatcggaatttatgcgtttatcacgttgatcggtcttgcggttgtgctgcagcagagcccaatgctgttcaaaaccatcagtttagcgggcgcagcttatttggcttacttaggttttaacgcgctgcgatccaaaggtggagtggccgccaagttggaatctggggaggaaacgaccgtacttcaatctgctagagaaggtttccttatctctattctaagtcctaaaatcgcactgttctttattgctttgtttagccagtttgtcgcgcttggaaatgatctgagtaaccaaatgatcattgttgcgaccccttttgttgtcgatggcttgtggtacacctttattacgttggtgttatcaagctccagagtggtcgataaaattcgctccaaagcggttctcattgaccgactatctggcgttgttcttatgctcttagcactaagagtggtggttacggtttag

SEQ ID NO: 101665 - protein, 204 aa, Vibrio parahaemolyticus
MTLTVWLSLFTVCLLGAMSPGPSLAIVAKHALAGGRMNGLATAWAHAFGIGIYAFITLIGLAVVLQQSPMLFKTISLAGAAYLAYLGFNALRSKGGVAAKLESGEETTVLQSAREGFLISILSPKIALFFIALFSQFVALGNDLSNQMIIVATPFVVDGLWYTFITLVLSSSRVVDKIRSKAVLIDRLSGVVLMLLALRVVVTV

SEQ ID NO: 101666 - DNA, 612 bp, Vibrio parahaemolyticus
  CDS (1)..(612)
atggaatttgtaactcttgcgctattgggtgtgcttattgttattagccctggcgcagactttgttttggtattaagaaacagcttaaatcaaggacgagaagctggcgtgtacagtgcgattggtatcagcatggcgataagcatccacatcgcttactccatgctggggatcagttacttaatttcacaaaatgaatggttgtttaatctcgtgcgctatcttggggctgcttatcttgtctaccttgggattaaaggaatattctcctcgcagcctgcgtcaaactcagaaaccattcaacagagcgagtattcaatgtggcgatttttcatgcagggatttctgtgtaatttactcaatcctaagacgatgctgttttttctgagtatttttagccaagtgatttctcccgattctagtcagcaacatatcgccttgttttacgggatttatatgattgcgctgcacggcatttggttttctatcgttgcagttttattcacgtccctccaattacaagccttcttgttaaagattaagcatcgactcaatcaagcatgtggggcgggtttggtcattttcggcgcgatgctgggcttaaaggcttaa

SEQ ID NO: 101667 - protein, 203 aa, Vibrio parahaemolyticus
MEFVTLALLGVLIVISPGADFVLVLRNSLNQGREAGVYSAIGISMAISIHIAYSMLGISYLISQNEWLFNLVRYLGAAYLVYLGIKGIFSSQPASNSETIQQSEYSMWRFFMQGFLCNLLNPKTMLFFLSIFSQVISPDSSQQHIALFYGIYMIALHGIWFSIVAVLFTSLQLQAFLLKIKHRLNQACGAGLVIFGAMLGLKA

SEQ ID NO: 101668 - DNA, 660 bp, Vibrio parahaemolyticus
  CDS (1)..(660)
atgaatgaatccactatcctgctgacattggccagcattcactttattgccttaatgagcccaggccccgacttcgcattagtggtgcaaaatgccacgcgtcatggtcgccagacgggcttatacatcgctcttggcttatccgttggtattttgctgcactcattgttcagcctgactggtgtgagctaccttgtgcatcaacatcctttgctgtattcggtattacaactgctaggtggcagttacctactttacctcggtgttggggccctgcgcggcgtgatcgctacgatcaaaaacccgcaaacggatcaacaaaataaaacaaacagcttcgtgatcagcaacaaacgtcaggcttttgccaaaggttttgccaccaacattctcaaccccaaagcactggttttcttcatcagcttgatgtcgagcttggtgcccgccggaatgtcggtctcaggcaaaagcatcgcgttagttatcctgttcagcttgtctctggtttggttttcgagcttggcgtggatgctctcaacgcaacgtttacaacgtcgattacaacaagcaggcatctacatcgatggcatttgtggtgtggtgtttaccctcgttggcggcagtatcttagtgcaaactatcagcacgttaatcggttaa

SEQ ID NO: 101669 - protein, 219 aa, Vibrio parahaemolyticus
MNESTILLTLASIHFIALMSPGPDFALVVQNATRHGRQTGLYIALGLSVGILLHSLFSLTGVSYLVHQHPLLYSVLQLLGGSYLLYLGVGALRGVIATIKNPQTDQQNKTNSFVISNKRQAFAKGFATNILNPKALVFFISLMSSLVPAGMSVSGKSIALVILFSLSLVWFSSLAWMLSTQRLQRRLQQAGIYIDGICGVVFTLVGGSILVQTISTLIG

SEQ ID NO: 101670 - DNA, 636 bp, Vibrio parahaemolyticus
  CDS (1)..(636)
atgttggagcaatacttatttctactgccaatcgctacgctgttactcattggcgcgatgacaccaggcccttcatttatcttggttgcgcaaacagccatatcaaaatctagatctgaagccatgtgtatttctataggtttaggtttgggggcaagtaaatttgcatttattgcctcaatggggctcattacactttttgacgcagtgcctgagttttacgtagcattcaaaattcttggtggtctatatctatgttatctgggggtaaaaatgtggcgtgcgagcaaaagcaaagttgtttctgctgacgcagagctaactagcaaaccagctcattttaaggcgatagttcttggcttggcgacacagttaagtaatccaaagactgcaattgtatttagcagtgtgtttgcagccatgttacccgtgaaagttcctgttcatacaacatcaatattagttgttggtgtgtttgtcttaaatttttcttggtacttcctagtttctattttgctatcaagtccaaaggctcaagccagttatttacgatttaagtcctacatcaacaaaggttcaggtgtattaatggggtcaatgggtagtaagtttgttgctgagagtttcgagccctaa

SEQ ID NO: 101671 - protein, 211 aa, Vibrio parahaemolyticus
MLEQYLFLLPIATLLLIGAMTPGPSFILVAQTAISKSRSEAMCISIGLGLGASKFAFIASMGLITLFDAVPEFYVAFKILGGLYLCYLGVKMWRASKSKVVSADAELTSKPAHFKAIVLGLATQLSNPKTAIVFSSVFAAMLPVKVPVHTTSILVVGVFVLNFSWYFLVSILLSSPKAQASYLRFKSYINKGSGVLMGSMGSKFVAESFEP

SEQ ID NO: 101672 - DNA, 636 bp, Vibrio parahaemolyticus
  CDS (1)..(636)
atggacatactaaattttgaagcgtttcttatcgctatcacgattttaacgctgacgccggggctggataccgcattagttcttcgtaatacaagtcgttcgggcttaaaagatgggtgtacaacaagtttaggcatttgttttggcttgtttgtacatgcgtttttctctgccgtgggcatttctgccatccttgcacaatccgcagagctattccaaatcgttaaaatgattggtgccgcgtacctcatttggcttggtatcagcagtttgaaagcgctaatggcatcgggcggaggcattactgtcgctgaacaaattcagcaggtatacagtggaaaacgttcgtttagagagggctttctctcaaatgtactaaacccaaaaacggcagtgttttacttggcatttttaccgcaattcgttaatccggaaggctcaccattgttgcaatctatgacgatggccgctatccattttgttatcgcaatggtttggcaatgtggcttggcaggggctttaaactcagcaaagaacttgctcaaaaatgccagctttatgaaatggatggaaggagtaacaggtgctgtgcttgttgcgctaggaattaagttactgattgaagaaccactttaa

SEQ ID NO: 101673 - protein, 211 aa, Vibrio parahaemolyticus
MDILNFEAFLIAITILTLTPGLDTALVLRNTSRSGLKDGCTTSLGICFGLFVHAFFSAVGISAILAQSAELFQIVKMIGAAYLIWLGISSLKALMASGGGITVAEQIQQVYSGKRSFREGFLSNVLNPKTAVFYLAFLPQFVNPEGSPLLQSMTMAAIHFVIAMVWQCGLAGALNSAKNLLKNASFMKWMEGVTGAVLVALGIKLLIEEPL

SEQ ID NO: 101674 - DNA, 660 bp, Vibrio parahaemolyticus
  CDS (1)..(660)
atggcatcaaaccatgattggaaaggagcgccaatgcaactcgatacttggatttactacactctcgcgatactcgttctcactgcttctcctgggccaagttctctactttgcttaagtaaaggcgtcagcagcggttttcgtctcgcactgacgacggctctaggcagtttaagtgcgattaccatcattcttaccctttcttttaccggtttaggcgttgtgattgcgtcttctgagttcgtgtttaacatcatcaaatggtgtggtgcggcatatttgatttggttaggcattcaagcatttcgatcaaaacaaaacgattttgcgaagtccgactctgcacaggtgtcaaccagccacgtcagtgcctataccagtggttttatcgttggttccagtaatccgaaagccattattttctttacggcactattcccacaattcattgacccaaccgcttcgctgctgacccaatatgcgattttcgcgggtactttcgtagtattcgaattgagctggttaaccttttacgccttattaggggtgaaaacatccaattggttatttgaagcaggacgagctaagttgttcaatcgcttgacgggtggggtgtttatcagtgctggtgtgatgctatctacggcgaatcgcagctag

SEQ ID NO: 101675 - protein, 219 aa, Vibrio parahaemolyticus
MASNHDWKGAPMQLDTWIYYTLAILVLTASPGPSSLLCLSKGVSSGFRLALTTALGSLSAITIILTLSFTGLGVVIASSEFVFNIIKWCGAAYLIWLGIQAFRSKQNDFAKSDSAQVSTSHVSAYTSGFIVGSSNPKAIIFFTALFPQFIDPTASLLTQYAIFAGTFVVFELSWLTFYALLGVKTSNWLFEAGRAKLFNRLTGGVFISAGVMLSTANRS

SEQ ID NO: 101676 - DNA, 645 bp, Pseudomonas syringae
  CDS (1)..(645)
atgtacgaaatcactttgctgattgcactggcgggcgcgttcatcgtgctgatcatcagccccggccccaactttctggtcatcacccagttatcgttcagccagtcgcggcagcagggcatctgcgccggtctgggcgttgcctcgggcagcattctctgggcgctgctggcagccaccggattaggcctggtgtttgagcaattgccttggttgcaaccggccttgcaactgcttggcggtgcttatctgacctggctaggcaccaaaagcctgcgcagcgcgggcagccagcccaaaccccgggacgtcggcgcgttgggcatcggcagtctgagccgcgcctatcgcttcggcttgctgaccaacctgaccaatcccaaggcgttggcgttttacaccagcgtgttcactaccgtcaccacgccgggcatgccgatgtgggtgcgcactgcgggggtgtcgattatcgccgtgctggcgatctcctggttcgtgctgctggccacgctgttttcgatccctgccgtgcaagcccgctatcagcgaatgaaaaaggccatcgatattgtcaccgggcttttcatgatcgcgttcggcctgcgtttgctgatcggtttgttgcccacgggcgtttttcactga

SEQ ID NO: 101677 - protein, 214 aa, Pseudomonas syringae
MYEITLLIALAGAFIVLIISPGPNFLVITQLSFSQSRQQGICAGLGVASGSILWALLAATGLGLVFEQLPWLQPALQLLGGAYLTWLGTKSLRSAGSQPKPRDVGALGIGSLSRAYRFGLLTNLTNPKALAFYTSVFTTVTTPGMPMWVRTAGVSIIAVLAISWFVLLATLFSIPAVQARYQRMKKAIDIVTGLFMIAFGLRLLIGLLPTGVFH

SEQ ID NO: 101678 - DNA, 633 bp, Pseudomonas syringae
  CDS (1)..(633)
atgtactgggcagaatttcttaccgtcgcactgattcacctgctggccgtcgccagtcccgggcctgattttgcggtggtggtgcgtgaaagcgtgactcatggccgcaaggccggcacctgggcggcgctgggggttggctcggcgatctttgtgcatgtgggctattcgctgttgggcatcgggattatcgtttcccagtccatcgtgctgttcaatgccttgaaatgggcggccgccgcctacctgctgtacatcggcatcaaggccctgcgcgccaaaccggccgcggcgacggacgataccgccatcaaggccgttgccggtgagcgcagcgcacggggtgcctacatcagcggctttgtcaccaatggcctgaaccccaaggcaacgctgtttttcctgtcgttgttcacggtcgtgatcaacccgcacacacccttgctggtgcagggaggctatggcgtctaccttgcggttgcgacggcggcgtggttctgtctggtggcgcggttgttcagtcaggcgcgggtgcgcgccggttttgcacgcatggggcactggttcgatagggccatgggcggcgtgctggtagcgttggggatcaagctcgcgctcaccgaagtgcgctga

SEQ ID NO: 101679 - protein, 210 aa, Pseudomonas syringae
MYWAEFLTVALIHLLAVASPGPDFAVVVRESVTHGRKAGTWAALGVGSAIFVHVGYSLLGIGIIVSQSIVLFNALKWAAAAYLLYIGIKALRAKPAAATDDTAIKAVAGERSARGAYISGFVTNGLNPKATLFFLSLFTVVINPHTPLLVQGGYGVYLAVATAAWFCLVARLFSQARVRAGFARMGHWFDRAMGGVLVALGIKLALTEVR

SEQ ID NO: 101680 - DNA, 633 bp, Pseudomonas putida
  CDS (1)..(633)
atgcccgaagccacgcaactgctcacgttcgccctgatttgcctcggcatggtcctgaccccagggccgaacatgatctacctgatttcccgctcgatctgtcagggccgccaagccgggttgatttcgcttggcggtgtggctctgggcttcgtcatctacatgttctgcgcggcaatgggcatcacggcgctggtgatggcagtaccctttgcctacgacgcgctgcgcatcggtggcgcgctgtacctgttgtacctggcctggcaggcgctgcggccgggtggccaatcgccgttccagctccgtgaactgcccgccgacagcccgcggcggctattcaccatggggtttgccaccagcctgctcaaccccaagattgccgtcatgtacctgtcgctcatgccgcaattcatcgaaccgggccacggcagcgtgctgttgcagtcgctggtgctgggttcgacgcagatcgccatcagcgttacggtcaacgcgctgattacgatcatggccggttccatcgccgtgttcctggctggcaggccgctgtggcaacaggttcagcgttggttgatgggaacggtgctggcggggctggcggtgcgcatgctggcagaagggcgccgttga

SEQ ID NO: 101681 - protein, 210 aa, Pseudomonas putida
MPEATQLLTFALICLGMVLTPGPNMIYLISRSICQGRQAGLISLGGVALGFVIYMFCAAMGITALVMAVPFAYDALRIGGALYLLYLAWQALRPGGQSPFQLRELPADSPRRLFTMGFATSLLNPKIAVMYLSLMPQFIEPGHGSVLLQSLVLGSTQIAISVTVNALITIMAGSIAVFLAGRPLWQQVQRWLMGTVLAGLAVRMLAEGRR

SEQ ID NO: 101682 - DNA, 642 bp, Pseudomonas putida
  CDS (1)..(642)
atggattctcactcgctgttcgcgtttaccctggtcgccgccatcgcgatcgccagcccaggccctgccaccttgatggctatcaacaacagccttgcccatggccaacgcagcgcgatctggtcgtcgctgggcaatggcacgggtctgttctgtctgtcggcagcggccatgctggggctaggcgcactgctggccagttctgaagtactgttcaatgccgtgaagatcctgggggcgggctacctgttctacctgggcgcgcgacaactgctgaagaagagcccgatgctggagcagggggccgcagagcgttcagccaaggtgcggcccacgccgctgaaactgttcaaatcggcctttctcactgcagtgaccaacccgaaggcgaccatgttctttactgcactgttcccgcagttcatcgaccagggggctgcgctgttgccgcagttcctgaccttgaccgggattttcgtggccttgtcgctcacttcgctaagcgcgtatgccgccctggctgcgcgggccaagggggtgctgacccggccgtcgctgtcgcgctgggtgaacagggtggtgggcaccacctttatcggttttggcgcggcgatcctggcgatgcgacggcagggtgcctga

SEQ ID NO: 101683 - protein, 213 aa, Pseudomonas putida
MDSHSLFAFTLVAAIAIASPGPATLMAINNSLAHGQRSAIWSSLGNGTGLFCLSAAAMLGLGALLASSEVLFNAVKILGAGYLFYLGARQLLKKSPMLEQGAAERSAKVRPTPLKLFKSAFLTAVTNPKATMFFTALFPQFIDQGAALLPQFLTLTGIFVALSLTSLSAYAALAARAKGVLTRPSLSRWVNRVVGTTFIGFGAAILAMRRQGA

SEQ ID NO: 101684 - DNA, 615 bp, Pseudomonas putida
  CDS (1)..(615)
atgcaacaattcatgatcatcgccctggcccacttccttgccctgctctcgcctggcccggactttttcctggtcgcacgcaacgcgatcagcagcggctggcgcatcgccagcggcgcctgcctgggcatagcgctggccaatggcgcgttcatcgtcatcgccttcaccgggctttcggtactgcagcaaggcagcctgctgttcagcgccctgcaactggtcggcgccagctacctgctgtacatcggcgtgctgttcctgcgccatgccgggcaaaccagcctgggcacagtcgccggcagccagcgggtgcatggctggtggcgcagtttgggcatgggcttcttgtctggcatcctcaaccccaagaacgcgctgttctatgccagcctggccagcatggtcgccagcgtcagccccggctggaaaacggcctacgcgctatggatgttcagcatcgtcctgctctgggacttgctggtcgccgtggccatcggcaaccagcgggtactgcggcgcttcgcccgcagcctggcgtggctggagcgggcctcgggggtcatgctggtgatgttggcgggggcgttgttgctgcatctggcccggggctga

SEQ ID NO: 101685 - protein, 204 aa, Pseudomonas putida
MQQFMIIALAHFLALLSPGPDFFLVARNAISSGWRIASGACLGIALANGAFIVIAFTGLSVLQQGSLLFSALQLVGASYLLYIGVLFLRHAGQTSLGTVAGSQRVHGWWRSLGMGFLSGILNPKNALFYASLASMVASVSPGWKTAYALWMFSIVLLWDLLVAVAIGNQRVLRRFARSLAWLERASGVMLVMLAGALLLHLARG

SEQ ID NO: 101686 - DNA, 615 bp, Pseudomonas putida
  CDS (1)..(615)
atgaccgaactcatcgccgtcgccctgttcaccctgctcgccgtcatcagccccggcgcggacttcgccatggtcacccgcagcagttatgcgcaggggcgcaaggccgggctggctgctgctgtgggcatcgccctgggggtgcaggtgcatgtgttgtacacggtgttgggcattgccgtgatcatcagccagagcccgacgctgttcttcgtcatgaaggtgctgggtgcgggctacctgatctacctcgggtacaagtcattgaccaacacgcaacgtatcagcctggacggggttggccagtctgctgccagcgtactgcaagcgctgcgcaccggctttttgaccaacgccctcaaccccaagaccatgttgtttgtcatcagtgccttcacccaggtggtgcagcctggcagcccgctggcgctgaacttcgcctacggtgcgttcatgtccgttgcccattggctatggttcagcctggtggcggtatttttctccagtacggcattgcgcagggcgatgatcgagcggcaagtgctggtggacagggccattggtctggcattgatcgggcttggcctggctgtggcggtgaccggaatacgttga

SEQ ID NO: 101687 - protein, 204 aa, Pseudomonas putida
MTELIAVALFTLLAVISPGADFAMVTRSSYAQGRKAGLAAAVGIALGVQVHVLYTVLGIAVIISQSPTLFFVMKVLGAGYLIYLGYKSLTNTQRISLDGVGQSAASVLQALRTGFLTNALNPKTMLFVISAFTQVVQPGSPLALNFAYGAFMSVAHWLWFSLVAVFFSSTALRRAMIERQVLVDRAIGLALIGLGLAVAVTGIR

SEQ ID NO: 101688 - DNA, 675 bp, Clostridium tetani
  CDS (1)..(675)
atgtgtatttataatttaataaaaaggaggaatattattatgtttggaatcataaactatggtgttttcataatttcagttctggcattaaatttaacgccaggggcagacactatgtacatattgggaaacagcatgtcaagaggaaagaaagtaggggtaatgtcagctttaggcattaatactggatgtatcatacatacaattctagcggcattaggtctatcagcaatacttgcaaaatcagcctatgcttttaacattattaaatacctaggtgcaagttacttaatttatcttggtattcgttcattaatatcaaaatcctctatgcttatgaaaaaggataacgataaaaaagatagtcttaaaaaaatatatttccaaggaattataactaatgtattaaaccctaaggtagccctatttttcttagcatttttacctcaatttattaatcctaataatacatatggagcaatcccatttttagtacttggatttacatttgttataatgggaactatgtggtctatgacattagctatattctcatcatatataacaggaaatctaagcaaaaaatttggactagctaattcattaaataaaataacaggaggaatatttattttcttaggattaaatttattgcgagcaaaattgggaaattag

SEQ ID NO: 101689 - protein, 224 aa, Clostridium tetani
MCIYNLIKRRNIIMFGIINYGVFIISVLALNLTPGADTMYILGNSMSRGKKVGVMSALGINTGCIIHTILAALGLSAILAKSAYAFNIIKYLGASYLIYLGIRSLISKSSMLMKKDNDKKDSLKKIYFQGIITNVLNPKVALFFLAFLPQFINPNNTYGAIPFLVLGFTFVIMGTMWSMTLAIFSSYITGNLSKKFGLANSLNKITGGIFIFLGLNLLRAKLGN

SEQ ID NO: 101690 - DNA, 633 bp, Bradyrhizobium japonicum
  CDS (1)..(633)
atgctgggcattcacgaaatctggctcttcatcctgtcgggcgtgctgctcaacatcacgccgggaccggactccgtctacgtcatcggccgcagcatgcagatgggctggcggggcggggctgccgccgccttgggcatcagttgcggctgctttttccacgtcgcaggcgcggcaatcggcctttcggccctgctgatggcctcatctaccgctttttcgatcctgaagctggttggcgcggcctatctggtcgtcacgggacttcagatgctgtggtcgcgcccgacgctggcatcggcgatcgacgagccggcgcggagctcgctgcggcgggtgttcctccagggcgtcttcaccaacgcgctcaatcccaaggtcgcgctgttcttcctggccttcctgccgcaattcgtcgcagccgattctccgcacaagccgctcgccttcctgaccctcggcctgattttcatctgcacgggaacgctgtggtgcctggtgctggcggcgttcgcggcaaaggccgcgcaccgcttgcgggcctccgagggcgcgatcgcctgggtcaaccgcgcgctcggcggcctgttcatctatctcggcgtccgcgtcgccatgctggagacgcggtaa

SEQ ID NO: 101691 - protein, 210 aa, Bradyrhizobium japonicum
MLGIHEIWLFILSGVLLNITPGPDSVYVIGRSMQMGWRGGAAAALGISCGCFFHVAGAAIGLSALLMASSTAFSILKLVGAAYLVVTGLQMLWSRPTLASAIDEPARSSLRRVFLQGVFTNALNPKVALFFLAFLPQFVAADSPHKPLAFLTLGLIFICTGTLWCLVLAAFAAKAAHRLRASEGAIAWVNRALGGLFIYLGVRVAMLETR

SEQ ID NO: 101692 - DNA, 627 bp, Bradyrhizobium japonicum
  CDS (1)..(627)
atgatcgaccactcgaccctcatcacctacatcctcatcgtgctcggttttgtcttcattcccggcccggccacgctgctcaccatggcgcgggccgcaagctccggagcgaaggtgggtatcgcgacgggcgcggggattgcggcgggtgacgtgattcacaccagcatggcgatcgtcggcctctcggcgatcatcgccacttcggcgctcctgttcagcatcgtcaaatatgctggggccgcgttcctgatctatctcggcattcgcgccatgctcgacaaggcaccgatcgagctgaatggcggagcgcccacgatcagcgctggtcgcgcattccgcgaggccgtgctgaccgaggtgctcaatcccaagaccgcgttgttcttcctcgccttcctgccgcaattcgtccggccggaacacggcgcgaccgcgcttcagcttgcggtcctcggcattgtcttcgtgctgctcggcctgttgagcaccgtcgtgttcgccgtgggtgccggtcgtctcggcaatttcctgcgctgccatccggccgtcgtgaagtggcagggcaaggtggttgggaccatctactgcgccgtcggcgtgcggctggcgttgcacgagcgctga

SEQ ID NO: 101693 - protein, 208 aa, Bradyrhizobium japonicum
MIDHSTLITYILIVLGFVFIPGPATLLTMARAASSGAKVGIATGAGIAAGDVIHTSMAIVGLSAIIATSALLFSIVKYAGAAFLIYLGIRAMLDKAPIELNGGAPTISAGRAFREAVLTEVLNPKTALFFLAFLPQFVRPEHGATALQLAVLGIVFVLLGLLSTVVFAVGAGRLGNFLRCHPAVVKWQGKVVGTIYCAVGVRLALHER

SEQ ID NO: 101694 - DNA, 678 bp, Yersinia pestis
  CDS (1)..(678)
atgcaaagaatgctaagtggcgttattatcgccagattgcttcactcccattcggtaattaagatgcttgaaacctcgttattcgtcgcgacactcgcgacattgggaatgatctcccccggacctgatttttttctggtgatcaaaaacgctgcccgctatcgccgcactgccgccatgacgacggcagttggtgtgattttgggtgttgctacgcatatgtcttattgcgtggccggtctggcggtcgttatcacgaccacaccatggttattcaatttgctgaaatatgccggggcctgctacctgatctggattggtattcaagcactgctgtcacggggagaaagtaagtttagtattgataatactgcacagcatcccatctcactcaaagccgcatttttgcaagggtacctctgcaacttattgaatcccaaagcgactcttttcttcctcgccgttttcacgcaaatactgcagatagactccggcgtaggagaaaaactatggtacgcctcaatcatctggatactggccgcaatttggtggcctttgctggtgatcctgatccaaagcgcgccagtacgccgtggtttagccaaaacacaaaaagtggtcgataaagtgttaggtggcctgttgatcggccttggcatcaaagtcgccttgggctaa

SEQ ID NO: 101695 - protein, 225 aa, Yersinia pestis
MQRMLSGVIIARLLHSHSVIKMLETSLFVATLATLGMISPGPDFFLVIKNAARYRRTAAMTTAVGVILGVATHMSYCVAGLAVVITTTPWLFNLLKYAGACYLIWIGIQALLSRGESKFSIDNTAQHPISLKAAFLQGYLCNLLNPKATLFFLAVFTQILQIDSGVGEKLWYASIIWILAAIWWPLLVILIQSAPVRRGLAKTQKVVDKVLGGLLIGLGIKVALG

SEQ ID NO: 101696 - DNA, 666 bp, Staphylococcus epidermidis
  CDS (1)..(666)
atgaattgtaaaacgacaacgaggaggtttcttatggacggtttaattacatttatcattattacattattgattattatagtacctgggccagatttcattattgtaatgaaaaacactattaattcaagtaaaatgaatggttttatggccgcatttggtattactacggggcatattttatactcttcattagctatttttggaattatatacatacttacgagtttacactttgtttttttaacaataaaaatattgggtgcttgttatcttatttatctcggaatcaaaagtattttgagtgcgcacagttctgttgattttagtaaacaagctttagctgatgtcagaaatgtgagttatatcacttcttttagacaaggttttttaagtacaagtcttaaccctaaagctttattattttatgttagtatattccctcagtttctttctaacggtaatatacatatgaaatctgaagttgcgttatttgctttttcagttgttgtagttatatgcttatggtttttattttgtgtattcatctttcaatatattaaattattattcagcagaccgagattcaaagctatatttgattatattgtagggtttgttttaattggcttatctattaatttattattaagtaaaagcagctaa

SEQ ID NO: 101697 - protein, 221 aa, Staphylococcus epidermidis
MNCKTTTRRFLMDGLITFIIITLLIIIVPGPDFIIVMKNTINSSKMNGFMAAFGITTGHILYSSLAIFGIIYILTSLHFVFLTIKILGACYLIYLGIKSILSAHSSVDFSKQALADVRNVSYITSFRQGFLSTSLNPKALLFYVSIFPQFLSNGNIHMKSEVALFAFSVVVVICLWFLFCVFIFQYIKLLFSRPRFKAIFDYIVGFVLIGLSINLLLSKSS

SEQ ID NO: 101698 - DNA, 636 bp, Vibrio vulnificus
  CDS (1)..(636)
atggacattttaaattttgaagcctttttaatcgccattaccatcttaacgttaactccggggctagatacggcattggtcattcgcaatacgactcgtgctggcttgcaagatggctgcatgacgagtttaggcatttgctgcggtttgtttgtgcacgcgctgttttctgccattgggatttcagccattttggcgcagtcagcggagctgtttcaatttgtaaaaatgatcggggcggcttaccttatttggctgggctttagtagcttgaagtctttgatgacaagtggtgcagggttaagcgtcgcgcagatggcacagcaaagttacgacgcaaaacgctcgttgcgagaaggttttttgtcgaatgtgctcaatcctaaaacggcggtcttctatttggcgtttttgccacagtttgttaatccagagggttcacctctcttacaatcaatgacgatggcgggaattcatttcgtcatagcgatggtgtggcaatgtgggttggctggtgcgttgaactcagcgaaaaatcttttgaaaaatgcgcagttcatgaaatggatggaaggcgcaacaggggccgttttggtggctcttggtattaaacttttggttgaaaagccagtctga

SEQ ID NO: 101699 - protein, 211 aa, Vibrio vulnificus
MDILNFEAFLIAITILTLTPGLDTALVIRNTTRAGLQDGCMTSLGICCGLFVHALFSAIGISAILAQSAELFQFVKMIGAAYLIWLGFSSLKSLMTSGAGLSVAQMAQQSYDAKRSLREGFLSNVLNPKTAVFYLAFLPQFVNPEGSPLLQSMTMAGIHFVIAMVWQCGLAGALNSAKNLLKNAQFMKWMEGATGAVLVALGIKLLVEKPV

SEQ ID NO: 101700 - DNA, 672 bp, Vibrio vulnificus
  CDS (1)..(672)
atgaacgaactgacgattttactgacgctggcaagcgtccactttattgctttgatgagccccggccccgacgtggcactggtcgtgcaaaacgcaagccgctatggccgccaaacgggcctttttattgccctcggtttgtctgttggcattttgctgcattctctattaagcctgacgggcgtgagttacttggtccaccagcaaccgatgttgtatgccttattacaactgctgggtggcagctatttgctctatttgggcattggcgcgttgcattccgtattacgtcattggcgtcagccatcggtgaatcccaccatcactcaacggcagtggacgctgaacacgaaacgccaagcttttctcaaaggctttgccaccaacattctcaatcccaaggcgttagtgttttttgtcagcctgctatcgagcttaatcccagcaaccatgtcgctctctggcaaggccacagcggtgatgattttatttgcgttgtcatttctttggtttgccagcttagcgtgggcgctctctggtcgccgaatgcaacagcatttacacaaagcgagtgtctatattgatggcatttgcggcgttttattctgcttaattggcgcaggcatcctctacaacacggtgattcatcaagtcatcagccaagttgcatag

SEQ ID NO: 101701 - protein, 223 aa, Vibrio vulnificus
MNELTILLTLASVHFIALMSPGPDVALVVQNASRYGRQTGLFIALGLSVGILLHSLLSLTGVSYLVHQQPMLYALLQLLGGSYLLYLGIGALHSVLRHWRQPSVNPTITQRQWTLNTKRQAFLKGFATNILNPKALVFFVSLLSSLIPATMSLSGKATAVMILFALSFLWFASLAWALSGRRMQQHLHKASVYIDGICGVLFCLIGAGILYNTVIHQVISQVA

SEQ ID NO: 101702 - DNA, 690 bp, Shewanella oneidensis
  CDS (1)..(690)
atgggttggccagtgttaaactgtcgctcctgtgaaggccttcttgtgggccttttatgcgctgaaggggtaaagatgagttttagtacatggttaggattgcttgcgatttgttgtttaggggccatgtcacccgggcctagcttagccatggtggtgcgtcataccttgggcggtggacgcggcaagggaattatttgtgcttgggcacactcgattggtatcggcatttatgcgttggtgacactacttgggcttgcggtggtgttgaaaaaggcgcccctgatatttaatggtatcgctatattaggtgccgtttatttggcatggatgggcattcaagcgctgcgctcaaatggtggcatgcaagcaaaacttgcggccggcgaggctacagatgcacttacagcggcgcgcgatggcattgcgatttccctcttcaaccccaagattatgctgttctttttagcattattcagtcagtttgtaatggtggccgatagttttaccggtcaagcactgatcgtattaacgccaatggtggtggatggactttggtacagcttaattgctttagtgttatcccactcgagtgtattacccaaattgcgggaaaaagcagggttgattgataaactctctggcgtggttttgattctgctggcaataagagtgctgtataccctttag

SEQ ID NO: 101703 - protein, 229 aa, Shewanella oneidensis
MGWPVLNCRSCEGLLVGLLCAEGVKMSFSTWLGLLAICCLGAMSPGPSLAMVVRHTLGGGRGKGIICAWAHSIGIGIYALVTLLGLAVVLKKAPLIFNGIAILGAVYLAWMGIQALRSNGGMQAKLAAGEATDALTAARDGIAISLFNPKIMLFFLALFSQFVMVADSFTGQALIVLTPMVVDGLWYSLIALVLSHSSVLPKLREKAGLIDKLSGVVLILLAIRVLYTL

SEQ ID NO: 101704 - DNA, 612 bp, Shewanella oneidensis
  CDS (1)..(612)
atggagttattgagtattgtgatatttgggctgttgattgtggttagccctagtgccgattttgtgttggtctttaaaaatagtgctatgcatagcagaaaagcggggatgttgacggccattggaatcggtgcgggtgtctgtgtgcatattagctattctatcattgggattagccagttaattgccaataatgcggggttatttagcctagtgaagtatgtgggtgcagcgtatttaatctatattgggatcgcaggcttattgagtgccaagctaaccttagattatgggactcagcttattaaaccagttgaaaatcgaaagtacattatgcaaggttttttatgtaatgtactgaatcctaaaacgatgattttcttcttaagtgtttttagccagctgatatcatcccatagtgacagcttagcattcgtcatcagctatggtgtttatatcgccgtgttacacgggatctggttttgcatcgtcgcgtacttagtgacatcagccaaagccactcgagtattgaaacggtttggtcatagaatcaatcaggcctgtggtgtgggtcttataacctttggcgtaatattatcaacaaacgattga

SEQ ID NO: 101705 - protein, 203 aa, Shewanella oneidensis
MELLSIVIFGLLIVVSPSADFVLVFKNSAMHSRKAGMLTAIGIGAGVCVHISYSIIGISQLIANNAGLFSLVKYVGAAYLIYIGIAGLLSAKLTLDYGTQLIKPVENRKYIMQGFLCNVLNPKTMIFFLSVFSQLISSHSDSLAFVISYGVYIAVLHGIWFCIVAYLVTSAKATRVLKRFGHRINQACGVGLITFGVILSTND

SEQ ID NO: 101706 - DNA, 639 bp, Escherichia coli O6
  CDS (1)..(639)
atgttcgctgaatacggggttctgaattactggacctatctggttggggccatttttattgtgttggtgccagggccaaataccctgtttgtactcaaaaatagcgtcagtagcggtatgaaaggcggttatcttgcggcctgtggtgtatttattggcgatgcggtattgatgtttctggcatgggctggagtggcgacattaattaagaccaccccgatattattcaacatcgtacgttatcttggtgcgttttatttgctctatctggggagtaaaattctctacgcgaccctgaaaggtaaaaatagcgagaccaaatccgatgagccccaatacggtgccatttttaaacgcgcgttaattttgagcctgactaatccgaaagccattttgttctatgtgtcgtttttcgtacagtttatcgatgttaatgccccacatacgggaatttcattctttattctggcgacgacgctggaactggtgagtttctgctatttgagcttcctgattatttctggggcttttgtcacgcagtacatacgtaccaaaaagaaactggctaaagtgggcaactcactgattggtttgatgttcgtgggtttcgccgcccgactggcgacgctgcaatcctga

SEQ ID NO: 101707 - protein, 212 aa, Escherichia coli O6
MFAEYGVLNYWTYLVGAIFIVLVPGPNTLFVLKNSVSSGMKGGYLAACGVFIGDAVLMFLAWAGVATLIKTTPILFNIVRYLGAFYLLYLGSKILYATLKGKNSETKSDEPQYGAIFKRALILSLTNPKAILFYVSFFVQFIDVNAPHTGISFFILATTLELVSFCYLSFLIISGAFVTQYIRTKKKLAKVGNSLIGLMFVGFAARLATLQS

SEQ ID NO: 101708 - DNA, 675 bp, Escherichia coli O6
  CDS (1)..(675)
atgatgaagttacttcacttatttatggatgaaatcactatggatcctttgcacgccgtttacctgaccgtaggattgttcgtgattactttttttaatccgggagccaatctctttgtggtagtacaaaccagcctggcttccggtcgacgcgcaggggtgttgaccgggctgggcgtggcgctgggcgatgcattttattccgggttgggtttgtttggtcttgcaacgctaattacgcagtgtggggagattttttcgcttatcagaatcgtcggcggcgcttatctcttatggtttgcgtggtgtagtagcatgcgccgccactcaacaccgcaaatgagcacactacaacaaccgattagcgccccctggtatgtctttttccgccgtggattaattaccgatctctctaacccgcaaaccgttttattttttatcagtattttctcagtaacattacatgccgaaacaccaacatgggcacgattaatggcctgggcggggattgtgctcgcatcaattatctggcgagtctttcttagtcaggcgttttctttgcccgcagtgcgtcgtgcttatgggcgtatgcaacgcgttgccagttgggttattggtgcaattattggtgtattcgcgctacgcctgatttacgaaggggtgacgcagcggtga

SEQ ID NO: 101709 - protein, 224 aa, Escherichia coli O6
MMKLLHLFMDEITMDPLHAVYLTVGLFVITFFNPGANLFVVVQTSLASGRRAGVLTGLGVALGDAFYSGLGLFGLATLITQCGEIFSLIRIVGGAYLLWFAWCSSMRRHSTPQMSTLQQPISAPWYVFFRRGLITDLSNPQTVLFFISIFSVTLHAETPTWARLMAWAGIVLASIIWRVFLSQAFSLPAVRRAYGRMQRVASWVIGAIIGVFALRLIYEGVTQR

SEQ ID NO: 101710 - DNA, 675 bp, Corynebacterium efficiens
  CDS (1)..(675)
atggactgggctgcactcggaaccctgattctgctcaatatcgtgggcagtctgtccccgggtcccgacacgttcttcctcctgcgtctggccacccggtcacggatccacgcgatcatgggggtgaccggtattgtcaccggtctgaccgtctgggtgaccctcacggtggtgggtgcggccaccctgctcaccacctaccccgacatcctcggcgtcatccagctggtcggcggtggctacctgacctggatggggtaccggatggggcggggagcggtcagggagcttctcgacgcccgggccttccgcttcaattccgccacccgccccatccccgatgcggtggctgcactgggcaccccggggcaggcgtaccggcaggggatggccaccaacctgtccaaccccaaggtgatcatgtacttcgcggccatcctggccccgttgatgccggcgaacccctcgttggcggttgccctgaccatcatcatcgcgatcttggtgcagacctgggtggtgttcaccttcatgtgcgtgatcgtctccaccgagaggatccgcaaggcggtgctgcgggccggccccgtcttcgacggggtggcggcggtggtgttcatcgcggttggtctcaccctcatctatgagggtgcatcccagctgctcctggggtag

SEQ ID NO: 101711 - protein, 224 aa, Corynebacterium efficiens
MDWAALGTLILLNIVGSLSPGPDTFFLLRLATRSRIHAIMGVTGIVTGLTVWVTLTVVGAATLLTTYPDILGVIQLVGGGYLTWMGYRMGRGAVRELLDARAFRFNSATRPIPDAVAALGTPGQAYRQGMATNLSNPKVIMYFAAILAPLMPANPSLAVALTIIIAILVQTWVVFTFMCVIVSTERIRKAVLRAGPVFDGVAAVVFIAVGLTLIYEGASQLLLG

SEQ ID NO: 101712 - DNA, 705 bp, Corynebacterium efficiens
  CDS (1)..(705)
atgaccaccgccaccctgcttgccctgctcgtcgtctggatcgccgcgatcgtctcgccagggcctgacctcgtgcagatcatccgggtcggttcccgcagccgcagtgatggtatctgggcggccatcgggatcatggtgggcaatgccatctggatctgcgccagcctgctcggcctgtcggtgctgatctccaccacgcccgcggtgttgtggctgctccagctcgccggcggttcctatctgatctggatgggcatcggtgccgtgcgctcctggtgggggcagcggatcaccgcccggcaggcgggggatgccgtggaacgggtgctggagggggatggttcggacggtgttcccggtgggttcggttccccaggtgtcctcggcgcccggcgggccctgcgcaccggtatcgccaccaacctgtccaaccccaaggccgtgctcttcttcggttcggtgttcgcccagttcatcaccccggacatgggagtggggtggagcatctttctcgccgtcttcctcatcctcaccggcctggtgtggttcttaggtttcgcggtgctggtgcgcagcttcgccgcccgcatcacccgcaacgcggcggtgatcgatctgttcacgggggtgatcttcatagcccttggaatgttcatggtctggcagggcgttgtgggtatcggcagctggatcctgggttag

SEQ ID NO: 101713 - protein, 234 aa, Corynebacterium efficiens
MTTATLLALLVVWIAAIVSPGPDLVQIIRVGSRSRSDGIWAAIGIMVGNAIWICASLLGLSVLISTTPAVLWLLQLAGGSYLIWMGIGAVRSWWGQRITARQAGDAVERVLEGDGSDGVPGGFGSPGVLGARRALRTGIATNLSNPKAVLFFGSVFAQFITPDMGVGWSIFLAVFLILTGLVWFLGFAVLVRSFAARITRNAAVIDLFTGVIFIALGMFMVWQGVVGIGSWILG

SEQ ID NO: 101714 - DNA, 639 bp, Brucella suis
  CDS (1)..(639)
atgcatccttacctgtttgaacttgcatcccttatggcaatcttcgtttttgccatcgtttcccccggcgctgatctggccatggtcatccggcaatcgctgctgcatggccgccgcgaggcgatcattacgagtttcggcatcggtacggcgctgatgatgcatgtcacctatacggtgctgggcctcggcctcatcatttccaggtcgatctatctgttcaatatcgtcaaatggtgcggtgtggcctatctggtctatatcggattcaaggcgctgcgtgccggcaccacgaaaatcgaggcgggtccggatttgaaggagccgcgccggaaacagggctttgccaaggctttcggcctcggctttgctgccaatgcgctgaaccccaaggccgttttcttcttcctgtcgattttctccacggtcgttcatgtccatacaccgaccgaagtgaaactcggctatggcgtggtgatggcgaccgcattgatctcgtggtttgtcggcgtcagctttttcatgacgacgccgaaaatgcgcgcggctttctcgcgcgcatcgaaatggatagacaggacgagcggcgtggtattcatcgcgcttgggctgaaacttgccactgaaaaggctatgtag

SEQ ID NO: 101715 - protein, 212 aa, Brucella suis
MHPYLFELASLMAIFVFAIVSPGADLAMVIRQSLLHGRREAIITSFGIGTALMMHVTYTVLGLGLIISRSIYLFNIVKWCGVAYLVYIGFKALRAGTTKIEAGPDLKEPRRKQGFAKAFGLGFAANALNPKAVFFFLSIFSTVVHVHTPTEVKLGYGVVMATALISWFVGVSFFMTTPKMRAAFSRASKWIDRTSGVVFIALGLKLATEKAM

SEQ ID NO: 101716 - DNA, 651 bp, Rhizobium loti
  CDS (1)..(651)
atgccagaactgaccccactcgccctgtacctcgccgcggcctccgtgctcgccatcacccccggtccgggcatcttctacgttgccgcgcgcacgctcgccggtggtcgtcgggaaggtatcgcttccagcttcggcacggggttggggggcatgatccacgtcctcgccgcaagcttaggtgtttccgcgatcgtgctcgagagctcggaactgttctccgcattaaagctgttcggcgcggtctacctcgtctggctcggctttcgcacctttcaagccgcccgcctcaagggagcgactggcggcgatgacggcgccgcagtgggtccagtcggaccccggcgggcgtttcgtgaaggggtactggtcgaggcgctcaacccgaagacggcagtcttcttcctcgccttcattccgcagttcgtgaatccgagcgcagggctcgtagctctgcaattcgcggtgcttggctccgtgtccattgcgctcaacacgctcgccgacatcgtggttgccgtcgtggccagcggcattcaagacggcgcggcagcgcgtcccgggttgatccgccgcctgagggaggcgtcaggcggcgcgatgatcgcgctgggcgtcggcctcgctctggcgaaacaccctgctgcctga

SEQ ID NO: 101717 - protein, 216 aa, Rhizobium loti
MPELTPLALYLAAASVLAITPGPGIFYVAARTLAGGRREGIASSFGTGLGGMIHVLAASLGVSAIVLESSELFSALKLFGAVYLVWLGFRTFQAARLKGATGGDDGAAVGPVGPRRAFREGVLVEALNPKTAVFFLAFIPQFVNPSAGLVALQFAVLGSVSIALNTLADIVVAVVASGIQDGAAARPGLIRRLREASGGAMIALGVGLALAKHPAA

SEQ ID NO: 101718 - DNA, 627 bp, Ruegeria sp
  CDS (1)..(627)
atggaattgcagacttggctcgccttcgtggctgcttccaccgcattgctgttgatacccgggccaacggtcctgcttgttctgagctatgccatcagccaaggaaagaaagtggcagttgcaaccgttgccggcgttgccttgggtgatttcatagcgatgtccgcctcattggcgggactcggcacattggtcctgtcttctgccgtgctgttttcggtactgaaatgggtcggcgcgttttacctgatttacctcggggtaaagattttccgcggcgcatcctctgcaaaactcggagatctcgaagagctttcacaagcctccgccaaactcgcctttgggcaaagcgcttttgtcacggctttgaatccgaaatcagtcctgttctttatcgccttcgttcctcagttcattgatatcgaaaaaccactcttgactcaattcgccattctcctggtgacatttgtcggcctggcctcgataaatgcgctggtctatgcccttttggccagcggtctgcgcgcccagatctcgcggccttccgtcgtgccgtggttttcgcgcgtcggaggcggcacgatcattgccatgggcctgggaactgcgcttttcgcccgggcctga

SEQ ID NO: 101719 - protein, 208 aa, Ruegeria sp
MELQTWLAFVAASTALLLIPGPTVLLVLSYAISQGKKVAVATVAGVALGDFIAMSASLAGLGTLVLSSAVLFSVLKWVGAFYLIYLGVKIFRGASSAKLGDLEELSQASAKLAFGQSAFVTALNPKSVLFFIAFVPQFIDIEKPLLTQFAILLVTFVGLASINALVYALLASGLRAQISRPSVVPWFSRVGGGTIIAMGLGTALFARA

SEQ ID NO: 101720 - DNA, 624 bp, Corynebacterium glutamicum
  CDS (1)..(624)
atggacgcagcatcatgggtcgcattcgcactcgcattattggtggcattagcggtgcccggacctgaccttgttcttgttctacattctgcaacccgcgggatccgcacgggggtcatgactgcggcaggaatcatgacgggactgatgttacatgcgagtcttgcgatagccggagcaactgcattattgctatcagctccgggagtattgagcgctattcaacttcttggtgcgggagtgcttttgtggatgggcacgaacatgtttcgtgcttcccaaaataccggggaatctgaaactgctgctagtcaatcgagtgcaggttattttcgaggatttatcaccaatgccacgaacccgaaagcgctgttgttctttgcagcgattcttcctcagttcattgggaatggggaagatatgaaaatgaggaccttggcattgtgtgccaccatcgtgcttggctcaggagcgtggtggttgggaacaatcgcattggtcaggggtattggtctgcaaaagttaccgtctgcggatcgcattatcaccctggttggtggcatcgcactgtttctcattggtgccggattactggttaatactgcttatgggcttatcacttag

SEQ ID NO: 101721 - protein, 207 aa, Corynebacterium glutamicum
MDAASWVAFALALLVALAVPGPDLVLVLHSATRGIRTGVMTAAGIMTGLMLHASLAIAGATALLLSAPGVLSAIQLLGAGVLLWMGTNMFRASQNTGESETAASQSSAGYFRGFITNATNPKALLFFAAILPQFIGNGEDMKMRTLALCATIVLGSGAWWLGTIALVRGIGLQKLPSADRIITLVGGIALFLIGAGLLVNTAYGLIT

SEQ ID NO: 101722 - DNA, 672 bp, Corynebacterium glutamicum
  CDS (1)..(672)
atggagtggaccgcttttggcaccctgattctgctcaatttggtgggcagtttatccccggggcctgatacctttttcctcctccgcttagccacccgctccagagcgcacgcgatcgctggcgtcgccggcatcgtcaccggactcacggtgtgggtgacgctgacggtcgtgggagcagcggcgctgctcaccacttatccgtcgattctcggaatcatccagctcgtcggcggcacgtacctaagcttcattgggtacaagttgctgcgctcggcgtcgagagagcttatcgacgcccgccagttccgtttcaacgccgatgcccgacctatcccggatgcggtagaagcactgggaacccgcactcaggtatatcgacaaggtttggccaccaacctgtcaaaccctaaagttgtcatgtacttcgcggcaattctggctccgttgatgccagcgcacccatcaccggtgctggcgttctctatcatcgtggcgattttagtgcagacctttgttaccttctctgctgtgtgcctcattgtctctacggagcgtgtgcgcaaagcaatgctgcgtgcaggtccctggtttgacctgcttgctggcgttgtcttcctcgttgtgggtgtgactctgctgtatgaaggcctgaccggtttactcgggtag

SEQ ID NO: 101723 - protein, 223 aa, Corynebacterium glutamicum
MEWTAFGTLILLNLVGSLSPGPDTFFLLRLATRSRAHAIAGVAGIVTGLTVWVTLTVVGAAALLTTYPSILGIIQLVGGTYLSFIGYKLLRSASRELIDARQFRFNADARPIPDAVEALGTRTQVYRQGLATNLSNPKVVMYFAAILAPLMPAHPSPVLAFSIIVAILVQTFVTFSAVCLIVSTERVRKAMLRAGPWFDLLAGVVFLVVGVTLLYEGLTGLLG

SEQ ID NO: 101724 - DNA, 681 bp, Corynebacterium glutamicum
  CDS (1)..(681)
atgacaacagcacagtttctagcgctttttctggtgtggatcgcagcaattgcatcccctgggccagaccttttccagatcatcaggctaagtgccaaaaaccgccgtgatggcgtactgactgccgtaggcatcatggtgggaaactccatctggatcatagccagcctccttgggctctcggcactgatctccacgtatccagcaattttgaacctgttgcagctcgtcggtggcggttatttgacctggatgggcatcggggcggtgaggtcatggtggacgaaacgctccacacagcaagctgcagcggattctcaagctgtagagaatacgttggtgacagccacggctgcatctgtcggagtgtggccagctattcgatctggcattgctaccaacttgtccaaccccaaagctgtgctgttttttggttccgttttcgcccaatttgttagacctgacatgggaatcgggtggagtattttcattggagtcttcctcaccctcactggcctgctgtggtttgtggggttcgccgtcttggtccgcaaactagccgctggcctcacccgaaatggagccatcatcgacctgctaacgggggtgattttcatcgggctgggaatgttcatgatcttcgagggggttgtaggaatcggtggcagggtagtgggttag

SEQ ID NO: 101725 - protein, 226 aa, Corynebacterium glutamicum
MTTAQFLALFLVWIAAIASPGPDLFQIIRLSAKNRRDGVLTAVGIMVGNSIWIIASLLGLSALISTYPAILNLLQLVGGGYLTWMGIGAVRSWWTKRSTQQAAADSQAVENTLVTATAASVGVWPAIRSGIATNLSNPKAVLFFGSVFAQFVRPDMGIGWSIFIGVFLTLTGLLWFVGFAVLVRKLAAGLTRNGAIIDLLTGVIFIGLGMFMIFEGVVGIGGRVVG

SEQ ID NO: 101726 - DNA, 636 bp, Methanosarcina mazei
  CDS (1)..(636)
atgagaaatttgatagagcaatcccagttaatctatttcattgcagcctctgcagcccttacctttcttcccggtccggatatcttatttgtgctcacacagagcatctcacagggaaaaattgcaggaattgcaacagcaacaggtctgtgcacaggcatacttgtccacaccagcgcagctgcattcgggatttcagcccttatatataaatcagcccttgcttttgagatcgtaaaatatgccggagcagcctaccttctttaccttgcctggcaggctttgagagaaagcggagagcttgtgtcttctgcccccatcagggaaagaaactcttttgccctttacaggcgtgggatctttatgaacgtccttaaccctaaagttgcactattcttcctcgcattccttccccagtttgtgaataccggagcaggccgtgtccctatgcagatgatattccttggaatagtgttcctggtgcaggcgtgggtaattttttcagtaatctcggtttttgcaggagcgataggagagaaaatagtacagagacggggaattgggaagtatatcagctggggaaaagcgagtatctttactgtaataggggtaaaacttgcactgtctcataaataa

SEQ ID NO: 101727 - protein, 211 aa, Methanosarcina mazei
MRNLIEQSQLIYFIAASAALTFLPGPDILFVLTQSISQGKIAGIATATGLCTGILVHTSAAAFGISALIYKSALAFEIVKYAGAAYLLYLAWQALRESGELVSSAPIRERNSFALYRRGIFMNVLNPKVALFFLAFLPQFVNTGAGRVPMQMIFLGIVFLVQAWVIFSVISVFAGAIGEKIVQRRGIGKYISWGKASIFTVIGVKLALSHK

SEQ ID NO: 101728 - DNA, 636 bp, Methanosarcina acetivorans
  CDS (1)..(636)
atgagaaatttgatagaacaatcccagttaatctatttcattgcagcctccgcagcccttacgtttcttcctggacccgatattcttttcgtgctcacccagagcatttcacagggcaaaatggcagggattgcaaccgcaacgggtctgtgtacgggcatactcgtccacaccagcgcagctgctttagggatttccgccctgctatacaaatctgcccttgccttcgaaatcgtaaaatatgccggagcagcctatctactttaccttgcctggcaggctttaaaggaaagcggagaactggtatcttctgcccctgtccgggaaacaaatgcacttgccctttacaggcgcgggatttttatgaatgtcctgaatcccaaagttgctctcttcttcctcgcattcctcccccagtttgtaaacctggaatcaggaagcgtcccgatacagatgatattcctgggcatagttttcctgatacaggcctggctgatcttttcctcaatttcgatctttgccgggataatcggagataagatcgtacagagaccgggcattggaaagtacattaactggggaaaagcaggcatttttaccgtaatcggagttaaacttgcgctttcccataaatga

SEQ ID NO: 101729 - protein, 211 aa, Methanosarcina acetivorans
MRNLIEQSQLIYFIAASAALTFLPGPDILFVLTQSISQGKMAGIATATGLCTGILVHTSAAALGISALLYKSALAFEIVKYAGAAYLLYLAWQALKESGELVSSAPVRETNALALYRRGIFMNVLNPKVALFFLAFLPQFVNLESGSVPIQMIFLGIVFLIQAWLIFSSISIFAGIIGDKIVQRPGIGKYINWGKAGIFTVIGVKLALSHK

SEQ ID NO: 101730 - DNA, 663 bp, Ralstonia solanacearum
  CDS (1)..(663)
atgttcgcccacttcggcatcatcgagttctggaccttcctgctcggcacgatcttcatcgtgctgctgccggggccgaactcgatgtacgtgctgtcggtggcggcccgccgcggtgtgcgcgcaggctaccagggcgcgtgcggcgtgttcctgggcgatgccatcctgatggtgctgtcggcggcgggcgtgtcgtcgctgctcaaggcgagtccggtgctgttctacgtcgtgaagtccatcggcgcggcgtacctggcgtggatcggcctgcagatgctgcgcggcgcggtgcgcaactggcgcgcgcgcaaggcgggcgggtcggccgagcagaacgcggcccggggcgacgaatcgcatccgttcaagaaggcgctggtcatcagcctgctgaacccgaaggcgatcctgttcttcatctcgttcttcatccagttcgtcgatccgcacttcgcgctgccggcgctgtcgttcgtcgtgctggggctggtctgccagatcggcagcttcctgtatctgaccaccatcatcttcgtgggcgcgcggctggccgcggcgttccgcgcgcgacgacgcctggctgccggcatgagcagcggcgtcggcgccatgtttatcggcttttccgccaagctggcgacggccacactgaattaa

SEQ ID NO: 101731 - protein, 220 aa, Ralstonia solanacearum
MFAHFGIIEFWTFLLGTIFIVLLPGPNSMYVLSVAARRGVRAGYQGACGVFLGDAILMVLSAAGVSSLLKASPVLFYVVKSIGAAYLAWIGLQMLRGAVRNWRARKAGGSAEQNAARGDESHPFKKALVISLLNPKAILFFISFFIQFVDPHFALPALSFVVLGLVCQIGSFLYLTTIIFVGARLAAAFRARRRLAAGMSSGVGAMFIGFSAKLATATLN

SEQ ID NO: 101732 - DNA, 633 bp, Ralstonia solanacearum
  CDS (1)..(633)
atgcccaccctgaccaacctcctcaccttcgccctggtcgccctgggcatggtcctgacccccggccccaacatgatctacctgatctcgcggtcgatcagccaggggcgcaacgcggggctgatttcgctggcgggcatcgccaccgggttcgtgttctacatgctgtgcgcggcattcggcatcacggcgctgctgatggcggtgccgtttgcctacgacacgctgcgcttcggcggggcgatctacctgctctatctggcatggcaggcggtgcgtcccggcgggcgcgccccgttccagctgcgcgagctgcctgcggacagcccgcgccgcctgtattcgatgggcctgctgaccagcctgctcaacccgaaggtggcggtgctgtatctgtcgctgctgccgcagttcatcgagccggcgcacggcagtgtgctggtgcagtcggtctgcctggggctgacgcagatctgcgtgagcctgaccatcaactcgatgatcgcctcggccgccggcagcatcgccgcgctgctttcccgcaaggcgagctggctggcgctccagcgttacctgatgggctcggtgctgacggggctggcgctgcgcatggcgatggaagcccgcaagtaa

SEQ ID NO: 101733 - protein, 210 aa, Ralstonia solanacearum
MPTLTNLLTFALVALGMVLTPGPNMIYLISRSISQGRNAGLISLAGIATGFVFYMLCAAFGITALLMAVPFAYDTLRFGGAIYLLYLAWQAVRPGGRAPFQLRELPADSPRRLYSMGLLTSLLNPKVAVLYLSLLPQFIEPAHGSVLVQSVCLGLTQICVSLTINSMIASAAGSIAALLSRKASWLALQRYLMGSVLTGLALRMAMEARK

SEQ ID NO: 101734 - DNA, 621 bp, Ralstonia solanacearum
  CDS (1)..(621)
atgccgaatgtgctgctgttcctgctgtcttccgtcgccatcacggtgatgccggggccggacaacctgcaggtgatcgcgcgtggcgcgagccagggccgcaaggccgggctggcggcggcggccgggtttgcctcgggctgcctgttccatacgacgctggcggcgctggggctggcggcggtgctgcagtccgcgccggcggcgttccaggcgatccgctggctgggcgcggcctacctggtctggctgggcgtgcaggcgctgcgcagcaagggcggcgtcgggccgtcggtgagcgcgcaggcggcggcgcccgatctgtggcaggtgttccgccagagcgtgctggccaacatgctcaaccccaaggtgacgctgttcttcgtggtgttcctgccgcagttcgtcgacgcgcaggccggtcatgcggcgctgcagatgctgctgctgggcggggtgttcatggcgcagaccatcgtggtcttcggcctgtacggctggtgcgcggcggcgctgggcggctggatgcgccgcacgccgcgcgcgtcgctgtggctggatcgcgtgagcggctgcattttcatcgggctggggctgcgggtcgcgctcaccaagtga

SEQ ID NO: 101735 - protein, 206 aa, Ralstonia solanacearum
MPNVLLFLLSSVAITVMPGPDNLQVIARGASQGRKAGLAAAAGFASGCLFHTTLAALGLAAVLQSAPAAFQAIRWLGAAYLVWLGVQALRSKGGVGPSVSAQAAAPDLWQVFRQSVLANMLNPKVTLFFVVFLPQFVDAQAGHAALQMLLLGGVFMAQTIVVFGLYGWCAAALGGWMRRTPRASLWLDRVSGCIFIGLGLRVALTK

SEQ ID NO: 101736 - DNA, 636 bp, Ralstonia solanacearum
  CDS (1)..(636)
atgcccctgcacacttggctggccttcatcggcgcgagcctcatcgtcctgctgattcccggcccgaccatcctgctggtgatcggcgattcgctggccaaccgcgggcgttcggcctggagcacggtggccggcgtggccgccggggataccacggcgatggccgtgtcgctggccggggcgggtgcgctgctggccgcatcggcggcggcgttcacggtgctgaagctggtcgggggctcgtacctcgtctacctgggcatccggtcgatcctgaccgcgcggcgcctgcgcgacgatgcgcccgaggccgtcatcccgatgcagccgaagtccgcccggcgccgcttcctgtcggcctggacggtgacggcgctgaaccccaagagcatcgtcttcttcgtcgccttcgtgccgcagttcatctcggcggaccagaccttcgtgtcgcagggcgcgatcctgctgccgaccttcgtctgcctggccgcgctgaatgcatcgatgtacgcgctggccgcccggctgctggcccgccggctgaccagcgtggccgcgcagcgccgcttcggctataccggcggcgcggtgctgctgggcgccggcacgatcacgctcggcatgcagtcgggctga

SEQ ID NO: 101737 - protein, 211 aa, Ralstonia solanacearum
MPLHTWLAFIGASLIVLLIPGPTILLVIGDSLANRGRSAWSTVAGVAAGDTTAMAVSLAGAGALLAASAAAFTVLKLVGGSYLVYLGIRSILTARRLRDDAPEAVIPMQPKSARRRFLSAWTVTALNPKSIVFFVAFVPQFISADQTFVSQGAILLPTFVCLAALNASMYALAARLLARRLTSVAAQRRFGYTGGAVLLGAGTITLGMQSG

SEQ ID NO: 101738 - DNA, 648 bp, Ralstonia solanacearum
  CDS (1)..(648)
atgagtacgctgggcatcatcaacctgccggtcttcatgcttgccgtgctcctgctcaacgtgacgcccgggccggataccgcctatatcgtcgggcgcagcgtgtcgcaggggcgcgcggcggggctgatgtcgagcctgggtgtgtcggcggggtgctgcgtgcacgtgctggcggtggccttcgggctgacggcgctgctggccgcgtcggccgtggcgttcacggtgatcaaggcgatcggcgcggcgtatctgatctatctgggcggccgcatgctgctggcgccggccgggagcgacgacgcgcccgtggcgcaagcggtcgctactgcccgccgtccgctgcgcgcgctgttcatgcaggggttcctgaccaatgtgctgaacccgaaggtggtgctgttcttcctgtcgttcttcccgcaattcgtcgatccgggcgcgagccacaaggcggcggcgtttctggtgctgggggcggtgttcatcgtgatgtcgacggcatggaacagcctggtcgcctgggtggcggccagcgtcacgcgccgggtggcgggcaagccgggtatcaagcgctggctcgaccgcgttgtcgggacggcgttcatcgggctgggggcgcggctggcgttcacgacccgatga

SEQ ID NO: 101739 - protein, 215 aa, Ralstonia solanacearum
MSTLGIINLPVFMLAVLLLNVTPGPDTAYIVGRSVSQGRAAGLMSSLGVSAGCCVHVLAVAFGLTALLAASAVAFTVIKAIGAAYLIYLGGRMLLAPAGSDDAPVAQAVATARRPLRALFMQGFLTNVLNPKVVLFFLSFFPQFVDPGASHKAAAFLVLGAVFIVMSTAWNSLVAWVAASVTRRVAGKPGIKRWLDRVVGTAFIGLGARLAFTTR

SEQ ID NO: 101740 - DNA, 648 bp, Rhizobium meliloti
  CDS (1)..(648)
atgctcgacctcacgcccacgccctatctgccgcagctcctcgtcgcgtggacagcttatatcatcgccgttgcttcgccggggccagcggttctggcgatcatcgcgacctcggtcagccgggggagaagcgcgggcctggcgctcgccttcggcgtgctgagcggcagctacacctgggcgatgctgacggcttccggcctgtcggccctcatccggacctatggccaggcgatcatcgtcctgaagatcgccggcgcctgctatctgttctggcttgcctataacgcgctcagagcggcgatgcagggcgacgcccaaccgtccgcccttcgtgttcccccgacttcctcgctgaagaagctttacctcaaaggtctcgggatccacctgaccaatccgaaggcgatcttcgcctggatcatgctggtctcgctcgggatgccggagggcgcgccggtcggcgtcacggccgccttcatcggcggctgcatgctgatcggcctcgtgatcttctgcggcttcgcgatcgtcttctcgctcgcgccggtgcatcgcgcctatctgaaatcgcggcggatcatcgagagcctgatggccggcttcttcgcctttgcgggcttcaagctgctgacggcacggctctga

SEQ ID NO: 101741 - protein, 215 aa, Rhizobium meliloti
MLDLTPTPYLPQLLVAWTAYIIAVASPGPAVLAIIATSVSRGRSAGLALAFGVLSGSYTWAMLTASGLSALIRTYGQAIIVLKIAGACYLFWLAYNALRAAMQGDAQPSALRVPPTSSLKKLYLKGLGIHLTNPKAIFAWIMLVSLGMPEGAPVGVTAAFIGGCMLIGLVIFCGFAIVFSLAPVHRAYLKSRRIIESLMAGFFAFAGFKLLTARL

SEQ ID NO: 101742 - DNA, 642 bp, Rhizobium meliloti
  CDS (1)..(642)
atggacttcgttcccagcctgccgacgctcatcgcattcgccgctgcaagcctcctgctcgccgcgacgccgggtcccgacatgacgctttcgatcacccgggcgttggcgcagggaaagaaggccgcccttttcgtcgtggtcggcaccgggctcggcatcgtcgtccatacgctgctcgtcgccttcggcatctcggcgctgatcaccgcatccccgaccgccttcctggtgctgaagaccgggggcgccgcctatctcctatggctcgcgatccaggcgatccgctacgggtccagcctgtcggtgacgaaggtgacggaggcgaagggtacgatcctttcgaacatcgcgaccggcttctcggtcaacattctgaacccgaaggtggtgatcttcttcatgaccttcctgccgcagttcgtcactgcgaacgatcccgccgtgacgggcaagctgctcttcctcggtttcttcttcatcgcgataggcatgccggtgaacgcattggtcgttcttgctgccgactggctcgcagcctggctgcagcgcaacaggcgcgtgatgcgggcgatcgactacggtttcgccggcgtcttttccatattcgcggtcaagatcttcttcacgcagacgcgctga

SEQ ID NO: 101743 - protein, 213 aa, Rhizobium meliloti
MDFVPSLPTLIAFAAASLLLAATPGPDMTLSITRALAQGKKAALFVVVGTGLGIVVHTLLVAFGISALITASPTAFLVLKTGGAAYLLWLAIQAIRYGSSLSVTKVTEAKGTILSNIATGFSVNILNPKVVIFFMTFLPQFVTANDPAVTGKLLFLGFFFIAIGMPVNALVVLAADWLAAWLQRNRRVMRAIDYGFAGVFSIFAVKIFFTQTR

SEQ ID NO: 101744 - DNA, 636 bp, Rhizobium meliloti
  CDS (1)..(636)
atgtccttcgaacactggttcgcctttgccgccgcgtctgcggtgctgcttgccattcccggccccacgatccttctcgtcatctcctacgcgctcggccacggccgcaagatcgcgggcgcgaccgtggctggtgtcgctcttggcgatttcaccgcaatgaccgcttcgatgctcggcctcggtgccctgcttgcaacctcggcggcggttttcaccgtgctgaagtggatcggcgccgcctatctcgtctggctcggcatcaagctctggagggcgccggtcggcaacgacagcgggagcaccgttgaaacgagtcctgcggaaagaccgctgcggatattccttcacacctatgcggtgaccgcacttaacccgaaaagcattctcttcttcgtcgccttcctgccccagttcctcgatctgtcgcggccgcttttcgcgcagatggcgatcttcgagacgacgttcctgatactcgcgacgatcaacgctgcgctctatgcctggcttgctgccgcggccggaagcaccatccgcaagccgaatatccggcgcatcgtcaatcgcctcggtggttcgctgctcatcggcgccggctttctgacggcagggctgaagcgcgccacgtcctga

SEQ ID NO: 101745 - protein, 211 aa, Rhizobium meliloti
MSFEHWFAFAAASAVLLAIPGPTILLVISYALGHGRKIAGATVAGVALGDFTAMTASMLGLGALLATSAAVFTVLKWIGAAYLVWLGIKLWRAPVGNDSGSTVETSPAERPLRIFLHTYAVTALNPKSILFFVAFLPQFLDLSRPLFAQMAIFETTFLILATINAALYAWLAAAAGSTIRKPNIRRIVNRLGGSLLIGAGFLTAGLKRATS

SEQ ID NO: 101746 - DNA, 639 bp, Rhizobium meliloti
  CDS (1)..(639)
atgacctatgcggaaaacctctggctctttttcacccttctcttcggcatcatcatcgttcccggcatggacatggttttcgtcctcgcgaatgcgatgaccggcgggcgcgcttccgggctttcggcaacggccggtatcgtggcaggcggcgtgctgcacacgctctatgcggcccttggcgtcagcgtcgtcctgcatctggtgccccaactcttcaacctgctgctcgctgccggcgcggcctatatcgcctggatcggtttttcgctcctgcgcagttccatcaccatcagcggtgtcgaaggaggagcacggctgtcgcgttgggcgagttttcgccagggtgcactgacgagccttatgaatcccaaggcctatctcttcatgcttgccgtctacccgcagttcctcaagccgcagttcggtccggtgtggtcccaggcggccgtcatggccgtgatgatcgcgctgacgcagcttgcggtctatggcgggcttgcacttgccgccgggcgcgggcgtgatttcctcgtgggcagccccggtgccacggtcaccatcggccggctcgccggtctcctcctcgtcgtcatcgccgtcttcacggtatggcatggctggagcggggctgcttga

SEQ ID NO: 101747 - protein, 212 aa, Rhizobium meliloti
MTYAENLWLFFTLLFGIIIVPGMDMVFVLANAMTGGRASGLSATAGIVAGGVLHTLYAALGVSVVLHLVPQLFNLLLAAGAAYIAWIGFSLLRSSITISGVEGGARLSRWASFRQGALTSLMNPKAYLFMLAVYPQFLKPQFGPVWSQAAVMAVMIALTQLAVYGGLALAAGRGRDFLVGSPGATVTIGRLAGLLLVVIAVFTVWHGWSGAA

SEQ ID NO: 101748 - DNA, 555 bp, Rhodococcus fascians
  CDS (1)..(555)
atgttggcggtcaagcactcgcttaccggcggtgtgcgtcacggcatcgccgtagctttgggtgcggcgacggggtcgatggcctggggcatcgctgcggccgtggggttggcgtccttgctcaccagcgtccccggggcattcgacgcggtacgtatcgcaggtgccgcctacctggtgtttctaggaattcagagtatctggcagcgcaagggcagcttcaccgacgtcgatgccgcgacttacaacgcgcaccagccgaagtggtcgcgagcgttcatgaccggtttcgtcgcggacctgttgaatccgaaaatgggtgcgttctacctggcggtgctgccgcagttcattccgcgcgacgggaacgttttcgtttggtccatgctgctcatgtcgatcgagttcgtggtggcgctgatatgtctgtcctcgtacgcacttcttgcctcgtccgctcgccggttcttggagaagggccgcttgggggcgtggctcgagcgtggactgggtgttgttctggtgggattcggcgtccggctggccttcgagtaa

SEQ ID NO: 101749 - protein, 184 aa, Rhodococcus fascians
MLAVKHSLTGGVRHGIAVALGAATGSMAWGIAAAVGLASLLTSVPGAFDAVRIAGAAYLVFLGIQSIWQRKGSFTDVDAATYNAHQPKWSRAFMTGFVADLLNPKMGAFYLAVLPQFIPRDGNVFVWSMLLMSIEFVVALICLSSYALLASSARRFLEKGRLGAWLERGLGVVLVGFGVRLAFE

SEQ ID NO: 101750 - DNA, 615 bp, Rhizobium loti
  CDS (1)..(615)
atggaccttgccaccatccttgctttcgcggccgccttcttcgtctttgccgccagcccaggccccgacaacatgaccatcgttgcccgcacgatctccagcggcgccgcgtcgggcatcgcctatggcgccggcacggtggtaggcattcttatcttcctgatgctcgcagccttcggcctgtcgatcgtcgccgccaagatggcgatcgtcatgacgttgcttcgctatgggggagcggcctatctgatctggatgggcgtcaagctctggacggccgtgcccgtcgtgccggagctccagcccgtctccggccggcgcgggctgctgacgatcttcgccaccggtgtcgcgctcaatctcggcaatccgaaaatgccgctgttctatgtggcgctgctgcccaacgtcgtcggtgcctcgctcacaccagcgcatctcggcatcctcgtcgcggtgatcctggctgtcgagattgtggtgatcggcgggcatgtcctccttgccggccgcgcccgcagcctgttgcgcacgcccaggatcgtgcgccgggtcaaccgcgcggcggggggcgtcatgatcggcgccggcgttgccgtggtcgccacgcgctaa

SEQ ID NO: 101751 - protein, 204 aa, Rhizobium loti
MDLATILAFAAAFFVFAASPGPDNMTIVARTISSGAASGIAYGAGTVVGILIFLMLAAFGLSIVAAKMAIVMTLLRYGGAAYLIWMGVKLWTAVPVVPELQPVSGRRGLLTIFATGVALNLGNPKMPLFYVALLPNVVGASLTPAHLGILVAVILAVEIVVIGGHVLLAGRARSLLRTPRIVRRVNRAAGGVMIGAGVAVVATR

SEQ ID NO: 101752 - DNA, 627 bp, Rhizobium loti
  CDS (1)..(627)
atgatcgatttgtcgacatcgatcgcctataccgccgtcgtgctcggctttgtctttattccaggtccggccacgctgctgacgatcgctcgggcaacgagttcgggaacgaaggtcgggatcgcgaccggcgccgggatcgcggccggcgacatttttcacactgtcatggcgatactcggcatctcggcgatcatcgccacctcggcgacgctgttcagcatcgtaaaatatatcggtgcggcctacctcgtttacctcggcattcgcgccatcatcgagaaaacgccggccgatccctctgccggcgcgcttgcgatctccgccggcaaggcgtttcggcaggccgtcctgaccgaagtgctcaaccccaagaccgcactgtttttcctagcattcctgcctcagttcgtacggcccgaaaacggaacggtgatgcttcaattggccgtgctgggaattgtcttcgtcgtgctcggccttttcagcacggtcgtctttgccgtgagcgccggtcgcctcggctctttcctgcgccgaaatccgaccgtgctgaaatggcagggcaaggttgtcggcggcatctactgtgccttgggcgtgcgcctggccttgcagcaacgctga

SEQ ID NO: 101753 - protein, 208 aa, Rhizobium loti
MIDLSTSIAYTAVVLGFVFIPGPATLLTIARATSSGTKVGIATGAGIAAGDIFHTVMAILGISAIIATSATLFSIVKYIGAAYLVYLGIRAIIEKTPADPSAGALAISAGKAFRQAVLTEVLNPKTALFFLAFLPQFVRPENGTVMLQLAVLGIVFVVLGLFSTVVFAVSAGRLGSFLRRNPTVLKWQGKVVGGIYCALGVRLALQQR

SEQ ID NO: 101754 - DNA, 639 bp, Rhizobium loti
  CDS (1)..(639)
atgaatgtcgatctccatcagttgctcatcgtctttgctgcatatgtcattgccgcggggagccccggcccgagcaacatgcgcattatgggggttgcgatggcgcgcggcagaggtgctgcgctcatgcttgcctccggcgtcgtcagcggctcgatcttttggggttttatggcctccaccggcatctccgccctgttggccaggtacgcccaggcactgctcgttctgcaggttttcggggggctttacctgctattcctcgccttcagggcgggacggtcggcgcttacgtcgaacgagaagctggcggtgcgcgcatcgaccgaccaagtcgctctttcgcggggtgagctctataggaagggcctcttgatgcatttggcgaacccaaaatccgtgctggcatggatcgcgctcgtcacgctggggatcggtccgaattcatcgtggcaaagcatcgcggcgatattgggtggctgcgccatcctaagtgtcacgatattctgcggctacgccattgtcttctccacaccgcctatggtggctctatatcgccgctgccgccgctggatcgaaagtctgttggcgatgttcttcgcgttcgccgggctgcgtatgctgctttcccgtatgtag

SEQ ID NO: 101755 - protein, 212 aa, Rhizobium loti
MNVDLHQLLIVFAAYVIAAGSPGPSNMRIMGVAMARGRGAALMLASGVVSGSIFWGFMASTGISALLARYAQALLVLQVFGGLYLLFLAFRAGRSALTSNEKLAVRASTDQVALSRGELYRKGLLMHLANPKSVLAWIALVTLGIGPNSSWQSIAAILGGCAILSVTIFCGYAIVFSTPPMVALYRRCRRWIESLLAMFFAFAGLRMLLSRM

SEQ ID NO: 101756 - DNA, 642 bp, Rhizobium loti
  CDS (1)..(642)
atgtccttcattcccgacaccgccacgctgatccagttcgccatcgccacggtcatcctggcgatcacgcccgggccggacatgaccctgttcgtttcgcgcacgctgagccaggggcgcgccaccggctttgcctcgatggcgggcgcgctgtgcggcacgctgatccacaccacgctggtggtggtcggggtctcggcgctgatcgtcgcctcgccgatggccttcttcgtgctgaagatctttggcgccggctatctcgtcttcctggcctggcaggccatcgccaagggctcggccttttcgccggagaagaagacaggcccgcaaatctcgctgctgcgcagctgggcggccgggctcggcgtcaatttgctcaacccgaagatcatcctgttcttcatgaccttcctgccgcaattcgtctccgcgcatgatccgcacgcgccgggcaagctgttcttcctgggcttgatgttcatcgtgctgtcgatcccggtgacggcgccgatggtgctggcggcagagaaattctccgcggcgatgaaggccagcccgcgcgtcacgcgggtggtcgactatctcttcgccggcgtgttctcagccttcgcgctcaagatcctgacggcccaggcgaagtag

SEQ ID NO: 101757 - protein, 213 aa, Rhizobium loti
MSFIPDTATLIQFAIATVILAITPGPDMTLFVSRTLSQGRATGFASMAGALCGTLIHTTLVVVGVSALIVASPMAFFVLKIFGAGYLVFLAWQAIAKGSAFSPEKKTGPQISLLRSWAAGLGVNLLNPKIILFFMTFLPQFVSAHDPHAPGKLFFLGLMFIVLSIPVTAPMVLAAEKFSAAMKASPRVTRVVDYLFAGVFSAFALKILTAQAK

SEQ ID NO: 101758 - DNA, 633 bp, Rhizobium loti
  CDS (1)..(633)
atgccgtcgaccgaactgctcattgcgtttttcgccaccacggcgatcttcgcctatatccccggtccggccatgctctatgccgccgcgcagacgctggcgcgtgggcggtggtcgggactgacggcagcacttggcatccatctcggcggttatgtgcatgtctttgccgccgccgccggcctgtcggtgttgttccatgccgtgccgccgctctacatggcggtcaagctgatcggtgcgctctatctgatctggctcggtgtctcgctgtttcgcaagcgcgtcgagggcgacgtggcgctgcctgcgattgaacggaaatcggcccgccgcgcctttttcgagagcatcaccgtcgaagtgctcaatccgaaaaccgcgatcttcttcatggcgttcctgccgcagtttatcgacgcctcggcggccttgccggtgtggctgcaattcgtggtgctgggcaccatcgtcaatctgatgttctcctcggccgacattgtctgcgtgttcctcgccggcctcgtgatcagccggctgcggcgttcgagccgggcgcagcgggtgatgcagcgggcaggcggggcggtgctggtcgggctcggcgtccacgttgccctgcagaagagctga

SEQ ID NO: 101759 - protein, 210 aa, Rhizobium loti
MPSTELLIAFFATTAIFAYIPGPAMLYAAAQTLARGRWSGLTAALGIHLGGYVHVFAAAAGLSVLFHAVPPLYMAVKLIGALYLIWLGVSLFRKRVEGDVALPAIERKSARRAFFESITVEVLNPKTAIFFMAFLPQFIDASAALPVWLQFVVLGTIVNLMFSSADIVCVFLAGLVISRLRRSSRAQRVMQRAGGAVLVGLGVHVALQKS

SEQ ID NO: 101760 - DNA, 612 bp, Rhizobium loti
  CDS (1)..(612)
atgacaccaacggcatttctggcttattgcgccgccgtcacactcgccgccgccacgccggggcctgcgatgttcacggtcatcaccaatggtgtgtcgcgcggtttccttcgcgccttcatggccggtgtcggggttgccgccggcgatgccgtgctggtcactctggcgctgctcggccttgtggcgctggcgcaaacattcgaatggatatttctcctgctgaaatatgcaggcgccgcctatctgatctttctcggcatcaggatgtggcgcgcctcggccacgcaatcgaatgagccgcggacgggtgaggcgagattgtcccggtccttcttcctcggcgcgtccattgcgctgggcaaccccaaggcgatcctgttccacgcctcgatcatgccgctgatcctcaacctcgacacgctgacattcgtcgatggcctgctggtggtggccaccgtcatcagcgtcaatatcctgaccatgggggtctacgcagcccttgcgggccgggcttcgggctggttcaggacgccgaagcgcatgcggctgatgaaccggtttgccggcagcgccatgatcggcaccggagcgctgattgccgcacgctga

SEQ ID NO: 101761 - protein, 203 aa, Rhizobium loti
MTPTAFLAYCAAVTLAAATPGPAMFTVITNGVSRGFLRAFMAGVGVAAGDAVLVTLALLGLVALAQTFEWIFLLLKYAGAAYLIFLGIRMWRASATQSNEPRTGEARLSRSFFLGASIALGNPKAILFHASIMPLILNLDTLTFVDGLLVVATVISVNILTMGVYAALAGRASGWFRTPKRMRLMNRFAGSAMIGTGALIAAR

SEQ ID NO: 101762 - DNA, 645 bp, Pasteurella multocida
  CDS (1)..(645)
atgatgttaaatcttattattgtacattttttcggtttaatcacgccaggacccgactttttttatgtcagtcgattagctgccagtaattcacgtcgtaatgcactttgtgccgtgattggtattaccttaggggtgttgttttgggcattagcctctattttaggtttagccatattatttaatacggttcctgttttacagggattagtcatgactttaggcggtgggtatttagcctacttgggttaccttatgttaaaaagtcaacaaaatgtggttttcgagccagtttctgaacaagaacaaaataaacagaccagcatcaaaaaagaaatcaccaaagggcttttagtgaatttatctaatgctaaagcggtgatttactttgctagtgtgatgtctttggttttagttaatttaacccaaacatggcagatctggagcgcacttttgatcattgtattggaaactttcctgtatttttatgccatttcaattgttttttcacgtcaacaggcaaagcagttttatagtcaatatagccgatatattgatcatctttcaggcgtgatttttctgctgtttggtgtgtatttaatgtatagtggtatcggggaaatgaccccacttatctcgaaatga

SEQ ID NO: 101763 - protein, 214 aa, Pasteurella multocida
MMLNLIIVHFFGLITPGPDFFYVSRLAASNSRRNALCAVIGITLGVLFWALASILGLAILFNTVPVLQGLVMTLGGGYLAYLGYLMLKSQQNVVFEPVSEQEQNKQTSIKKEITKGLLVNLSNAKAVIYFASVMSLVLVNLTQTWQIWSALLIIVLETFLYFYAISIVFSRQQAKQFYSQYSRYIDHLSGVIFLLFGVYLMYSGIGEMTPLISK

SEQ ID NO: 101764 - DNA, 621 bp, Salmonella typhimurium
  CDS (1)..(621)
atgatgatgctatttttcaccgtggcaatggtgcacatcgttgcgctaatgagccccggccccgactttttcttcgtgtctcaaactgctgtcagccgttcgcgtaaagaagcgatgatgggcgtactgggcatcacctgcggcgtgatggtatgggcgggcgtggcgctgcttggcctgcatctcatcatcgaaaaaatggcctggctgcatacgatcattatggtaggcggcggcctgtacctgtgctggatgggctatcagatgctgcgcggcgcgctgaaaaaacaggatgcggcggcgtcttctccgcacattgaactggcgcagagcgggcgcagctttctcaaagggctgctgaccaatctgtcgaatcctaaagcgattatctattttggttccgttttttcactttttgtcggcgataacgtcggcgctgcggcgcgctggggtattttcgcgttaatcaccctggaaacgctggcctggtttaccgtagtcgccagcctgttcgcgctgccgaaaatgcgccgtggctatcagcgtctggcgaaatggattgatggctttgccggcgctctgtttgcgggctttggtattcacctgattatttcgcgctaa

SEQ ID NO: 101765 - protein, 206 aa, Salmonella typhimurium
MMMLFFTVAMVHIVALMSPGPDFFFVSQTAVSRSRKEAMMGVLGITCGVMVWAGVALLGLHLIIEKMAWLHTIIMVGGGLYLCWMGYQMLRGALKKQDAAASSPHIELAQSGRSFLKGLLTNLSNPKAIIYFGSVFSLFVGDNVGAAARWGIFALITLETLAWFTVVASLFALPKMRRGYQRLAKWIDGFAGALFAGFGIHLIISR

SEQ ID NO: 101766 - DNA, 27 bp, Artificial sequence
  primer
atgatgcagttagttcacttatttatg

SEQ ID NO: 101767 - DNA, 22 bp, Artificial sequence
  primer
ttaccgctgcgtcaccccttcg

SEQ ID NO: 101768 - protein, 202 aa, Artificial sequence
  Variant (3)..(24): xaa in position 3 to 24 is any amino acid
  Variant (25)..(25): xaa in position 25 is any or no amino acid
  Variant (27)..(29): xaa in position 27 to 29 is any amino acid
  Variant (31)..(40): xaa in position 31 to 40 is any amino acid
  Variant (42)..(58): xaa in position 42 to 58 is any amino acid
  Variant (59)..(59): xaa in position 59 is any or no amino acid
  Variant (61)..(62): xaa in position 61 to 62 is any amino acid
  Variant (65)..(93): xaa in position 65 to 93 is any amino acid
  Variant (94)..(123): xaa in position 94 to 123 is any or no amino acid
  Variant (125)..(130): xaa in position 125 to 130 is any amino acid
  Variant (134)..(136): xaa in position 134 to 136 is any amino acid
  Variant (138)..(194): xaa in position 138 to 194 is any amino acid
  Variant (195)..(201): xaa in position 195 to 201 is any or no amino acid
PGXXXXXXXXXXXXXXXXXXXXXXXGXXXGXXXXXXXXXXGXXXXXXXXXXXXXXXXXXGXXYLXXXXXXXXXXXXXXXXXXXXXXXXXXXXXXXXXXXXXXXXXXXXXXXXXXXXXXXXXXXGXXXXXXNPKXXXFXXXXXXXXXXXXXXXXXXXXXXXXXXXXXXXXXXXXXXXXXXXXXXXXXXXXXXXXXXXXXXXXG

SEQ ID NO: 101769 - protein, 68 aa, Artificial sequence
  Variant (3)..(11): xaa in position 3 to 11 is any amino acid
  Variant (12)..(12): xaa in position 12 is Ser, Ala, Thr or Gly
  Variant (13)..(18): xaa in position 13 to 18 is any amino acid
  Variant (19)..(19): xaa in position 19 is any or no amino acid
  Variant (20)..(20): xaa in position 20 is Gly, Ala, Ser or Thr
  Variant (21)..(25): xaa in position 21 to 25 is any amino acid
  Variant (26)..(26): xaa in position 26 is Gly or Ala
  Variant (27)..(29): xaa in position 27 to 29 is any amino acid
  Variant (30)..(30): xaa in position 30 is Gly, Ala or Ser
  Variant (31)..(40): xaa in position 31 to 40 is any amino acid
  Variant (42)..(42): xaa in position 42 is Leu, Ile, Val, Ala or Phe
  Variant (43)..(44): xaa in position 43 to 44 is any amino acid
  Variant (45)..(45): xaa in position 45 is Leu, Ile, Val or Phe
  Variant (46)..(54): xaa in position 46 to 54 is any amino acid
  Variant (55)..(55): xaa in position 55 is any or no amino acid
  Variant (56)..(56): xaa in position 56 is Leu, Ile, Val, Met or Phe
  Variant (57)..(59): xaa in position 57 to 59 is any amino acid
  Variant (60)..(60): xaa in position 60 is Gly or Ala
  Variant (61)..(61): xaa in position 61 is Ala, Gly or Val
  Variant (62)..(62): xaa in position 62 is any amino acid
  Variant (63)..(63): xaa in position 63 is Tyr or Trp
  Variant (64)..(64): xaa in position 64 is Leu or Ile
  Variant (65)..(65): xaa in position 65 is any amino acid
  Variant (66)..(66): xaa in position 66 is Tyr, Trp or Phe
  Variant (67)..(67): xaa in position 67 is Leu, Ile, Met, Phe or Tyr
  Variant (68)..(68): xaa in position 68 is Gly or Ala
PGXXXXXXXXXXXXXXXXXXXXXXXXXXXXXXXXXXXXXXGXXXXXXXXXXXXXXXXXXXXXXXXXXX

SEQ ID NO: 101770 - protein, 23 aa, Artificial sequence
  Variant (1)..(1): xaa in position 1 is Gly, Ala or Ser
  Variant (2)..(7): xaa in position 2 to 7 is any amino acid
  Variant (8)..(8): xaa in position 8 is Asn or Ser
  Variant (9)..(9): xaa in position 9 is Pro or Ala
  Variant (10)..(10): xaa in position 10 is Lys or Gln
  Variant (11)..(12): xaa in position 11 to 12 is any amino acid
  Variant (13)..(13): xaa in position 13 is Leu, Val, Ile, Phe, Met or Ala
  Variant (14)..(14): xaa in position 14 is Phe, Tyr, Ala, Val, Met or Leu
  Variant (15)..(15): xaa in position 15 is Phe, Tyr, Trp, Leu, Val or Cys
  Variant (16)..(22): xaa in position 16 to 22 is any amino acid
  Variant (23)..(23): xaa in position 23 is Val, Ile, Met, Leu, Ala or Thr
XXXXXXXXXXXXXXXXXXXXXXX

SEQ ID NO: 101771 - DNA, 1149 bp, Escherichia coli K12
  CDS (1)..(1149): transl_table=11
atgtatgcattaacccagggccggatctttaccggccacgaatttcttgatgaccacgcggttgttatcgctgatggcctgattaaaagcgtctgtccggtagcggaactgccgccagagatcgaacaacgttcactgaacggggccattctctcccccggttttatcgatgtgcagttaaacggctgcggcggcgtacagtttaacgacaccgctgaagcggtcagcgtggaaacgctggaaatcatgcagaaagccaatgagaaatcaggctgtactaactatctgccgacgcttatcaccaccagcgatgagctgatgaaacagggcgtgcgcgttatgcgcgagtacctggcaaaacatccgaatcaggcgttaggtctgcatctggaaggtccgtggctgaatctggtaaaaaaaggcacccataatccgaattttgtgcgtaagcctgatgccgcgctggtcgatttcctgtgtgaaaacgccgacgtcattaccaaagtgaccctggcaccggaaatggttcctgcggaagtcatcagcaaactggcaaatgccgggattgtggtttctgccggtcactccaacgcgacgttgaaagaagcaaaagccggtttccgcgcggggattacctttgccacccatctgtacaacgcgatgccgtatattaccggtcgtgaacctggcctggcgggcgcgatcctcgacgaagctgacatttattgcggtattattgctgatggcctgcatgttgattacgccaacattcgcaacgctaaacgtctgaaaggcgacaaactgtgtctggttactgacgccaccgcgccagcaggtgccaacattgaacagttcatttttgcgggtaaaacaatatactaccgtaacggactttgtgtggatgagaacggtacgttaagcggttcatccttaaccatgattgaaggcgtgcgtaatctggtcgaacattgcggtatcgcactggatgaagtgctacgtatggcgacgctctatccggcgcgtgcgattggcgttgagaaacgtctcggcacactcgccgcaggtaaagtagccaacctgactgcattcacacctgattttaaaatcaccaagaccatcgttaacggtaacgaggtcgtaactcaataa

SEQ ID NO: 101772 - protein, 382 aa, Escherichia coli K12
MYALTQGRIFTGHEFLDDHAVVIADGLIKSVCPVAELPPEIEQRSLNGAILSPGFIDVQLNGCGGVQFNDTAEAVSVETLEIMQKANEKSGCTNYLPTLITTSDELMKQGVRVMREYLAKHPNQALGLHLEGPWLNLVKKGTHNPNFVRKPDAALVDFLCENADVITKVTLAPEMVPAEVISKLANAGIVVSAGHSNATLKEAKAGFRAGITFATHLYNAMPYITGREPGLAGAILDEADIYCGIIADGLHVDYANIRNAKRLKGDKLCLVTDATAPAGANIEQFIFAGKTIYYRNGLCVDENGTLSGSSLTMIEGVRNLVEHCGIALDEVLRMATLYPARAIGVEKRLGTLAAGKVANLTAFTPDFKITKTIVNGNEVVTQ

SEQ ID NO: 101773 - DNA, 870 bp, Rattus norvegicus
  CDS (1)..(870)
atgcgtagcgggcagtccgcagcgttggctcccgtgctccagttcaccaactgccgcatcctgcgcggcggcacgctgctcagggaggatctgtgggtgcgcgggggccgaatcctggacccagagaagctgttttttgaggagaggcgtgtggctgatgagcagcgggactgcggaggccgcatcctggcgccgggctttatcgatgtgcagatcaacggtggatttggtgttgacttctccagggccacggaggacgtgggttcgggggtcgccctagtggcccggaggctcctgtcccacggtgtcacctccttctgtcccaccctggtgacctccccaccagaggtttatcacaaggtccttcctcagatccctgtgaagagtggaggtccccatggggcaggggtcctcggggtgcacttggaaggcccgttcatcagccgggaaaagcggggtgcacaccctgaggcctacctccgctcctttggagccaatgcttttcatgacgtgttggccacgtacggtcccctggacaacgtctgcattgtgacacttgcccctgaactagaccggagccatgaggtgatccaggcactgacagccaaaggcatccgtgtatctctggggcactcggtggctgacctgcgggctgcagaagtagcagtgcagagtggggccaccttcatcactcacctcttcaacgccatgttgcctttccaccaccgtgacccaggcatagtagggcttctgaccagtgaccagctgcccccaggccactgtatcttctatgggatgattgccgatggcatacacactaaccctgcagccctgcgcattgctcaccgggcccatccccagggtgagtag

SEQ ID NO: 101774 - protein, 289 aa, Rattus norvegicus
MRSGQSAALAPVLQFTNCRILRGGTLLREDLWVRGGRILDPEKLFFEERRVADEQRDCGGRILAPGFIDVQINGGFGVDFSRATEDVGSGVALVARRLLSHGVTSFCPTLVTSPPEVYHKVLPQIPVKSGGPHGAGVLGVHLEGPFISREKRGAHPEAYLRSFGANAFHDVLATYGPLDNVCIVTLAPELDRSHEVIQALTAKGIRVSLGHSVADLRAAEVAVQSGATFITHLFNAMLPFHHRDPGIVGLLTSDQLPPGHCIFYGMIADGIHTNPAALRIAHRAHPQGE

SEQ ID NO: 101775 - DNA, 1320 bp, Homo sapiens
  CDS (1)..(1320)
atgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtga

SEQ ID NO: 101776 - protein, 439 aa, Homo sapiens
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGELVWQADAARQ

SEQ ID NO: 101777 - DNA, 1173 bp, Mesorhizobium loti MAFF303099
  CDS (1)..(1173): transl_table=11
atgagcgaccgttttgccctgactggcgcccgcattttcgacggtgacgactggcatgacgatgccgcactcgtcgtgcgcgacggccttgtcgaggcgattgtgccctccggcgccattgccagggatgtccgcgccgtcgacaccggtggcggcatgctggtgccgggcttcgtcgacatccaggtcaatggcggcggcggggtcatgctcaacgaccaccccgatgttgcctcgatcgaaaccatctgccgggcgcatgcacccttcggcacgacggcgctgctgccgacgctgatcaccgacacgcccgcgatcaccgctgccgccatcgccgccggcgaggccgccgcgctgcaaaaggtgcccagcttcctcggcctgcatctggaaggcccgcacctgtcgatcgcgcgcaagggcgcgcatgatccggcgctgatccggccgatgacggatgccgaccaggtgatgctgatcgcggcgcggccaaagctgccggtgctgctcaccacgatcgcgccggaatccgtcgatcccacccgtgttgcggccttggccaaggccggcatcatcgtcagcctcggccattccgatacgggctacgccacggcaaagggcttcgccgaggccggcgccgccgtggtcacgcatctgttcaacgcgatgagccagatcggcaaccgcgagcccggcctcgtcggcgcggccatcgacatcggcacattgtccgccgggctgatcgccgacggcatccatgtccatccggcagccatcaggatcgcgctcgacgccaaacaggggccgggcaagatcgtgctggtcaccgacgccatggcgacgatcggcaccgacatgacctcgttcacgctcaacggccgcaccatctaccgcaaggacgggagcctgcggcttgccgacggcacgctggccggcgccgacctcgacatgatctcggccgtgcggttcatgcacaatatcgtcggtgtcgatctgtccgaggccttgcgcatggcttcgctctatccggcgcaggcgatcggccagtcgcaccggcttggccgcctggccaacggcacggtggccgacatcgttgcgctgtcggacggtctcgacataagaagcgtgtggatcggcggcgacaaggtgttcgaggccggcgcttcacgctaa

SEQ ID NO: 101778 - protein, 390 aa, Mesorhizobium loti MAFF303099
MSDRFALTGARIFDGDDWHDDAALVVRDGLVEAIVPSGAIARDVRAVDTGGGMLVPGFVDIQVNGGGGVMLNDHPDVASIETICRAHAPFGTTALLPTLITDTPAITAAAIAAGEAAALQKVPSFLGLHLEGPHLSIARKGAHDPALIRPMTDADQVMLIAARPKLPVLLTTIAPESVDPTRVAALAKAGIIVSLGHSDTGYATAKGFAEAGAAVVTHLFNAMSQIGNREPGLVGAAIDIGTLSAGLIADGIHVHPAAIRIALDAKQGPGKIVLVTDAMATIGTDMTSFTLNGRTIYRKDGSLRLADGTLAGADLDMISAVRFMHNIVGVDLSEALRMASLYPAQAIGQSHRLGRLANGTVADIVALSDGLDIRSVWIGGDKVFEAGASR

SEQ ID NO: 101779 - DNA, 1206 bp, Borrelia burgdorferi B31
  CDS (1)..(1206): transl_table=11
atgccaaatttttgcttatttaactcaaaatccgttttaactggaaatgataaaatagataactcagcggttctaattaaagataataaaatttttgatattgtaacgtctgacagacttaaaaaaatggatctcgaagaataccaaatgattgacacaaaaggcaattatataactcccggactttacgacaatcatattcatggatttcacggtcatgggacagaccagtgttcaacagaatcgatacttaaaatgtcagaacatttagcacaatacggtgtagtaggatttttaccaaccctttacccaagaccaatagatgaaatgattaaaacaataaaagcttgcatagcagcaattggtaaagaaaagggagctaaaattttgggacttcaccttgaaggaccatttttctctcctgaaaaaaaaggagctcatccagtttcttatcttcatgaacctagtattgaagttatgcaaaaactaatagatgcagctggtggagtatttacaggatcaaacggcaaaagaaaaacacatataagcacaatgactgttgctcctgagcttaagggtatgagagagcttgcaatattttgccttgaaaacaacataaaccttcaagcgggacacacaaatgcaacatatgaaaacatgatagaaggatttcaagttggaatacttcatacaacccattttttcaacgcaatgtcaaaacttgaccacagaaatccaaatgcaataggagcggtgttaatacacggcgatgtttcttgcgaaattattgcagatggccaccatatacacccaaaattaattttaatgcttagaaagcttaaagatataagtaaaatagtccttgtaactgacggacttactccgaattgtcaaacttgtggaaaactaattgcaaacggagacgaagtttatattgcagaagatggattattccatagcgtgaaaagcaacacaatagctggatcaacactcacaatgatacaaggtcttaaaaatttaatagaatttggtttcagcttaagcgatgctgttcaagcaagctcttacaatccaacaagaattctcaatattgataaaaagggcttaatatgtcatggatatgatgcaaacctcaatgtcctagataaagattttaatctaaagttaacaatgatagaatctaaaataatttttaacaatctctaa

SEQ ID NO: 101780 - protein, 401 aa, Borrelia burgdorferi B31
MPNFCLFNSKSVLTGNDKIDNSAVLIKDNKIFDIVTSDRLKKMDLEEYQMIDTKGNYITPGLYDNHIHGFHGHGTDQCSTESILKMSEHLAQYGVVGFLPTLYPRPIDEMIKTIKACIAAIGKEKGAKILGLHLEGPFFSPEKKGAHPVSYLHEPSIEVMQKLIDAAGGVFTGSNGKRKTHISTMTVAPELKGMRELAIFCLENNINLQAGHTNATYENMIEGFQVGILHTTHFFNAMSKLDHRNPNAIGAVLIHGDVSCEIIADGHHIHPKLILMLRKLKDISKIVLVTDGLTPNCQTCGKLIANGDEVYIAEDGLFHSVKSNTIAGSTLTMIQGLKNLIEFGFSLSDAVQASSYNPTRILNIDKKGLICHGYDANLNVLDKDFNLKLTMIESKIIFNNL

SEQ ID NO: 101781 - DNA, 1152 bp, Mycobacterium tuberculosis H37Rv
  CDS (1)..(1152): transl_table=11
gtgaccgtgctcggcgccgacgccgtcgtcatcgacggccggatatgccggccagggtgggtgcacaccgccgatggtcggattctctccggtggcgctggggcaccgcccatgccggccgacgcggaattccccgatgcgatcgtggtgcccggctttgtcgatatgcatgtgcacggcgggggcggcgcgtcgttcgccgacggcaacgccgcagacatcgcccgtgcggccgagtttcacctgcggcacggcaccactaccacgctggccagtctggtcaccgcgggccccgccgagttgctctccgccgtgggcgctttggccgaggcaactcgggacggcgtcgtcgcgggcatccatctggaggggccgtggctgagcccagcgcggtgcggagcgcacgaccacacccggatgcgtgccccggatcccgccgagatcgagtcggtgctcgccgccgccgacggcgccgtccggatggtcacgttggcacccgagttgcccggaagcgatgcggcgatccggcgcttccgtgacgccgaagtggttgtcgccgtggggcatacggatgcgacctacacacagacccgacacgccatcgacctgggcgcgacagtcggcacccacctgttcaacgcgatgccgccgctggaccatcgggcgcccggacccgtgctggcgttgctgtgcgacccgcgggtgaccgtcgaaatcatcgccgacggcgtgcacgtgcaccccgcggtggtgcacgcggtgatcgaagccgtcggtcccgatcgggtcgccgtggtcaccgacgcgatcgccgcggccggatgcggcgatggcgcgttccggctcggcacaatgccgatcgaggtcgagtcgagcgtggcacgggtggctggtgcgtcgacgctggcgggcagcaccaccaccatggatcagctcttccggacggtggctgggctcggctcgaagtcggactcagccggcgatgtggcgctggccgccgcggtgcaggtgacctcggcgacgccggcccgcgctctcgggctcaccggggtgggccggctggcggcgggctatgccgccaatcttgttgtgctggaccgtgatctgcgggtgacggccgtcatggtcaacgatgactggcgggtgggctga

SEQ ID NO: 101782 - protein, 383 aa, Mycobacterium tuberculosis H37Rv
MTVLGADAVVIDGRICRPGWVHTADGRILSGGAGAPPMPADAEFPDAIVVPGFVDMHVHGGGGASFADGNAADIARAAEFHLRHGTTTTLASLVTAGPAELLSAVGALAEATRDGVVAGIHLEGPWLSPARCGAHDHTRMRAPDPAEIESVLAAADGAVRMVTLAPELPGSDAAIRRFRDAEVVVAVGHTDATYTQTRHAIDLGATVGTHLFNAMPPLDHRAPGPVLALLCDPRVTVEIIADGVHVHPAVVHAVIEAVGPDRVAVVTDAIAAAGCGDGAFRLGTMPIEVESSVARVAGASTLAGSTTTMDQLFRTVAGLGSKSDSAGDVALAAAVQVTSATPARALGLTGVGRLAAGYAANLVVLDRDLRVTAVMVNDDWRVG

SEQ ID NO: 101783 - DNA, 1095 bp, Thermotoga maritima MSB8
  CDS (1)..(1095): transl_table=11
atgattgttgagaaagttctgatcgttgatcccatcgatggagagttcaccggggacgtggagatagaagagggaaagatcgtgaaagttgagaagagagaatgcattccacggggtgttctcatgcccgggtttgttgatccgcacatccacggtgtggtgggtgcagacaccatgaactgcgacttctctgaaatggaagaatttctctactctcagggagtcaccacgttccttgccacaactgtttccacttcgctcgaaaaaatgaaagaaattctgagaaaagcaagagattacatccttgaaaacccgtcaacatcgctgctgggcgttcatctggagggaccttacatctcgaaagaaaaaaagggagcacactcagagaaacacataagaccaccttcggagagagaactgagtgaaatcgactctccggcgaagatgctcaccttcgcacctgagatagaaagctccgaacttcttttgagactcgtgaaaagagacatcgttctctctgcgggacactccatcgcaacttttgaggagttcatgaaattctacaaagagggtgtcaagagaatcacacattttccgaacgggttgaaacctcttcatcacagggagataggaatcactggagcggggcttttgctggacgatgtgaagctggagctcatctgcgacggggtgcatctctccagagagatggtgaagctcgtctacaaagtgaaaaaagcgaacggaatcgttctggtcacagattctatatctgcggcgggtctcaaagacggaacaaccaccctgggagatcttgtggttaaggtgaaagacggtgttccaaggctggaagacggtacgctcgcgggaagcacgctctttttctcgcaggccgtgaagaacttcagaaagttcacagggtgttccattacagaacttgcaaaagtgtcctcgtacaacagctgtgttgaactgggactggatgacagaggaagaatagccgaaggaacgagggcggatcttgttcttctcgatgaagatttgaacgttgtgatgacgatcaaagagggtgaggtagtttttcgatccagatga

SEQ ID NO: 101784 - protein, 364 aa, Thermotoga maritima MSB8
MIVEKVLIVDPIDGEFTGDVEIEEGKIVKVEKRECIPRGVLMPGFVDPHIHGVVGADTMNCDFSEMEEFLYSQGVTTFLATTVSTSLEKMKEILRKARDYILENPSTSLLGVHLEGPYISKEKKGAHSEKHIRPPSERELSEIDSPAKMLTFAPEIESSELLLRLVKRDIVLSAGHSIATFEEFMKFYKEGVKRITHFPNGLKPLHHREIGITGAGLLLDDVKLELICDGVHLSREMVKLVYKVKKANGIVLVTDSISAAGLKDGTTTLGDLVVKVKDGVPRLEDGTLAGSTLFFSQAVKNFRKFTGCSITELAKVSSYNSCVELGLDDRGRIAEGTRADLVLLDEDLNVVMTIKEGEVVFRSR

SEQ ID NO: 101785 - DNA, 1137 bp, Vibrio cholerae O1 biovar eltor str. N16961
  CDS (1)..(1137): transl_table=11
atggcattaaaggcaatttcagccacacggctttttgatggaattcagtattacgagaatgcggcaatggtttgggaaggttcacacattcactccattgttcctattgagtctctgacggaggatattgagcatcaacattttgatggtgcattgatcgctccaggattcattgacttacaagttaatggcggtggcgatgtcatgttcaataatgacatgactcttgcgggtattgattcgatctgccgagcacacagaactcacggcaccgcctatctgcttccaaccttaatcagtgcaacaccggaacacatcaaccgtgcacttgatgccattcaatctgcaatcgaaaatcaagtctcgggtgtgttgggtattcacttagaggggccttggttaaacccagaaaagaaaggcgctcataacccagatctgttctattccccgacacccgaacaactttcacagtttcactggccaaccaaaggcaaagttcttgtaacggtcgcggctgaaaacctctccatcgactcactaaagtggttaaaggatcatcatgttactctctcgtgtggtcacagtaatgccactacagcccaattaaccactgagaagttagctctcattgatggatttacccacttatttaatgccatgtcgccttttgagagtcgtgaacccggagttgtcggtacagcattgaataccgatcatgcttggtgttcagtaataactgatggaattcatgtccatccacaaagttttttactcgctaagcgaatcaaacctaaagacaaacttcttattgttaccgatgccatggctagccttggcagtgtgactagccagtttgaattggatggggaaaccattcgcgtcatcgataataaactgattaatagcagaggcaatcttgcgggagcacacatcgggatggatgaatcggttgccaatgttattcgttggggaatcgcggaagatgaagcattaaaaatggcctcgtcttatccggctcaagcaattcaatgtgatgatttagggcaactaaaacccaattatcgagccgccgccactgtattaaactccaaatatgaaagcttggctgtagtcagtgaaggcgtgctctacaactga

SEQ ID NO: 101786 - protein, 378 aa, Vibrio cholerae O1 biovar eltor str. N16961
MALKAISATRLFDGIQYYENAAMVWEGSHIHSIVPIESLTEDIEHQHFDGALIAPGFIDLQVNGGGDVMFNNDMTLAGIDSICRAHRTHGTAYLLPTLISATPEHINRALDAIQSAIENQVSGVLGIHLEGPWLNPEKKGAHNPDLFYSPTPEQLSQFHWPTKGKVLVTVAAENLSIDSLKWLKDHHVTLSCGHSNATTAQLTTEKLALIDGFTHLFNAMSPFESREPGVVGTALNTDHAWCSVITDGIHVHPQSFLLAKRIKPKDKLLIVTDAMASLGSVTSQFELDGETIRVIDNKLINSRGNLAGAHIGMDESVANVIRWGIAEDEALKMASSYPAQAIQCDDLGQLKPNYRAAATVLNSKYESLAVVSEGVLYN

SEQ ID NO: 101787 - DNA, 1194 bp, Bacillus halodurans C-125
  CDS (1)..(1194): transl_table=11
atggagaacggaaattgcgtattaaaaggagcttcgatcgttggtgaaacacagtcatacgacaaaggttttctaaaagtagaagatggcatcattacggaagtaacagaacaagagatcgagaatcacaggcatgataagtcgattgatctttcgggatgttatgtcgttccgggctttatcgatgtccatatccacggatcacacggtgccgatacaatggacgcatctcaaatatgtctagaaacgatcgcaaaaagcattgtacgggaaggaacaacaggatttttagcaacgaccatcacccaagggcaagggcggattgagcaagcattagccaatgtggcagaatatgcaaaaggacctcacaacgaaggagcccaactgttaggggtccatctagaaggcccctttatttcagcaaaacgagcaggcgcccaaccagttgaacatattttagagccaaacctatccctgtttaataggtggtacgaggtatccggtcgcacaatcaaattagttacgctggcacctgaaacagagcaaggcctgcaattggtcggtgcacttcggtctagacaaattattgcatcaatcggacattcagatgcggtgcacgaacagatgatggacgccatatcccacggtgcgaaccatgtcacccacctttacaacgggatgaggggcttccaccatcgtgagcctggcgttgcaggaacagcgttagcgcgaaatgagttgacggttgaactgatcgttgatggcattcatgtccatcctgaggttgtcaaagctacttatgatgcgaaaacagcagataacatcattctcattacagatgcgatgcgtgcaaaatggttagccgacggaacctacgagcttggaggacaaaccgtccatgtgaagaacggaaaagcattgctacaggacggaacgttggcaggcagcgtattaaaaatgaacgatgcggtaaaaaatgtgatgacctacacaggatgttcattagaagaagcggtccaaatggcgagcgtgaatcctgctaaacagctaaatgtttttgatcgtaaagggagcattcgagtcggaaaagacgcagaccttaccgtactcgatcaagactggaatgttgtcctcacgatgtgccaaggaaggattgtttatcagaaaggagccaagtcctatgaaaatcattga

SEQ ID NO: 101788 - protein, 397 aa, Bacillus halodurans C-125
MENGNCVLKGASIVGETQSYDKGFLKVEDGIITEVTEQEIENHRHDKSIDLSGCYVVPGFIDVHIHGSHGADTMDASQICLETIAKSIVREGTTGFLATTITQGQGRIEQALANVAEYAKGPHNEGAQLLGVHLEGPFISAKRAGAQPVEHILEPNLSLFNRWYEVSGRTIKLVTLAPETEQGLQLVGALRSRQIIASIGHSDAVHEQMMDAISHGANHVTHLYNGMRGFHHREPGVAGTALARNELTVELIVDGIHVHPEVVKATYDAKTADNIILITDAMRAKWLADGTYELGGQTVHVKNGKALLQDGTLAGSVLKMNDAVKNVMTYTGCSLEEAVQMASVNPAKQLNVFDRKGSIRVGKDADLTVLDQDWNVVLTMCQGRIVYQKGAKSYENH

SEQ ID NO: 101789 - DNA, 1137 bp, Pasteurella multocida subsp. multocida str. Pm70
  CDS (1)..(1137): transl_table=11
atgtacgcgtttgttaatgccgtaatttacactgcaaaagacgtactttatggtaaagcgcttgttgtcgatggcgataaaattagtgcaattctacccgtagaagacgtgccagaaaatcttcagaaaattgatttacaagggaataatttaactgcaggttttattgatcttcaattaaatggctgtggtggtgtgatgtttaatgaagatattagcgtgaagacgttagagatcatgcaagaaactaatttgaaatccggcacgacaagttatttaccaacctttattacgtcacctgatgaaggaatgaaagacgcggtgaaggtgatgcgtgagtatttaactcagtataaaaatcaagcattaggtttacactttgaaggaccatatttgagtgttgagaaaaaaggggtacatcgcgaagaatatattcgtgcgataagcccagaaatgaaaacattcttgtgtgataatgcagatgtgattactaaaatcacgttggcagccgaaaatccaacggcacagtatattccagactttgttgaaaaagggattatcgtctcgcttggacactcgaatgcgacttacgatgtcgcacaacaggctattgagaaaggggcgagttttgcaacccatttacataatgcaatgtcaccaatcagctctggacgagcgatgggagtagtgggcgccgtattagattctgatatctatacaggtattattgtggatggtttacacgttgattatggcaatatacgactcgacaagaaagtaaaaggcgacaaattgtgtattgtgacagatgcaactgctgcagccggtgcagacattgactcctttgttttcgtcggtaaaaccgtctatgtgcgtgatggtaaatgctatgatagcaatggtacattaggtggcgctgcaatcacgatgattgagtcagtgaaaaatgcggtacaggaagttggcattccattggatgagacattacgtatgtgtaattactatcctgctaaagcaattggtgtggatcataaacttggctcaattgaagtgggtaaaatcgcgaatttaacagcattcacaaatgattttaacgtgttgggtacagccgtgaatggtgaatggaaagcgaagtaa

SEQ ID NO: 101790 - protein, 378 aa, Pasteurella multocida subsp. multocida str. Pm70
MYAFVNAVIYTAKDVLYGKALVVDGDKISAILPVEDVPENLQKIDLQGNNLTAGFIDLQLNGCGGVMFNEDISVKTLEIMQETNLKSGTTSYLPTFITSPDEGMKDAVKVMREYLTQYKNQALGLHFEGPYLSVEKKGVHREEYIRAISPEMKTFLCDNADVITKITLAAENPTAQYIPDFVEKGIIVSLGHSNATYDVAQQAIEKGASFATHLHNAMSPISSGRAMGVVGAVLDSDIYTGIIVDGLHVDYGNIRLDKKVKGDKLCIVTDATAAAGADIDSFVFVGKTVYVRDGKCYDSNGTLGGAAITMIESVKNAVQEVGIPLDETLRMCNYYPAKAIGVDHKLGSIEVGKIANLTAFTNDFNVLGTAVNGEWKAK

SEQ ID NO: 101791 - DNA, 1092 bp, Pseudomonas aeruginosa PAO1
  CDS (1)..(1092): transl_table=11
atgctcgaaggcaacattctcaccccgcaaggctgggtcctcggccgcctacacatccaggacgggcgtatccagcggatcgaaggcgagccctgcgatccggccggcaacgccgatccgtacctgctgccaggcttcatcgacctgcatgtgcacggcggcggcggccgcgacatcatggaaggcggcgacgccttcgccaccatcgcccgcacccaccggcgcttcggcacgacctcgctgctggccaccaccatgaccgcaccgcgcgaggagatcgccgacatcctcagccagctcggcgcttactgccgccgctcgctggagggcggttcacggatactcggcgtgcacctggaaggcccctacatcaactccggcaagctcggcgcgcagcccaacttcgcccatgccgcggtgctcgaggaagtcgaggactacctgcgccgcgcgccgatccgggtgatcaccatcgcccccgagatcgccggacaccggccgctgatccgcgccctcgccgagcgcggcgtacgcctgcagatcggccataccctgggcagctacgaggacggcgtggccgcactggaagccggcgccagcagcttcacccacctctacaacgcgatgaccggcctgcaccaccgcgaaccgggtatcgtcggcgcggccctggcccacgcacgctacgccgagctgatccccgacctgctgcatgtccatcccggcgccatcagggtggccctgcgttcgatcccgtgcctgtactgcgtgaccgactccaccgccgccgccggcatgcccgacggccagtacaagctcggcagccacacggtgaccaagtgcctgggcggcgtgcgcctgcccgacggcactctggccggcagcaccctgaccatggaccaggcgctgcgcaacctggtgaagatcggcctgcccctggccgaagcctcgcaacgcctttcgcaattccccgccgattacctcggcctcgccgagcgcggccgcctggcgcccgcagcctgggccgatgtggtgcgcctggatcgctccctggaactcgacgccgtgatggtggaaggagaactcgaatga

SEQ ID NO: 101792 - protein, 363 aa, Pseudomonas aeruginosa PAO1
MLEGNILTPQGWVLGRLHIQDGRIQRIEGEPCDPAGNADPYLLPGFIDLHVHGGGGRDIMEGGDAFATIARTHRRFGTTSLLATTMTAPREEIADILSQLGAYCRRSLEGGSRILGVHLEGPYINSGKLGAQPNFAHAAVLEEVEDYLRRAPIRVITIAPEIAGHRPLIRALAERGVRLQIGHTLGSYEDGVAALEAGASSFTHLYNAMTGLHHREPGIVGAALAHARYAELIPDLLHVHPGAIRVALRSIPCLYCVTDSTAAAGMPDGQYKLGSHTVTKCLGGVRLPDGTLAGSTLTMDQALRNLVKIGLPLAEASQRLSQFPADYLGLAERGRLAPAAWADVVRLDRSLELDAVMVEGELE

SEQ ID NO: 101793 - DNA, 1149 bp, Lactococcus lactis subsp. lactis Il1403
  CDS (1)..(1149): transl_table=11
atgacttactatattaaagcagatcaatttttctacgcttatgaaacaaaaaaaggtggtttcttagaaattactgatggaaaatttggagagtggacagaagaagcaccagcaggagctgacattttagattattcaggtcaatcaattgccccaggtcttgttgaaacacatatccatggttttggtggagcggatgcccaagatgctgaagttgaaggaattatgggaacaatgtcagaaggcttgttgtcagcaggggtcacatcatttttaccaagtcctttgaccgatgatcatgaaggattgaaagcagtttgtacggttgtaggagaacattaccaagaagctcgcggagccaaagttcgtggtattttctttgaaggtccattctttacagaggaaaagaaaggggctcaaaaccctaaatacatgcgcgatgccaaaatgtgggaacttgaagattggcaagaagctgcacatggaatgctcaaaaaaatcggtcttgccccagaacgtgatggttcagaagacttcatccgtaaagcaactgaatcaggtgttgttattgcattgggacattcaaatgcgacttataaacaagcagttgctggggtacaagctggagcatctgtttgggttcacacctttaacggaatgtctggaatgactcaccaagaaccaggaatggttggagcaattttaaatacaccaaacacttatgctgagttaatttgtgatggtcaccatgttcgtccagaagcagctgaaattgtaatgaaaatgaaaggtgctgaccatgttgttttgattacagactcaatgcgtgccgcaggacttcctgacggaccttatatgcttggcgaatacgaagtagaagttcgtgacggagccgcatggcttccaacaggacgccctgctgcttcaattttaacactcaaaacagctgttaaaaatgtcattgactgggggattgccacaccagcagaagcaattatgatggcttcattgacaccagcaaaatctgtaaacattgatgatgtttgtggtcaaataaaaccaggtttgtcagctgattttatcgttttagacaatgattttgatttagttgcaacttatcttgatggtgaaaaacgctatgaagcgtaa

SEQ ID NO: 101794 - protein, 382 aa, Lactococcus lactis subsp. lactis Il1403
MTYYIKADQFFYAYETKKGGFLEITDGKFGEWTEEAPAGADILDYSGQSIAPGLVETHIHGFGGADAQDAEVEGIMGTMSEGLLSAGVTSFLPSPLTDDHEGLKAVCTVVGEHYQEARGAKVRGIFFEGPFFTEEKKGAQNPKYMRDAKMWELEDWQEAAHGMLKKIGLAPERDGSEDFIRKATESGVVIALGHSNATYKQAVAGVQAGASVWVHTFNGMSGMTHQEPGMVGAILNTPNTYAELICDGHHVRPEAAEIVMKMKGADHVVLITDSMRAAGLPDGPYMLGEYEVEVRDGAAWLPTGRPAASILTLKTAVKNVIDWGIATPAEAIMMASLTPAKSVNIDDVCGQIKPGLSADFIVLDNDFDLVATYLDGEKRYEA

SEQ ID NO: 101795 - DNA, 1122 bp, Deinococcus radiodurans R1
  CDS (1)..(1122): transl_table=11
atgacctccccctcttctctgagtggccgcctgctgttgccgggcggctctttcgtgtccggcaccctgcacttcggcacccacatcacggcactggaggaggggccgataaacggcccactcatcctccccggtttcgtggacacccacctccacggcgggggcggcggcgacgcgatggacggcgcggagggcgtccgcaccctggcgcggctgcacgcccggcatgggacgacgaccctgctgcccaccacgatgaccaatccctgggacaaggtgcttgcggccctgcgcggcgtgcgcgaggtgatggacgcgggtggcgtgcccggcggcgccgacgtgcccggagcgcacctcgaagggccgttcatcagcccccagcgccttggggcccagccaccctgcacgctggcgccgacgcctgagcgggtggccgaagtgctcgcgctggacgtggtgagcgccgtcacgctggcacccgaagtggagggcggcctggccgccgcactcaccttcgcgcaggccggcgtgcgcgtgggcattgggcacacggcagcggacgcggacaccgtgcgcgcgtgcttgcaggcggttcacgcggcgggcgggcgcacggcgggcacccacctcttcaacgcgatgggcggcattcagggccgcgaaccgggggtgccgggggcgctgctggccgacccgcacgccttcgccgagatgatcctcgacggctttcacctgcacccgctgagcttcctgctcgcgcgcgcggcggcctcggagcgcatcctgctcatcaccgacgccatgcgcgctgccgggcaaggcgacggcgagagcgaactcggcgggcagcccgtcaccgtcaccggggggcgtgcagcgctggccaacggcagtctggccggtagcgtcctgacgatggacgtggccctgaaaaatgctgtgtcagtgggcgttcccctgcctgaagcgagccggatgctcagcctcgcccccgcccgctcgctggggctggaggaccggggcgaactgcgggtgggcaagcgcgccgacctggtggtgctcaatgacgacttggaagttcaggaagtgtacgtcggcggggagcggctggcccgctaa

SEQ ID NO: 101796 - protein, 373 aa, Deinococcus radiodurans R1
MTSPSSLSGRLLLPGGSFVSGTLHFGTHITALEEGPINGPLILPGFVDTHLHGGGGGDAMDGAEGVRTLARLHARHGTTTLLPTTMTNPWDKVLAALRGVREVMDAGGVPGGADVPGAHLEGPFISPQRLGAQPPCTLAPTPERVAEVLALDVVSAVTLAPEVEGGLAAALTFAQAGVRVGIGHTAADADTVRACLQAVHAAGGRTAGTHLFNAMGGIQGREPGVPGALLADPHAFAEMILDGFHLHPLSFLLARAAASERILLITDAMRAAGQGDGESELGGQPVTVTGGRAALANGSLAGSVLTMDVALKNAVSVGVPLPEASRMLSLAPARSLGLEDRGELRVGKRADLVVLNDDLEVQEVYVGGERLAR

SEQ ID NO: 101797 - DNA, 1134 bp, Escherichia coli O157:H7 EDL933
  CDS (1)..(1134): transl_table=11
atgacacacgttctgcgcgccagaaggctgctgactgaagagggatggctcgatgaccatcagttgcgtattgctgacggtgtcatcgcagcaatcgaaccgattccagtgagcgtgactgaacgcgatgcggaactgctctgccccgcttacatcgacacccatgtacacggtggtgcgggcgttgatgtaatggatgacgcgccggatgtactcgacaagctggcaatgcacaaggcacgcgaaggtgtcggcagttggttgccgactaccgtaaccgcgccgcttagtaccattcatgcggcgctgaaacgtattgctcaacgttgccaacgcggcggacctggtgcgcaagtgctggggagttatctcgaaggaccgtacttcacgccgcagaataaaggcgcgcatccgccggagttgtttcgcgagcttgaaattgccgagctggatcaattgattgccgtttctcagcacaccttacgcgtggtagcgctggcaccggaaaaagagggggcattgcaggccatccgccatcttaaacagcaaaatgtacgagtgatgctggggcatagcgcggcgacctggcaacaaactcgcgccgcgtttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcaatgtcsctgtgttgttgctgtgcgaaagagagaatcgtactgatcaccgacgcgatgcaggcagccgggatgccggatggtcgctatacgttatgtggcgaagaagtgcagatgcacggtggcgttgtccgtaccgcgtccggtgggctggcgggcagtacgctgtctgttgatgcggcagtgcgcaacatggtcgagttgacgggcgtaacgcctgcggaagccattcatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttga

SEQ ID NO: 101798 - protein, 377 aa, Escherichia coli O157:H7 EDL933
MTHVLRARRLLTEEGWLDDHQLRIADGVIAAIEPIPVSVTERDAELLCPAYIDTHVHGGAGVDVMDDAPDVLDKLAMHKAREGVGSWLPTTVTAPLSTIHAALKRIAQRCQRGGPGAQVLGSYLEGPYFTPQNKGAHPPELFRELEIAELDQLIAVSQHTLRVVALAPEKEGALQAIRHLKQQNVRVMLGHSAATWQQTRAAFDAGADGLVHCYNGMTGLHHREPGMVGAGLTDKRAWLELIADGHHVHPAAMSLCCCCAKERIVLITDAMQAAGMPDGRYTLCGEEVQMHGGVVRTASGGLAGSTLSVDAAVRNMVELTGVTPAEAIHMASLHPARMLGVDGVLGSLKPGKRASVVALDSGLHVQQIWIQGQLASF

SEQ ID NO: 101799 - DNA, 1161 bp, Xylella fastidiosa 9a5c
  CDS (1)..(1161): transl_table=11
gtgatgggtgcttcttctggggtcgccggattcatcaatggccgtgtcctgatcgataccgggttccgtcatgatctggcggtgctattgcgcggtggatgcattcaagcactgctgccgcatgatgatccgcgggtgacggagggggcgcagtggatggacttgcggggaggtctgttgctgcctgggtttatcgatatccaggtgaatggtggcggtggtgtgctgttcaataatgcgcgtgatgtggatgcgttggcgacgatcgcgcgtgcgcaccgtcgctacgggacgacgggactgttaccgacattgattagtgacactgtggaggtgatggctgaggccattgctgccacgcgtgccgcgattgctcagggggtaccgggaatcctcgggattcacttggaaggcccttacctcaatccgctccgtaaagggacccatgaccacactcagttccgtgtgccgcagttgcatgaggtgatgcggtgcacggcattggataacggggtgactctggtgacgttggcgcctgagcaggtgccgcttgagatgatccgtgtttttgtcgagcgtggtgcgatcgtctttgctgggcatactgcagcgacgtatgagcaagtgcgcgctggcatcgcagcgggtgtcacagggtttacgcatctgtacaacgcgatgtcgcagttagtcgggcgcgagccgaatgtggtgggtgctgcgctggaagatccggatacatggtgcgggatcatcgttgatggcgtacacgtgcatccggcgagtctgcgtgtggccttagccgccaagccgcgcggtaaggtgctgctggtgaccgatgcgatgccgccagttggcagtgacagtgttcactacgatctctatggtgaaacgattacggtgatggatggtgtggtccgtaatgcggctggtgcgttggcgggtgcggcgctggatatggcaacggcggtgcgcaatacggtgcattggttgggtgttgatttggctgaggctgtgcgcatggcctcgacctatccggcgcagtgcatcgggttaggggatcgtctggggaggattgcgcctggttatcaagccgacctagtgtggattgacgacgacgtgcaggtacagggcacgtggattgctggtgtgggcgattga

SEQ ID NO: 101800 - protein, 386 aa, Xylella fastidiosa 9a5c
MMGASSGVAGFINGRVLIDTGFRHDLAVLLRGGCIQALLPHDDPRVTEGAQWMDLRGGLLLPGFIDIQVNGGGGVLFNNARDVDALATIARAHRRYGTTGLLPTLISDTVEVMAEAIAATRAAIAQGVPGILGIHLEGPYLNPLRKGTHDHTQFRVPQLHEVMRCTALDNGVTLVTLAPEQVPLEMIRVFVERGAIVFAGHTAATYEQVRAGIAAGVTGFTHLYNAMSQLVGREPNVVGAALEDPDTWCGIIVDGVHVHPASLRVALAAKPRGKVLLVTDAMPPVGSDSVHYDLYGETITVMDGVVRNAAGALAGAALDMATAVRNTVHWLGVDLAEAVRMASTYPAQCIGLGDRLGRIAPGYQADLVWIDDDVQVQGTWIAGVGD

SEQ ID NO: 101801 - DNA, 1155 bp, Escherichia coli O157:H7
  CDS (1)..(1155): transl_table=11
atgtccggtcgaggaagggatatgacacacgttctgcgcgccagaaggctgctgactgaagagggatggctcgatgaccatcagttgcgtattgctgacggtgtcatcgcagcaatcgaaccgattccagtgagcgtgactgaacgcgatgcggaactgctctgccccgcttacatcgacacccatgtacacggtggtgcgggcgttgatgtaatggatgacgcgccggatgtactcgacaagctggcaatgcacaaggcacgcgaaggtgtcggcagttggttgccgactaccgtaaccgcgccgcttagtaccattcatgcggcgctgaaacgtattgctcaacgttgccaacgcggcggacctggtgcgcaagtgctggggagttatctcgaaggaccgtacttcacgccgcagaataaaggcgcgcatccgccggagttgtttcgcgagcttgaaattgccgagctggatcaattgattgccgtttctcagcacaccttacgcgtggtagcgctggcaccggaaaaagagggggcattgcaggccatccgccatcttaaacagcaaaatgtacgagtgatgctggggcatagcgcggcgacctggcaacaaactcgcgccgcgtttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagccgggatgccggatggtcgctatacgttatgtggcgaagaagtgcagatgcacggtggcgttgtccgtaccgcgtccggtgggctggcgggcagtacgctgtctgttgatgcggcagtgcgcaacatggtcgagttgacgggcgtaacgcctgcggaagccattcatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttga

SEQ ID NO: 101802 - protein, 384 aa, Escherichia coli O157:H7
MSGRGRDMTHVLRARRLLTEEGWLDDHQLRIADGVIAAIEPIPVSVTERDAELLCPAYIDTHVHGGAGVDVMDDAPDVLDKLAMHKAREGVGSWLPTTVTAPLSTIHAALKRIAQRCQRGGPGAQVLGSYLEGPYFTPQNKGAHPPELFRELEIAELDQLIAVSQHTLRVVALAPEKEGALQAIRHLKQQNVRVMLGHSAATWQQTRAAFDAGADGLVHCYNGMTGLHHREPGMVGAGLTDKRAWLELIADGHHVHPAAMSLCCCCAKERIVLITDAMQAAGMPDGRYTLCGEEVQMHGGVVRTASGGLAGSTLSVDAAVRNMVELTGVTPAEAIHMASLHPARMLGVDGVLGSLKPGKRASVVALDSGLHVQQIWIQGQLASF

SEQ ID NO: 101803 - DNA, 1041 bp, Mycobacterium tuberculosis CDC1551
  CDS (1)..(1041): transl_table=11
atgccggccgacgcggaattccccgatgcgatcgtggtgcccggctttgtcgatatgcatgtgcacggcgggggcggcgcgtcgttcgccgacggcaacgccgcagacatcgcccgtgcggccgagtttcacctgcggcacggcaccactaccacgctggccagtctggtcaccgcgggccccgccgagttgctctccgccgtgggcgctttggccgaggcaactcgggacggcgtcgtcgcgggcatccatctggaggggccgtggctgagcccagcgcggtgcggagcgcacgaccacacccggatgcgtgccccggatcccgccgagatcgagtcggtgctcgccgccgccgacggcgccgtccggatggtcacgttggcacccgagttgcccggaagcgatgcggcgatccggcgcttccgtgacgccgaagtggttgtcgccgtggggcatacggatgcgacctacacacagacccgacacgccatcgacctgggcgcgacagtcggcacccacctgttcaacgcgatgccgccgctggaccatcgggcgcccggacccgtgctggcgttgctgtgcgacccgcgggtgaccgtcgaaatcatcgccgacggcgtgcacgtgcaccccgcggtggtgcacgcggtgatcgaagccgtcggtcccgatcgggtcgccgtggtcaccgacgcgatcgccgcggccggatgcggcgatggcgcgttccggctcggcacaatgccgatcgaggtcgagtcgagcgtggcacgggtggctggtgcgtcgacgctggcgggcagcaccaccaccatggatcagctcttccggacggtggctgggctcggctcgaagtcggactcagccggcgatgtggcgctggccgccgcggtgcaggtgacctcggcgacgccggcccgcgctctcgggctcaccggggtgggccggctggcggcgggctatgccgccaatcttgttgtgctggaccgtgatctgcgggtgacggccgtcatggtcaacgatgactggcgggtgggctga

SEQ ID NO: 101804 - protein, 346 aa, Mycobacterium tuberculosis CDC1551
MPADAEFPDAIVVPGFVDMHVHGGGGASFADGNAADIARAAEFHLRHGTTTTLASLVTAGPAELLSAVGALAEATRDGVVAGIHLEGPWLSPARCGAHDHTRMRAPDPAEIESVLAAADGAVRMVTLAPELPGSDAAIRRFRDAEVVVAVGHTDATYTQTRHAIDLGATVGTHLFNAMPPLDHRAPGPVLALLCDPRVTVEIIADGVHVHPAVVHAVIEAVGPDRVAVVTDAIAAAGCGDGAFRLGTMPIEVESSVARVAGASTLAGSTTTMDQLFRTVAGLGSKSDSAGDVALAAAVQVTSATPARALGLTGVGRLAAGYAANLVVLDRDLRVTAVMVNDDWRVG

SEQ ID NO: 101805 - DNA, 1188 bp, Sulfolobus solfataricus P2
  CDS (1)..(1188): transl_table=11
ttgcaatggatatatgcaaaaatgaagagcccaaattatttaaatactcgcatgaagttgcgtgtttcttatacggtaaggtgggtgaaagtgagtaagtgtatcagaggactagagataataaccccattagaaagttttagggatgacatagtaatatctgatggtgaaataaggaaaattggaagtggaatctgcaatgaggaaataaaagtagatagaggtaaatatgtaatacctggaatgattgatattcatactcacggtatagggggaattcttgtaaatgacattagaagtattaatgactatgagaaaatggtatcctattattattcacatggtgtaaccactttcattccatcaacaatttctgaaaatgttgaaaaattagtgagtatagcaagggttttaaatgaagttaaaagtattgggatacaccttgagggaccgttaataaatccgaatagagctggtgcacataaattctttactagattcgacgaacgaattttagaaatttctaaactctttaaaataaagagaattactatagcaccagagattttgagtgataaagaattagagaatttagcggataactttcaagtttctttaggtcatacggacgctaattcagatgataccagaagagctataggttttggagcatcatcagttacacatttgttcaatgctatgaggccattccatcatagagatcccggaataattggtgtttcgttaacttctccgatatacgctgaagtaatatcagatttggtacacattaatgagattacactaagtattgtaagtaagttaaagggggataagacaattctagtgactgattccttacaagctgcgggattaggcgaaggagaatttttactatatggagaaaaaattacttgcgataaggcttgtttcgaggctaataaaaggcttgtaggtagtaacataactttggatgaaggcgtgagacgtgttagtaaaataattggattaagagaagcgataaaatatgtaacgtattctccagcatctctacttaacttagaaaaaataggacagatatctaggggttatgttgcagatttagttatattggatgaaaacctcaatgtgctcacaacgttaaaaagtggtagtatagtcttctccatctttaaaaattcatcataa

SEQ ID NO: 101806 - protein, 395 aa, Sulfolobus solfataricus P2
MQWIYAKMKSPNYLNTRMKLRVSYTVRWVKVSKCIRGLEIITPLESFRDDIVISDGEIRKIGSGICNEEIKVDRGKYVIPGMIDIHTHGIGGILVNDIRSINDYEKMVSYYYSHGVTTFIPSTISENVEKLVSIARVLNEVKSIGIHLEGPLINPNRAGAHKFFTRFDERILEISKLFKIKRITIAPEILSDKELENLADNFQVSLGHTDANSDDTRRAIGFGASSVTHLFNAMRPFHHRDPGIIGVSLTSPIYAEVISDLVHINEITLSIVSKLKGDKTILVTDSLQAAGLGEGEFLLYGEKITCDKACFEANKRLVGSNITLDEGVRRVSKIIGLREAIKYVTYSPASLLNLEKIGQISRGYVADLVILDENLNVLTTLKSGSIVFSIFKNSS

SEQ ID NO: 101807 - DNA, 1152 bp, Streptococcus pneumoniae TIGR4
  CDS (1)..(1152): transl_table=11
atgcctaactatattaaagcggatcagtttttctacccacacggagttcgtcgaggtggttacttggaacttgtggacggcaagtttgggaaacatgtagagcagattcctgaaggggctgaggtgattgactatacaggttatagcattgccccaggtcttgtggatactcatattcatggatatgcaggtgtagatgtgatggacaacaacattgaaggtacattgcatactatgagtgaaggacttcttagtaccggtgttaccagtttcttacccacaactttaacagccacttatgagcaattgcttgcagtcactgaaaatcttggaaaccattataaagaagcaacaggtgctaagattcgtgggatttattatgaaggtccatatttcacagaaacttttaagggggcacaaaatccaacttatatgagagacccgggtgttgaggagtttcattcttggcaaaaagcggcaaatggcttgcttaataaaattgcccttgcaccagaacgtgatggggtggaagactttgttcgtacagttacgggcgaaggtgtgacggttgctcttggacattcaaacgcgacttttgatgaagccaaaaaagcaatcgatgctggagcgagtgtttgggtgcatgcctacaatggaatgcgtgggttgactcaccgtgaattggggatggttggagccatgtaccaattgccacatacctatgcagagttgatctgtgatggtcaccacgtagatccaaaggcttgcgaaattcttatcaaacaaaaaggaacagaaaacatcgctcttatcacagactgtatgacagctgggggattggaagacggagattatatgttgggagaattcccagttgtcgttgcaaatggaactgcacgcctcaaatcgacaggtaacttggcaggttctatcctcaaactcaaagatggtttgaagaatgtggtcgaatggggaattgcgaatccgcatgaagcagtcatgatggccagcttcaacccagctaaatccgttcacatcgatgacgtctgtggccaaatccgtgaaggctacgacgctgacttcatcgtattagataaagatttggaattggtagcaacctacctagatggcgtaaaacgttatcaagcataa

SEQ ID NO: 101808 - protein, 383 aa, Streptococcus pneumoniae TIGR4
MPNYIKADQFFYPHGVRRGGYLELVDGKFGKHVEQIPEGAEVIDYTGYSIAPGLVDTHIHGYAGVDVMDNNIEGTLHTMSEGLLSTGVTSFLPTTLTATYEQLLAVTENLGNHYKEATGAKIRGIYYEGPYFTETFKGAQNPTYMRDPGVEEFHSWQKAANGLLNKIALAPERDGVEDFVRTVTGEGVTVALGHSNATFDEAKKAIDAGASVWVHAYNGMRGLTHRELGMVGAMYQLPHTYAELICDGHHVDPKACEILIKQKGTENIALITDCMTAGGLEDGDYMLGEFPVVVANGTARLKSTGNLAGSILKLKDGLKNVVEWGIANPHEAVMMASFNPAKSVHIDDVCGQIREGYDADFIVLDKDLELVATYLDGVKRYQA

SEQ ID NO: 101809 - DNA, 1146 bp, Clostridium acetobutylicum ATCC 824
  CDS (1)..(1146): transl_table=11
atgaaagctataattaacggaaaaataattaccgaagatagcatacttgaaaataaagttttactatttgatgaaaaaataatagatattgtagatgaaaaaaaccttgataggaaaacaacttatgtaatagatgcagaaggcaactacgtttctcctggttttatagatgttcatatacatggtttcagtggtgcagatactatggatggaaccctcgatgctcttaaaaccataagtagagatataacaaaaaatggtgttacatctttcctaccaactaccatgacaatggacagacaaaaaatttatactgccttagatactataagagaagcgagtacaaagtgcttaggtggtgctaatattctaggtgcccatcttgaaggtccttttataagcgaaaaatttaagggtgcgcaagctaaaactcacatattaaagcctgattatgattttattaaggactatatagatattataaagataataactttagcacctgaagaggatgaaaatctcgaattcataaaaactgttaaaaagaattcagatatagttttatcaataggtcactcaaatgcctcctatgacgaagctgtaaatgcaattaaaaatggaataaatcatgttactcatatgtttaacgcaatgacacctttaactcacagaaatttaggcgtaataggcgctatatttaacaataatattccatctgaaataatagcagataaaattcatcttcatcctgatatatacaagattcttataaaaacaatcggtactaacaatataaccctaataactgattgtatgagagcgggaggtttaggtgatggagtttcagaacttggcggacagaaagtcatagttaaagatgattctgcaagacttgagaacggaactttagccggaagtatattaactttaaataaagccataaaaaatgtatatgaaaatacagatttaaaacttaacgaagcagtaaaacttgccactataaatccagcaaaaaatataaatgtatttgataaaaagggaagtttaaataatggtaaggattcagatataactatatttaatgatgcttttgaaattaaacttacaatcataggaggagatataattgaaaatagtaactgttaa

SEQ ID NO: 101810 - protein, 381 aa, Clostridium acetobutylicum ATCC 824
MKAIINGKIITEDSILENKVLLFDEKIIDIVDEKNLDRKTTYVIDAEGNYVSPGFIDVHIHGFSGADTMDGTLDALKTISRDITKNGVTSFLPTTMTMDRQKIYTALDTIREASTKCLGGANILGAHLEGPFISEKFKGAQAKTHILKPDYDFIKDYIDIIKIITLAPEEDENLEFIKTVKKNSDIVLSIGHSNASYDEAVNAIKNGINHVTHMFNAMTPLTHRNLGVIGAIFNNNIPSEIIADKIHLHPDIYKILIKTIGTNNITLITDCMRAGGLGDGVSELGGQKVIVKDDSARLENGTLAGSILTLNKAIKNVYENTDLKLNEAVKLATINPAKNINVFDKKGSLNNGKDSDITIFNDAFEIKLTIIGGDIIENSNC

SEQ ID NO: 101811 - DNA, 1152 bp, Streptococcus pneumoniae R6
  CDS (1)..(1152): transl_table=11
atgcctaactatattaaagcggatcagtttttctacccacacggagttcgtcgaggtggttacttggaacttgtggacggcaagtttgggaaacatgtagagcagattcctgaaggggctgaggtgattgactatacaggttatagcattgccccaggtcttgtggatactcatattcatggatatgcaggtgtagatgtgatggacaacaacattgaaggtacattgcatactatgagtgaaggacttcttagtaccggtgttaccagtttcttacccacaactttaacagccacttatgagcaattgcttgcagtcactgaaaatcttggaaaccattataaagaagcaacaggtgctaagattcgtgggatttattatgaaggtccatatttcacagaaacttttaagggggcacaaaatccaacttatatgagagacccgggtgttgaggagtttcattcttggcaaaaagcggcaaatggcttgcttaataaaattgcccttgcaccagaacgtgatggggtggaagactttgttcgtacagttacgggcgaaggtgtgacggttgctcttggacattcaaacgcgacttttgatgaagccaaaaaagcagtcgatgctggagcgagtgtttgggtgcatgcctacaatggaatgcgtgggttgactcaccgtgaattggggatggttggagccatgtaccaattgccacatacctatgcagagttgatctgtgatggtcaccacgtagatccaaaggcttgcgaaattcttatcaaacaaaaaggaacagaaaacatcgctcttatcacagactgtatgacagctgggggattggaagacggagattatatgttgggagaattcccagttgtcgttgcaaatggaactgcacgcctcaaatcgacaggtaacttggcaggttctatcctcaaactcaaagatggtttgaagaatgtggtcgaatggggaattgcgaatccgcatgaagcagtcatgatggccagcttcaacccagctaaatccgttcacatcgatgacgtctgtggccaaatccgtgaaggctacgacgctgacttcatcgtattagataaagatttggaattggtagcaacctacctagatggcgtaaaacgttatcaagcataa

SEQ ID NO: 101812 - protein, 383 aa, Streptococcus pneumoniae R6
MPNYIKADQFFYPHGVRRGGYLELVDGKFGKHVEQIPEGAEVIDYTGYSIAPGLVDTHIHGYAGVDVMDNNIEGTLHTMSEGLLSTGVTSFLPTTLTATYEQLLAVTENLGNHYKEATGAKIRGIYYEGPYFTETFKGAQNPTYMRDPGVEEFHSWQKAANGLLNKIALAPERDGVEDFVRTVTGEGVTVALGHSNATFDEAKKAVDAGASVWVHAYNGMRGLTHRELGMVGAMYQLPHTYAELICDGHHVDPKACEILIKQKGTENIALITDCMTAGGLEDGDYMLGEFPVVVANGTARLKSTGNLAGSILKLKDGLKNVVEWGIANPHEAVMMASFNPAKSVHIDDVCGQIREGYDADFIVLDKDLELVATYLDGVKRYQA

SEQ ID NO: 101813 - DNA, 1116 bp, Sulfolobus tokodaii str. 7
  CDS (1)..(1116): transl_table=11
atggagttaaaattaacaaacgctaagatcataacaccttataaagaaattgaaaggggtagtgtgataattaaagatggtataattagtgaaatattagaggaaaggactgagggggaagacttagagggaatgctcttacttccagcgtttgttgatattcatactcacggaattggtggatatgattatacatcatgggatagtgaggatgatttcataaaaaacgctatagggatgaaaaagaaactgatccaacatggtgtaacaactttcttacctacaacagttacaatgcctagagaaagtctgttggaggcttgtaaggctatatcacagacagatattttaggactccacttagaaggtccttatataagtgaaaaacatgctggtgcacaagatgtaagatatataagaaacccagacaagaatgaagtgttggagtgtgtcagagagagtaataataaagtaataacaataacttattctcccgaaaaagatctggattttattccattcatgttaagtctgggaatttacccttcaataggacatacagatgcagattatgagacagcagttaaagcattcctcttaggtgctagtagggttacacatttatttaatgcaatgagggcatttcatcatagagatccaggcgtaattttagctagtattaatttttctccatttattgaaataattccagactttatacacgttgataaagaggtggtgaggtttttaactaaaatagttgatataaaaagaattgttgcagtaacagattctataatagctactgatcttcaagatggtacttatactttgggtaaaatgaggataagggttgaaaatggtattgcaaggactgaggatggaaaattggccgggagtactttaacaatggataaggcatttaaaaatctatcaagtattataggaataagggaggcttcactcatatgttcatataatccagcaagggcaataggacttagtgacagagggattattgaaaaggggaagagggctgacttaatcgtaatggatgaaaagttgaatgttaaaaaagtatttataaatggagaggagattttttctagcagttag

SEQ ID NO: 101814 - protein, 371 aa, Sulfolobus tokodaii str. 7
MELKLTNAKIITPYKEIERGSVIIKDGIISEILEERTEGEDLEGMLLLPAFVDIHTHGIGGYDYTSWDSEDDFIKNAIGMKKKLIQHGVTTFLPTTVTMPRESLLEACKAISQTDILGLHLEGPYISEKHAGAQDVRYIRNPDKNEVLECVRESNNKVITITYSPEKDLDFIPFMLSLGIYPSIGHTDADYETAVKAFLLGASRVTHLFNAMRAFHHRDPGVILASINFSPFIEIIPDFIHVDKEVVRFLTKIVDIKRIVAVTDSIIATDLQDGTYTLGKMRIRVENGIARTEDGKLAGSTLTMDKAFKNLSSIIGIREASLICSYNPARAIGLSDRGIIEKGKRADLIVMDEKLNVKKVFINGEEIFSSS

SEQ ID NO: 101815 - DNA, 1161 bp, Sinorhizobium meliloti 1021
  CDS (1)..(1161): transl_table=11
atgactgcgaagaagacgatcagcggagcgcggattttcgacggcatcgactggcacgacggggcagccctcgtgatcgaggcaggacacgtcaaggcgattgcgccggcgggaagcgtccccgccggtggcgagaccatcgacgcgcgtggcctgcttctcgtgcccggcttcatcgatctgcaggtgaacggcggcggcggcgcgcttctgaacgaaaagccgtccctcgaaagtatccggcagatctgcgcggcgcatgcgcaattcggcacgacggcgctgctgccgacgctgatcaccgacacgcgcgcggtcaggaccgcggccatcgccgcaggcatcgaggcgaaagccgcggcggttcccggcttcctaggcctgcatctcgaaggcccgcatctttccgtcgcgcgcaagggggctcacgatccggcgctgatccgtccgatgggcgatgacgatcttgccgagatactcgcctgcgcaaaggcgctcagccgtctgatgctcaccgtggccccggaaaacgccaccaaggagcaggtgcgggcgctggccgatgccggcgtcgtggtgagcctcggccataccgacgtggattacgacaccgcctgcgcctatgccaaagcgggtgcccggaccgtcacgcatctcttcaacgccatgagcggactcggccatcgcgagcctggcgtggtcggcgcggcgctttcgaccggcacgctccacgccggcatgatcgccgacggttttcacgttcacccggcctcgatgggcatcgcgctgcgcggcaagaaaggcccgggacagatctttctggtcaccgacgccatgtcgccgatcggcaccgatcagacgagcttcttcctgaacggacgggaaatcctgcgccagggcgggcgcctgacgcttgccgacggcacgcttgccggcgccgatgtcgacatgctttcgtctgtccgcttcgtccaccaaaagcttggcctgccgatcgaggaggcggtccgcatggcctccgcctatcccgccgacgccatggggatcgcctcgcacaagggccggctcctgccgggtacggatgcggatttcgtgctgctcacgccggaactcgcaatgaaatcgacctggatcggcggggagacggtttttgcggcttga

SEQ ID NO: 101816 - protein, 386 aa, Sinorhizobium meliloti 1021
MTAKKTISGARIFDGIDWHDGAALVIEAGHVKAIAPAGSVPAGGETIDARGLLLVPGFIDLQVNGGGGALLNEKPSLESIRQICAAHAQFGTTALLPTLITDTRAVRTAAIAAGIEAKAAAVPGFLGLHLEGPHLSVARKGAHDPALIRPMGDDDLAEILACAKALSRLMLTVAPENATKEQVRALADAGVVVSLGHTDVDYDTACAYAKAGARTVTHLFNAMSGLGHREPGVVGAALSTGTLHAGMIADGFHVHPASMGIALRGKKGPGQIFLVTDAMSPIGTDQTSFFLNGREILRQGGRLTLADGTLAGADVDMLSSVRFVHQKLGLPIEEAVRMASAYPADAMGIASHKGRLLPGTDADFVLLTPELAMKSTWIGGETVFAA

SEQ ID NO: 101817 - DNA, 1137 bp, Caulobacter crescentus CB15
  CDS (1)..(1137): transl_table=11
atgccggctgctctgatcaatggccgcgtcctgacggagagcggcgtcgtcgaaggcaaagccgtcctggtcaaggacggtctgatcctggacgtcatcgaagccgctcagacgccttcggacgccaagcctcgcgacctgaagggcggcctgctggtcccgggtttcatcgacacccaggtcaatggcggcggcggcgtacttttcaatgacgcgcccacggtcgagacgatcgcgacgatcggcgcggcgcaccgtcgcttcgggacaacgggcttcctgcccaccctgatcagcgacgatctgcgcgtcgtcgaccaggcgatgcgcgccaccgaggaggccatcgcgcggggcgtgcctggggtccttgggcttcacatcgagggcccattcctgaaccccaagcgcaaaggcattcatgacgccggaaaattccgggtcatcgacgacgaagcgctggcgctgctcacctcgctcaagcgcggcaaaacgctggtgaccctcgcgccggaacgcaccacgccccagatcatccggcgcctggcggacgccggcgtgatcgtggccgcaggtcataccaacgccctctacgcgaccatgcgtcaggccctggagcatggcctgaccggctttacgcacctcttcaacgccatgtcgcccctgacgagccgcgagcccggcgcagtcggcgcggcgctggagagcccggacgcctggtgcgggatcatcgtcgacggccgccatgtcgacccggtggtgctgaaaatcgctctgcggacccgcgccctcgaccgcttcatgctggtcaccgacgcgatgccgaccgtgggtctgcctgacaagcggttcaatcttcagggccgggatatccgcgtggtcgacggtgtctgcgttgacgaccacggcaccctggcgggatcggatctcgacatgatcggcgcggtgcgcaacgcgatcgacctgctggaccttagcctggacgacgccgtgatgatggcgtctcacgccccggcgagcttcctgggtcttggacacggtcgcggcctgatcgcgccgggctatgcggcggacctatgcttgttgaacgaccgcctggaggtcgcggccacctggatcgacggccaggaaggctga

SEQ ID NO: 101818 - protein, 378 aa, Caulobacter crescentus CB15
MPAALINGRVLTESGVVEGKAVLVKDGLILDVIEAAQTPSDAKPRDLKGGLLVPGFIDTQVNGGGGVLFNDAPTVETIATIGAAHRRFGTTGFLPTLISDDLRVVDQAMRATEEAIARGVPGVLGLHIEGPFLNPKRKGIHDAGKFRVIDDEALALLTSLKRGKTLVTLAPERTTPQIIRRLADAGVIVAAGHTNALYATMRQALEHGLTGFTHLFNAMSPLTSREPGAVGAALESPDAWCGIIVDGRHVDPVVLKIALRTRALDRFMLVTDAMPTVGLPDKRFNLQGRDIRVVDGVCVDDHGTLAGSDLDMIGAVRNAIDLLDLSLDDAVMMASHAPASFLGLGHGRGLIAPGYAADLCLLNDRLEVAATWIDGQEG

SEQ ID NO: 101819 - DNA, 1164 bp, Caulobacter crescentus CB15
  CDS (1)..(1164): transl_table=11
atgccgatcgctctcgtcaatggtcgggtcctgacgccggcgggctttgtcagcggcaaggcggtgctcgtggagaacggcgtggtcgtggcgctgctcgacgccagggacgttccggccgacgcccagcgccacgacctgggcggcgaccgccttgtcccgggcttcatcgacacccaggtcaacggcggcggcggggcgctgttcaacgacgcccccacggcgcgaaccatcgccacgatcggcgaagcgcatcgcgcctatggcacgaccgggttcctgccgaccttgatcagcgacgatctcgaggtggtggacgccgcgctacgcgccaccgaggacgcgatcgcccagggcgttccgggcgttctgggcgtgcacatcgaaggcccgttcctgaaccccaagcgcaaggggatccacgacgaagccaagtttcgggtgatcgatgaggacgcgatcgcgctgctctcatcgctcaagcgcggcaagctgctgttgaccctggcgccggaacgcacgacgcccgacatcattgcgcgcctggccgccgccggcgtcatcgtcgcggcgggccacaccaacgcgcactacgagaccatgcggcgggcgctggatcatggcctgacaggcgtgacccacctgttcaacgccatgtcgcccctcacgagccgcgagcccggcgtggtcggcgcagtgctggaaaaccagaacgcctgggccgggatcattgtcgacgggcgtcacgtcgatccggtgaccctgaagatcgctctgcggacccgtccgctggaccgcttcatgctggtcaccgacgcgatgcccacggtcggcttgaccaacaagcggttcaacctgcaaggccgcgagatcgtggttcgcgacggggtctgcgtcgatgaggccggcaccctggccggctcggacctggacatggccgccgctgtccgcaacgccgtctcgatgctgggcctgacgctggaggacgcggtcatgatggcctcggccgcgccgtcggccctgctgggccttcaacagcggcgcggcgccatcgcgccgggactggccgcagatttctgccgactcgatgacgccctgaacgtcacgagcacctggatcgacgggaaggaaacacatgcccgacaagaggctctgctggtctaa

SEQ ID NO: 101820 - protein, 387 aa, Caulobacter crescentus CB15
MPIALVNGRVLTPAGFVSGKAVLVENGVVVALLDARDVPADAQRHDLGGDRLVPGFIDTQVNGGGGALFNDAPTARTIATIGEAHRAYGTTGFLPTLISDDLEVVDAALRATEDAIAQGVPGVLGVHIEGPFLNPKRKGIHDEAKFRVIDEDAIALLSSLKRGKLLLTLAPERTTPDIIARLAAAGVIVAAGHTNAHYETMRRALDHGLTGVTHLFNAMSPLTSREPGVVGAVLENQNAWAGIIVDGRHVDPVTLKIALRTRPLDRFMLVTDAMPTVGLTNKRFNLQGREIVVRDGVCVDEAGTLAGSDLDMAAAVRNAVSMLGLTLEDAVMMASAAPSALLGLQQRRGAIAPGLAADFCRLDDALNVTSTWIDGKETHARQEALLV

SEQ ID NO: 101821 - DNA, 1134 bp, Listeria monocytogenes EGD-e
  CDS (1)..(1134): transl_table=11
atggctaataaagtaattactaacgctacaatttatactggtaaaggtgttctagaaaatgctttcgtacgttttgataaacaaattttagaggttggctcgatggctgattttcaagcggacaaagcagaagaagtaatcgatgcaaaaggacaaaaacttgttcctggtttcattgatgttcattcacacggtggttatagttttgacgcaatggatgcagatccagaagcacttagaaaacaagtgaacggaatgttaaatgaagggattactacttacttcccaacaacgatgacgcaatcacacgaaaatatcgaaaaagcgctaaaagtgattaacgaagtcgcacaaacagaacctgttattggtgggattcatctagaaggcccatttgtttccaaagtctttaaaggagcgcaaccagaagaatacatccaagcgcctgatttggaacttttcaaaaaatggtttgatatttctggtggcttaattaaattagtaacatatgcaccagagcatgatacttctgctgattttgaaaatttgtgtttcgaactaggggttgttccaagtattgggcactctaatgatgtgcgtgaacacttgaaaacaagtaaagcgacacatgcgacacatttatataatgcttgtcaccgtatgacacaccgtgagccaggcgttccaggtcacgttttactagaacgcggtattaatgcagaactaatcgttgatggtattcacgttcatcctgatatggtgaaattagcttatcaaatgaaagggccagaacatttatgcattatcactgactccatgcgagcaaaaggtatgccagaaggaaaatccgaacttggcggtcaaactgttatcgtaaaagataaacaagctcgtttagaagatggaactttagctggaagtgtgctcacttatgacgacggcttccgcaacatgattaaatttactggatgctcggtagaagaggcagttcttatgtcttctggaaaccaagcacgcgaatttaatttaacacaaaaaggtgcaatcgaggctggtaaagatgcagatttcaacttactagacgaagatttacacattacagcaacttattcattcggaaaaaaacattcttga

SEQ ID NO: 101822 - protein, 377 aa, Listeria monocytogenes EGD-e
MANKVITNATIYTGKGVLENAFVRFDKQILEVGSMADFQADKAEEVIDAKGQKLVPGFIDVHSHGGYSFDAMDADPEALRKQVNGMLNEGITTYFPTTMTQSHENIEKALKVINEVAQTEPVIGGIHLEGPFVSKVFKGAQPEEYIQAPDLELFKKWFDISGGLIKLVTYAPEHDTSADFENLCFELGVVPSIGHSNDVREHLKTSKATHATHLYNACHRMTHREPGVPGHVLLERGINAELIVDGIHVHPDMVKLAYQMKGPEHLCIITDSMRAKGMPEGKSELGGQTVIVKDKQARLEDGTLAGSVLTYDDGFRNMIKFTGCSVEEAVLMSSGNQAREFNLTQKGAIEAGKDADFNLLDEDLHITATYSFGKKHS

SEQ ID NO: 101823 - DNA, 1134 bp, Listeria monocytogenes EGD-e
  CDS (1)..(1134): transl_table=11
atggccgttatcaaaaatgtgaaaatttacaaagaaaatgaattaatcgatgcagtagttattacagaaggaaatttgataaaagaagtttgttcaactactcctgaaaagtattcagatgagccaacttttgatggaaatggacgattgctaattcccggaatgattgacgttcatattcatggggcaaaaaattatgatatgatggatggttcaacagaaagcattcaagctgtatctatggcttgtgcggaaacaggatgtactagttttttagtcacctcggttagttcttctttggaagacttaattcaaatgattagacaaacaaaaaaagtgataggaaaagagaaaggtgccaaaattgcaggaattcacttagaaggcccctaccttaatatcgaaaaaaagggcatgcaaaacccagcccatttaagacaccctgacctaaaagaaatgaaaaagattttcgatgaagcagatggtcttattaaaatggtaaccattgctccagagttgcccggaggtatcgaactcattgacttcttgaaaaaaagaggcgtagttgttgcaattgcccactccaatgcaacttatgaagaggcgcaagatgcctttgaaaaaggcgcatcgcatataactcattgctttaatgctatgccggcaatccatcatagggcaccagggcttgtagcagcggctttagaaaatgattcgataagtgtccaagccatcgtagacggggtccaccttcatcctgggattgtgcgtctcattcataaaattaaaggacccgataaaatggttctcacaaccgatgcccttcaagctatgggagttggcgacggcgagtatatttttggcggtcaccaagtaacggttacagaaggagtggcacgcttacaagacgggacattagcttcaagtaccgtgacgatgaataaatctttaagattaagtaatgaatttggtattaacttgcaagacactatacaaatggcaacaagtacacccgcagatattttaggcatgaaaaatttgggccgaattgaaaaaggttatagcgctgacttggttttacttgataaaaaattcgaggttctaagtacgtggattaacggtgaaaaatactaa

SEQ ID NO: 101824 - protein, 377 aa, Listeria monocytogenes EGD-e
MAVIKNVKIYKENELIDAVVITEGNLIKEVCSTTPEKYSDEPTFDGNGRLLIPGMIDVHIHGAKNYDMMDGSTESIQAVSMACAETGCTSFLVTSVSSSLEDLIQMIRQTKKVIGKEKGAKIAGIHLEGPYLNIEKKGMQNPAHLRHPDLKEMKKIFDEADGLIKMVTIAPELPGGIELIDFLKKRGVVVAIAHSNATYEEAQDAFEKGASHITHCFNAMPAIHHRAPGLVAAALENDSISVQAIVDGVHLHPGIVRLIHKIKGPDKMVLTTDALQAMGVGDGEYIFGGHQVTVTEGVARLQDGTLASSTVTMNKSLRLSNEFGINLQDTIQMATSTPADILGMKNLGRIEKGYSADLVLLDKKFEVLSTWINGEKY

SEQ ID NO: 101825 - DNA, 1134 bp, Listeria innocua Clip11262
  CDS (1)..(1134): transl_table=11
atgactaataaagtaattactaacgctacaatttatactggtaaaggtgttctagaaaatgcttttgtacgatttgataaacagattttagaagttggctcaatgactgactttcaagcggaaaaagcagaagaagtaatcgatgcaaaaggacaaaagttagttcctggtttcattgatgtccattctcatggtggttatagttttgacgcaatggatgcagatcctgaagcacttaaaaaacaagtgaatggtatgttaaacgaaggtatcactacttacttcccaacaacaatgactcaatcacatgaaaatattgaaaaagctttaaaagttattaatgaagtcgctcaaactgaacctgtaattggcgggattcatcttgaaggtccatttgtatctaaagtcttcaaaggagcgcaaccagaagaatacattcaagcacctgacttggaacttttcaagaagtggtttgatatttctggtggcttaattcaattagttacctacgcgccagaacacgatacttcagctgattttgaaaacttgtgttttgaacttggagttgttccaagtattggtcactccaacgatgtgcgcgaacacttaaaaacaagtaaagcgacacatgcgacacatttatataatgcctgtcaccgtatgacgcaccgtgaaccaggtgttccaggccacgttttactcgaaaaaggtattaatgcagaattaattgttgatggtattcacgttcaccctgatatggtgaaattagcataccaaatgaaaggcccagaacatttatgcattattactgactcgatgcgagcaaaaggtatgccagaaggaaaatccgaacttggcggccaaacagttatcgtgaaagataaacaagctcgtttagaagatggaacattagccggaagtgtactcacttacgacgacggtttccgcaatatgattaaatttactggatgcacggtggaagaagcagttcttatgtcttctggtaaccaagcacgcgaatttaatttaacacaaaaaggtgcaatccaagctggtaaggatgcagatttcaacttactagatgaagatttaaacattacagcaacatattcattcggaaaaaaacattcttga

SEQ ID NO: 101826 - protein, 377 aa, Listeria innocua Clip11262
MTNKVITNATIYTGKGVLENAFVRFDKQILEVGSMTDFQAEKAEEVIDAKGQKLVPGFIDVHSHGGYSFDAMDADPEALKKQVNGMLNEGITTYFPTTMTQSHENIEKALKVINEVAQTEPVIGGIHLEGPFVSKVFKGAQPEEYIQAPDLELFKKWFDISGGLIQLVTYAPEHDTSADFENLCFELGVVPSIGHSNDVREHLKTSKATHATHLYNACHRMTHREPGVPGHVLLEKGINAELIVDGIHVHPDMVKLAYQMKGPEHLCIITDSMRAKGMPEGKSELGGQTVIVKDKQARLEDGTLAGSVLTYDDGFRNMIKFTGCTVEEAVLMSSGNQAREFNLTQKGAIQAGKDADFNLLDEDLNITATYSFGKKHS

SEQ ID NO: 101827 - DNA, 1143 bp, Listeria innocua Clip11262
  CDS (1)..(1143): transl_table=11
atggcgattatcaaaaacgtaaaagtttacaaagaaagcgagttaatcaatgcaacagttattacagaaggcaatctgatagcagaagtttttccaagtaataaaattattcccgaaaaatattcaacagagcaaatttttgatggaaatggtcagttgctcatacccggaatgattgacgttcatatccacggtgcaaagaattacgatatgatggatggttcaacagaaagcatccaagctgtatctatggcttgtgcggaaacaggatgtactagttttttagtcacatcggttagttcttctttggaagatttgattcaaatgattaagcaaacaaaaaaagtggttggaaaagagcaaggtgctaaaattgcaggaattcacttagaaggcccctacctcaatatagaaaaaaagggcatgcaaaatccagcttatttaagacaccctgacttaaaagaaatgaaacagatttttgatgaagcagatggtctgattaaaatggtaacgattgcgccagaattgcccggtggtatcgaactcattgacttcttgaaaaaaagaggagttgttattgcaattgcgcattccaatgcaacttatgaagaggcgcaagatgcttttgaaaaaggagcaacacatataactcattgcttcaatgctatgccagcaatccatcaccgggcacccggacttgttacagcggctttggaaaatgatgcggtaagcgttcaaactatcgtagacggggtccatcttcatcctgggattgtgcgtctcatccataaaattaaaggaccagataagattgttctcacgaccgatgcccttcaagctatgggagttggcgatggcgagtatatttttggcggtcaccaagtaactgttaaggaaggaatcgcacgcttacaagacggaacgctagcttcaagcaccgtgacaatgaataaatcgttaaggttaagtaatgaatttggtattagcttacaagactcgatacaaatggccacaagtacacccgcagaaatcctcggtatgaaaaaattcggtcgcattgaaaaaggctatatcgctgacttagttttactcgatgaaaaattcgaggttctaactacatggattaatggtgaaaaatactaa

SEQ ID NO: 101828 - protein, 380 aa, Listeria innocua Clip11262
MAIIKNVKVYKESELINATVITEGNLIAEVFPSNKIIPEKYSTEQIFDGNGQLLIPGMIDVHIHGAKNYDMMDGSTESIQAVSMACAETGCTSFLVTSVSSSLEDLIQMIKQTKKVVGKEQGAKIAGIHLEGPYLNIEKKGMQNPAYLRHPDLKEMKQIFDEADGLIKMVTIAPELPGGIELIDFLKKRGVVIAIAHSNATYEEAQDAFEKGATHITHCFNAMPAIHHRAPGLVTAALENDAVSVQTIVDGVHLHPGIVRLIHKIKGPDKIVLTTDALQAMGVGDGEYIFGGHQVTVKEGIARLQDGTLASSTVTMNKSLRLSNEFGISLQDSIQMATSTPAEILGMKKFGRIEKGYIADLVLLDEKFEVLTTWINGEKY

SEQ ID NO: 101829 - DNA, 1200 bp, Nostoc sp. PCC 7120
  CDS (1)..(1200): transl_table=11
atgagcaattaccaattaacaattaccgattaccaattaccgactaccatacacaagcctacagatattattaatgctaaagtccctggctaccaagatttacagatgcttgtggtgaatcaggggggcataattgaacaaatattgccgatggggactggatttaacagagttgcgtcaccagacttacaaataatagatgtggctggagattggatttctttgggtggcgttgatttgcaaattaacggtgctttgggcttggcttttcctgatttggcggctgagaatgcccactttttggggaaaatttgccaatttttatgggatgtgggagtagatggatttttacctacactggtgacaacttcagtggaaaatatccagcgatcgcttgctgttattgctgattttatctctaccacacaacctggttcccagattttaggcgtacatctagaaggccccttcttaaactatcaaaagcggggcgctcacccagccgagtatttattacctctgacaatagaagaagtccaacgggttttgggagattacgcccatattgttaaagtcatcaccttagcgccagagttagatcctacgggagaagtcatcccatatttacgttctttaggaatcacggttagtttaggacattctcaggcaacggctaaccaagcccaaaatgcttttgcgttgggtgcaacaatggtaactcatgccttcaatgccatgcctcccttacatcaccgcgaacctggactcttgggggcagctatgactaatcctcatgtcatgtgtggttttattgccgacggtcagcacgtttcgcctatcatgttgcaaatcctactccgtgccactcaaggaatatttctcgttagtgatgccctcgctcccttagggctacccgatggtgtgtatccttgggatagtcggcaaatagaagttcaagggggtactgcacggctaccagatggcacattatcaggcacaaccttacctttattagtaggggtggaaaacttggtgaattgggaaatttgcgatgtggaaactgcactggtacttgctactgatgccccaaggaaggcaattggtttgccaggaatgaaaccgggtcaacctgccaatttattgcgctggcattgggatagtcatacaaaaaaacttacatggcagcgattgttcagctaa

SEQ ID NO: 101830 - protein, 399 aa, Nostoc sp. PCC 7120
MSNYQLTITDYQLPTTIHKPTDIINAKVPGYQDLQMLVVNQGGIIEQILPMGTGFNRVASPDLQIIDVAGDWISLGGVDLQINGALGLAFPDLAAENAHFLGKICQFLWDVGVDGFLPTLVTTSVENIQRSLAVIADFISTTQPGSQILGVHLEGPFLNYQKRGAHPAEYLLPLTIEEVQRVLGDYAHIVKVITLAPELDPTGEVIPYLRSLGITVSLGHSQATANQAQNAFALGATMVTHAFNAMPPLHHREPGLLGAAMTNPHVMCGFIADGQHVSPIMLQILLRATQGIFLVSDALAPLGLPDGVYPWDSRQIEVQGGTARLPDGTLSGTTLPLLVGVENLVNWEICDVETALVLATDAPRKAIGLPGMKPGQPANLLRWHWDSHTKKLTWQRLFS

SEQ ID NO: 101831 - DNA, 1167 bp, Agrobacterium tumefaciens str. C58
  CDS (1)..(1167): transl_table=11
atgagcggcatcaaggcatttgttggcgcccgcattttcgacggcgccgcatggcacgagggcagagtgctcgtggtcggtgacgggcatgtcaccgccatctcagatagcgtgccagccgaagccgagatgatcgatgtaaagggactgctgatcgcgcctggattcatcgatctccaggtcaatggcggcggcggggtgatgttcaacaaccagccggatgtcgaaggcattgcccgcatctgttccgctcacgccaggttcggcacgacggcgctgatggtcacgctcattaccgaccggccggatgtaatctcgaaagcagcgcaggcgggtattgccgccagcaagaagcaggtgccgggctttctgggcctgcatttcgaagggccgcatctttccgtcgcacgcaagggcacccatgatccagcgctggtccgcaagatggagacggccgatcttgccgttctgatcggctgcaaggcggaactggccttcgtgatgacgaccattgcccctgagaacgtcaccgaggaacaggtcgcagcgctgagaaaagccggcatcgtggtcagtctcggccataccgataccggccttgatgttgcgacggcctatatcgaggccggcgcttccatggtgacacatctttttaacgccatgagcccgcttggccatcgcgaaccgggtctggttggcgccgccctttcgaatggcgggctggattgcgggctgatcgctgacggatttcatgtcgatcccgccgccatcggcattgcgctacgcgccaagaatggcccgggccggattttcctcgtcaccgacgccatgtcgaccatcggcacggatgacgatggtttcgaactgaatggccggcgcgtctatcgcaatggcggccgactgacacttgaagacggcacgcttgctggggcggatatcgacatgctctcctgcgtccgcttcatgtatgaaaagctggagatgccgctggaggaagccttgagaatggcatccgcctatcctgcacaggccgttggcgcatcggacaagggaaaactgctgcccggcttcgatgccgattttgttgtgctgacgcccggcctccagatgcattcgacctggattggcggagaaaaaacctacgatgccgtgcattccggagtgtga

SEQ ID NO: 101832 - protein, 388 aa, Agrobacterium tumefaciens str. C58
MSGIKAFVGARIFDGAAWHEGRVLVVGDGHVTAISDSVPAEAEMIDVKGLLIAPGFIDLQVNGGGGVMFNNQPDVEGIARICSAHARFGTTALMVTLITDRPDVISKAAQAGIAASKKQVPGFLGLHFEGPHLSVARKGTHDPALVRKMETADLAVLIGCKAELAFVMTTIAPENVTEEQVAALRKAGIVVSLGHTDTGLDVATAYIEAGASMVTHLFNAMSPLGHREPGLVGAALSNGGLDCGLIADGFHVDPAAIGIALRAKNGPGRIFLVTDAMSTIGTDDDGFELNGRRVYRNGGRLTLEDGTLAGADIDMLSCVRFMYEKLEMPLEEALRMASAYPAQAVGASDKGKLLPGFDADFVVLTPGLQMHSTWIGGEKTYDAVHSGV

SEQ ID NO: 101833 - DNA, 1137 bp, Clostridium perfringens str. 13
  CDS (1)..(1137): transl_table=11
atgttaataaaaaactgtaatatagtatatttagataagattgaaaaaggaaatatacttatagaaaacggaaagataaaggctataaatcctaaagaagaatgtgattgtgaagtaattgatggagaaggcttattcctatctccaggatttatagatgttcatatacacggtgctggtggtcacgatactatggatggtacttatgaagctataaatgaaatatcaaaggttatagttaaacatggtactacttcatttttaccaacaacaatgactgtagctgctgaagacgtatgcaagtcaatggaagctattcataaagcaaaaactgaaggaacagatggagctaatgttttaggtgctcacttagaaggaccatttataagcacaagtgcaataggtgctcaaaatcctgatttcttaatccctccaacaaaagaaaacttttataaattagttggagaacatgaagatgatgttgtttcaataactcttgctcctgaagtagaaggtgctaaagaacttactaaattcttaagtgaaaaaggtatagttgtttcaatgggacatactaaagctacttatgaagaagctatggaaggaataaagtgtggatgctctcatgccactcatttattcaatgcaatgactccatttactcatagagaacctggagttgtaggtgctgtttttgatagtgaaataactactgaaacaatctcagatggtattcacatagcatatccaagtttaagagttgcctataaacaaaaaggaacagataaggttttattaataactgatgctatgatggcttgctgtatgcctgatggaatgtattcattaggaggacaagatgttgaagttaaaaatggagctgcaagattattaagtggttctttagcaggatcaattttaactttagatgtggcagttaaaaatatatttaaaaacactaattatccacttaatgaagttataaaaatggctacttataacggagctaaacactgcaaagttgatgacaaaaaaggattaattaaagaaggctatgatgctgacttaattctttttgatgataatatagatataaaatatgtaatagttaatggaaaattagttcataaagcttaa

SEQ ID NO: 101834 - protein, 378 aa, Clostridium perfringens str. 13
MLIKNCNIVYLDKIEKGNILIENGKIKAINPKEECDCEVIDGEGLFLSPGFIDVHIHGAGGHDTMDGTYEAINEISKVIVKHGTTSFLPTTMTVAAEDVCKSMEAIHKAKTEGTDGANVLGAHLEGPFISTSAIGAQNPDFLIPPTKENFYKLVGEHEDDVVSITLAPEVEGAKELTKFLSEKGIVVSMGHTKATYEEAMEGIKCGCSHATHLFNAMTPFTHREPGVVGAVFDSEITTETISDGIHIAYPSLRVAYKQKGTDKVLLITDAMMACCMPDGMYSLGGQDVEVKNGAARLLSGSLAGSILTLDVAVKNIFKNTNYPLNEVIKMATYNGAKHCKVDDKKGLIKEGYDADLILFDDNIDIKYVIVNGKLVHKA

SEQ ID NO: 101835 - DNA, 1155 bp, Corynebacterium glutamicum ATCC 13032
  CDS (1)..(1155): transl_table=11
gtgcattatcaagaaaatgcaggtcaagcagttaaaaaaattgaaggaagaattgttaccccccacggggtgattgatggctttctccaactcgaaaacggcatcatcacggaactctctggagaaccagcacctaaaaacgcaggattccaccccgaactccccacgattgttcccagttttattgatcttcataatcacggtggaaacggtggcgcgtttcctacgggaacgcaggaccaggcgaggaatgccgcgcagtatcaccgcgaacatggcacgaccgtgatgttggcaagcatggtttcggcgccggctgacgcactggcagcgcaggtggaaaaccttattcccttgtgtgaagagggcctgctgtgcggcattcacctcgagggtcctttcatcaacgcatgccgttgtggtgctcaaaacccggattttatttttcccggcaacccaacagatcttgcccaggtgatccatgcgggaaaaggttggatcaaatcgatcacagtagcgccggaaactgacaatcttactgagcttctcgatctctgcgcagcgcaccacatcattgcttccttcgggcacactgatgcagattttgataccactaccagcgcaattgccttggctaaagagaaaaatgtgacggtcacggctacgcatttgttcaatgcgatgcctccgctgcatcatagggatcccggcagcgtgggcgctttgcttgctgcggcacgtgccggggacgcatatgttgagttgatcgccgacggcgtgcatttggccgatggaacggtcgatctagctcgttccaacaacgcctttttcatcacggacgccatggaagccgccggaatgccagacggtgagtacattttgggcgttttgaacgtcaccgtcaccgatggcgtcgcccgtctgcgcgatggcggcgccatcgccgggggtaccagcacactagcgagtcagttcgtgcaccacgtgcgcaggggtatgacgcttatcgacgcgaccctccacacctcaaccgtcgccgccaaaattctcggacttagcgatcacgaaatcgttaaatccaaccctgtaaattttgtggtctttgactcaaacggccagttacaacaggtccatttagaccatcaagtaatttaa

SEQ ID NO: 101836 - protein, 384 aa, Corynebacterium glutamicum ATCC 13032
MHYQENAGQAVKKIEGRIVTPHGVIDGFLQLENGIITELSGEPAPKNAGFHPELPTIVPSFIDLHNHGGNGGAFPTGTQDQARNAAQYHREHGTTVMLASMVSAPADALAAQVENLIPLCEEGLLCGIHLEGPFINACRCGAQNPDFIFPGNPTDLAQVIHAGKGWIKSITVAPETDNLTELLDLCAAHHIIASFGHTDADFDTTTSAIALAKEKNVTVTATHLFNAMPPLHHRDPGSVGALLAAARAGDAYVELIADGVHLADGTVDLARSNNAFFITDAMEAAGMPDGEYILGVLNVTVTDGVARLRDGGAIAGGTSTLASQFVHHVRRGMTLIDATLHTSTVAAKILGLSDHEIVKSNPVNFVVFDSNGQLQQVHLDHQVI

SEQ ID NO: 101837 - DNA, 1161 bp, Fusobacterium nucleatum subsp. nucleatum ATCC 25586
  CDS (1)..(1161): transl_table=11
atgaaaaaaattttattaaaaaatgcaaagttagttttagaaaataaattgattaatggttctattttaatttttaaaaataaaatagaaaaaatttttacagataatgataatttatctgaatttatttttgatgaagttatagatttaaaaggcaaatatttaggacctgcttttatagatgttcatacacatggtgctgatggtgctgatgcaatggatggcaatgaagaagctttaagaaaaatttctagttatttagttaaagaaggaactgcaaattttttagccacaactttaacaagtacaaaagaaattttaaaagatgttttggaagttgttgctaatttacaagataaagatattgaaggtgcaaatatttttggagtacatatggaaggaccttattttgctattgaatataagggagctcaaaatgataaatatatgaaacctgctggaataaaggaacttgaagaatatttatcagtaaaagatggacttgtaaaattattttcaatatctcctcataatcaagaaaatttagaagctataaaatttttagctgatagaggagttgttgcatctgttgggcattcaggggcaagttatgaagctgttatgaaggcagtagactatgggctttctcatgctactcatacttataatggaatgaaaggttttactcatagagaaccaggagttgttggtgcagtatttaattctgataatattatggcagaaattatttttgataaagtgcatgttcatccagaagcagtaagaactcttataaaaataaaaggtgtggataaagtagtttgtattacagactctatgtctgcaacaggtttagcagaagggcaatataagttaggagaacttgatgttaatgtaaaagatggacaggcaagacttgtttcaaataatgcattggcaggtagtgtattaagaatggatatagcttttaaaaatttaatagaattaggttatagcataactgatgcttttaaaatgacttcaactaatgctgcaaaagagttcaaattaaatactggtattttaaaagaaggtaaagatgctgatttagttgtcttagataaagactataaggtttgtatgactatggttaaagggaaaattaaatttacaaatttataa

SEQ ID NO: 101838 - protein, 386 aa, Fusobacterium nucleatum subsp. nucleatum ATCC 25586
MKKILLKNAKLVLENKLINGSILIFKNKIEKIFTDNDNLSEFIFDEVIDLKGKYLGPAFIDVHTHGADGADAMDGNEEALRKISSYLVKEGTANFLATTLTSTKEILKDVLEVVANLQDKDIEGANIFGVHMEGPYFAIEYKGAQNDKYMKPAGIKELEEYLSVKDGLVKLFSISPHNQENLEAIKFLADRGVVASVGHSGASYEAVMKAVDYGLSHATHTYNGMKGFTHREPGVVGAVFNSDNIMAEIIFDKVHVHPEAVRTLIKIKGVDKVVCITDSMSATGLAEGQYKLGELDVNVKDGQARLVSNNALAGSVLRMDIAFKNLIELGYSITDAFKMTSTNAAKEFKLNTGILKEGKDADLVVLDKDYKVCMTMVKGKIKFTNL

SEQ ID NO: 101839 - DNA, 1149 bp, Streptococcus pyogenes MGAS8232
  CDS (1)..(1149): transl_table=11
atgacatgctatcttaaagcagattgtttttattacccaacagaggtgaaaccggctggctacctaggtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatttactttgaaggtccttattttaccgaagaatataagggtgctcaaaacccaagttatatgaaaaacccacgcttggaggaatttgatgcttggcaaaaagctgctaaagggctcatcaaaaaaattgcccttgctcctgagcgtgatggtgtcaaagaatttgtgtccgcagtgacaaaacaaggtgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagccatgattacggactgtatgcgagcaggtggttcaccagatggtgattacctcttgggggaattctctgtggttgtggcaaatggcactgctcgtcttaaagagagtggaaacttggcaggatctattttgaaattaaaagacggccttagaaatgtagtggcctggggaatcgcaactccggcagaagccattcatatggcaacctatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcctaa

SEQ ID NO: 101840 - protein, 382 aa, Streptococcus pyogenes MGAS8232
MTCYLKADCFYYPTEVKPAGYLGLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKNPRLEEFDAWQKAAKGLIKKIALAPERDGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 101841 - DNA, 1254 bp, Drosophila melanogaster
  CDS (1)..(1254)
atggacgttcggattaagtgcaacagcgaggagccagagtctccggagcagaagatcctggcgagcagccagcgcctgctgcagttcaccaactgccgccttgtacgcgaccaccggatcatccacgacgatctgtgggttcgcgacggtcggatcgtgaacccagagcctgtgttcttcgacgagcggaccaaggcccactgtcgcatcgactgcgggggcgccatcatcgcgcccggctacatcgacctccagatcaatggtggctatggcgtggacttctcgtacgacacggagaccatcgaggagggcgtggccacggtggcacgcggcctggtcaagagcggagtcacctccttctgtcccacgctggtgacctcgcccagcgacagctaccacaccatcctgccgcgcattcccgcagaggttcccaagggcgccggcatactgggcatccatgcggagggtccgtttatcaatccgcagaaaaagggcgcgcatccggagcactgcatccagaccattgataagggactcagcacgctgaaggagacgtacggctcgctggaacgcattaaaatcatcaccctggcgccggagaaggtcaccgacccggaggtgattggccagctggtggagcgtggcatcaccgtggccctgggccactcgatggcctcgctaagcgacggagagagggccgtgcagcagggcgccacgctgatcacgcatctgttcaacgccatgctgccgttccatcaccgcgatcccggcctggtgggactgctggcctcggacgcagtgccgcacggtaggaccgtgtacttcggcatcatctcggacggagtgcacactcatccggcggcactgaggatcgcctaccgcacgcatccgcagggcctgatcctggtgacggacgccatatcggcgctgggcctcgaggagggtgtccaccacatcggacagctgccgctgcaggttaagcagggcaaggcgttcatcgcaggcacagagacgctgtgcggcagcatcgccccgatggacgagtgcgtgcggatcttccagaaggcgaccgactgctccgtggtctatgccatcgaggcggccaccttgcatccagcacagtgcctgaagatcgaaaagcagaagggcaccctggactttggctcggacgcggacttcgttctcctggacgaccagctccgggtgctatccacctggatcgctggcgtatgtgttcataggactgtcaagtag

SEQ ID NO: 101842 - protein, 417 aa, Drosophila melanogaster
MDVRIKCNSEEPESPEQKILASSQRLLQFTNCRLVRDHRIIHDDLWVRDGRIVNPEPVFFDERTKAHCRIDCGGAIIAPGYIDLQINGGYGVDFSYDTETIEEGVATVARGLVKSGVTSFCPTLVTSPSDSYHTILPRIPAEVPKGAGILGIHAEGPFINPQKKGAHPEHCIQTIDKGLSTLKETYGSLERIKIITLAPEKVTDPEVIGQLVERGITVALGHSMASLSDGERAVQQGATLITHLFNAMLPFHHRDPGLVGLLASDAVPHGRTVYFGIISDGVHTHPAALRIAYRTHPQGLILVTDAISALGLEEGVHHIGQLPLQVKQGKAFIAGTETLCGSIAPMDECVRIFQKATDCSVVYAIEAATLHPAQCLKIEKQKGTLDFGSDADFVLLDDQLRVLSTWIAGVCVHRTVK

SEQ ID NO: 101843 - DNA, 1173 bp, Thermoanaerobacter tengcongensis MB4
  CDS (1)..(1173): transl_table=11
atggggaggatattaaaagtgaaaaagcttattttaaagaatgcagagatatataaagaagaggagatactctataatggtgatttgttaattgaagagggcaaaatttctaaattaggcagaaacatttcggaaataaatgcagaagtgattgatttaaaaggtaaaaaaatagtaccgggattcattgatatacatatacatggcggtgtaggttatgataccatggatgcaacttatgaagcgttaaacaatatttctgtgcatttagctaaacatggagttacaagtttttgcccaactactatgacaatggatattcctgatattttaagggctttagagaatgtaaaagaaacaatgaaaaaaggggtagaaggtgcagaggtcctaggagcgtatgtagaaggtcctttcataagtaaagagcataaaggagctcaagatgaaaaatacgttttagatccggataaggaattgtttgatcaattttatgaagtagcaggaggtaatataaaagttattattttggctccggaaaaagatccatcaggggactttataaaacatgtgataaaaaaaggagttaaagtctctttagggcataccagtgcttcttatgaagagatgaaaagaggagtagattatggagcaacaattgctgtacacacgtataatggcatgaagggtttccaccacagagagccaggagcgttgggagaagtatttttagatgacagaatatatggagagcttatatgtgatttcatacactctcaccctgcagcagttaaattgcttgtgaaaataaagggtgtggataaaattattttaatttccgatgctatggctgcttgtgggctaggggatggagagtatagccttgggggacaaaaagtgtacgtaaaaaatggagaagcgagacttaaaaatgggactttggcgggaagtaccctgacattagataaggctttgcaaaatatgacaaatttaggtatttccctttttgatgctgttaaaatggtgtctactaatgcttccaaagcgatagggatttatgacaaaaaagggagtattgcagttggaaaagatgcggatatagtagtattagatagcgatcttagtgtatatatgacaattgtaggtgggaaaattgtatattcaaaagaatga

SEQ ID NO: 101844 - protein, 390 aa, Thermoanaerobacter tengcongensis MB4
MGRILKVKKLILKNAEIYKEEEILYNGDLLIEEGKISKLGRNISEINAEVIDLKGKKIVPGFIDIHIHGGVGYDTMDATYEALNNISVHLAKHGVTSFCPTTMTMDIPDILRALENVKETMKKGVEGAEVLGAYVEGPFISKEHKGAQDEKYVLDPDKELFDQFYEVAGGNIKVIILAPEKDPSGDFIKHVIKKGVKVSLGHTSASYEEMKRGVDYGATIAVHTYNGMKGFHHREPGALGEVFLDDRIYGELICDFIHSHPAAVKLLVKIKGVDKIILISDAMAACGLGDGEYSLGGQKVYVKNGEARLKNGTLAGSTLTLDKALQNMTNLGISLFDAVKMVSTNASKAIGIYDKKGSIAVGKDADIVVLDSDLSVYMTIVGGKIVYSKE

SEQ ID NO: 101845 - DNA, 1146 bp, Streptomyces coelicolor A3(2)
  CDS (1)..(1146)
atggccccaagcaaggttctcgccggtgcccgggtggtactgcccaccgggaccgtggacgacggccgcgtgatcgtcgacggcgcgcggatcgcggacacggctcccccgcaggccgagaccgtcgacctggcgggccactgggtggtccccggcttcgtcgacatccacaaccacggcggcggcggagcctccttcgccggcggcaccgccgaggagatcctggccggcgtcgagacccaccgccggcacggcaccaccacggtggtcgcctccgccgtcaccggcgatctggacttcctggcccggcacgccgggatgctcgccgagctggcgcagcagggcgacatcgttggcatccacttcgaggggccgttcatctcgccgtgccgcaagggcgcgcacgacgagcagctgctgcgcgacccggacccggccgaggtgcgcaagctggtcgacgcggcgcacgggcacgcgaagatgatgacgctggcgaccgagctgccgggcggcctggactccgtacggctgctggtcgagcacggcgtgatcgcggccgtcgggcacaccgacgcgacgtacgagcagaccgtgcaggccatcgacgcgggcgccaccgtcgccacgcacctcttcaacgcgatgccgccggtcggtcaccgtgcgccgggtccgatcacggcgctcctcgaggacgagcggatcaccgtcgagctgatcaacgacggcacgcacctgcatccggccgcgctccaactggccttccaccacgcgggtgccgcccgggtcgccttcatcaccgacgcgatggacgcggcgggcttcggcgacggccactacctgctcggcccgctggaggtcgaggtcgcggacggcgtggcccggctggtggagggcggctcgatcgcgggctccacgctcaccctggaccgcgccttcaagcgggcggtgacggtggaccggctgcccgtcggggacgtcgtcgcggcgatctccgccaacccggcgcggctcctcggtctcgacgaccggatcggctcgctggagcccggcaaggacgccgacctggtcgtcctggacgacgccttcgacctggtgggcgtgatgcgccggggcgaatgggtggtcgatccccacctgggctga

SEQ ID NO: 101846 - protein, 381 aa, Streptomyces coelicolor A3(2)
MAPSKVLAGARVVLPTGTVDDGRVIVDGARIADTAPPQAETVDLAGHWVVPGFVDIHNHGGGGASFAGGTAEEILAGVETHRRHGTTTVVASAVTGDLDFLARHAGMLAELAQQGDIVGIHFEGPFISPCRKGAHDEQLLRDPDPAEVRKLVDAAHGHAKMMTLATELPGGLDSVRLLVEHGVIAAVGHTDATYEQTVQAIDAGATVATHLFNAMPPVGHRAPGPITALLEDERITVELINDGTHLHPAALQLAFHHAGAARVAFITDAMDAAGFGDGHYLLGPLEVEVADGVARLVEGGSIAGSTLTLDRAFKRAVTVDRLPVGDVVAAISANPARLLGLDDRIGSLEPGKDADLVVLDDAFDLVGVMRRGEWVVDPHLG

SEQ ID NO: 101847 - DNA, 1155 bp, Xanthomonas axonopodis pv. citri str. 306
  CDS (1)..(1155): transl_table=11
atgcacgctctcacgactcaggcactgtgcaatgcacgtgtgctcaccgacaacggattgcaggacggcctggtcgtgatgctggctggcacgcagatccaggcgatcgtgccggccgacgatgcgcgcgttacgcaggccgatacgcgcctggacctgggtggcgccagcttgttgccgggctttatcgacatccaggtcaatggcggcggcggcgtgttgttcaacaacgcacgcgacccccaggcactggccacgatcgccgccgcgcatcgtcgcttcggcaccaccggcatgctgccaaccttgatcagcgacaccgctgaggtgatggccgaagcgatcgatgccactcgccaggccatcgcgcaaggcgtacccggcgtgctcggcatccatctggagggcccgtacctgagtcctgcgcgcaagggcacgcacgacgcggacaagttccgcgtaccggacgcgcacgagattgccgtcgatacctcattggacaatggcgtcaccttgatcacgctcgcacccgagcgcgttccgctggacgatatccgtgccttcgttgccggcggcgcgctcgtgttcgccggccacactgcggccacctacgagcaggcacgcgatggcattgccgccggcgtcagcggcttcacgcacgtgtacaacgcgatgtcgcagctggctggccgcgaacccaatgcggtgggcgcggcactggaagacccgacgatttggtgcggcgtcatcgtcgacggcgtgcacgtgcatccggccagcttgcgtgtggcgctcgcggccaagccacgcggcaagttgctgctggtcaccgacgccatgccgatggtcggcagcgaaagcgccagcttcgatctctacggcgaaaccatcaccgccgtggacggcgtggtgcgaaatgccgatggtgcactggccggctccgcattggacatggccaccgccgtgcgcaacagcgtgcgctggctgggcgtggacctggccgaagccgcgcgcatggcttctacctaccccgcgcaatgcattggcctgggcgaacgcctgggacgcatcgcccccggctaccaagccgatctggtgctggtggatgacgatgtgcaggtgttgagcacgtgggtggctgggcagcgcgactaa

SEQ ID NO: 101848 - protein, 384 aa, Xanthomonas axonopodis pv. citri str. 306
MHALTTQALCNARVLTDNGLQDGLVVMLAGTQIQAIVPADDARVTQADTRLDLGGASLLPGFIDIQVNGGGGVLFNNARDPQALATIAAAHRRFGTTGMLPTLISDTAEVMAEAIDATRQAIAQGVPGVLGIHLEGPYLSPARKGTHDADKFRVPDAHEIAVDTSLDNGVTLITLAPERVPLDDIRAFVAGGALVFAGHTAATYEQARDGIAAGVSGFTHVYNAMSQLAGREPNAVGAALEDPTIWCGVIVDGVHVHPASLRVALAAKPRGKLLLVTDAMPMVGSESASFDLYGETITAVDGVVRNADGALAGSALDMATAVRNSVRWLGVDLAEAARMASTYPAQCIGLGERLGRIAPGYQADLVLVDDDVQVLSTWVAGQRD

SEQ ID NO: 101849 - DNA, 1143 bp, Thermosynechococcus elongatus BP-1
  CDS (1)..(1143): transl_table=11
atgagggtgctgcaatggctggatcgcgtgcggcttttggggagcgatcgcctgcaacaggtgcaaattgccgatggcaaggtggccgccattggtgccaacttaattccaccagaaacggttgaggttctggattttgccggtgattatctctcccttgggggcgtagatctacaaattaatggtgccttgggccttccctttccctggttaaaaacagccgagccgctgccaaccattagccactacctttggcaacaggggattgacgcctatgcccccaccatcgtgaccgctcccctcgctgaaattcacactgccctaggggtaatccacgagtatgcgcccaatgggcaagcatctgaggccaagattttgggtgtgcatttggaggggcctttcctcaatcctcagaagcgcggtgcccatcccccgtctcatcttcagcccttgaccctagaaagggtgcaaaccgtcctaggggagttcagtgattccattgagattctcaccctcgcccccgaattagatgccagtggtgaggtgctgccctatctgcggcagttggggatcacggtgagtttaggtcactctttggccacggtggaggaagctcaggcggcttttgatgcgggtgcaacaatgattacccatgcctttaatgccatgccccccctacatcaccgcgagccggggttgttggcggcagctttgacggaccaacgggtctggtgtggggtcattggcgatggggttcatgttcatccgcaaatgctgaagctgctgtggcagtgcgcgggcgatcgcctctttttggtcagtgatgccttggcccccctgggtttaggggatggcatctacccgtgggatcaacggcacattgaagtcaaaaatggcaccgctcgccttgaggatggtaccctctgtggcacaacggttcccctcttggcaatggtggggcgcttggtggattggggggtgtgtgactttgaggcggctcttgccttggcaacgctgaacccccgccgtgccgttggcctgaggacggagttagtcgggcaacccgtgagtcatctcctgcgctggcgctctccccaccactacgagcgattgccagttattggccgatttgctgagctataa

SEQ ID NO: 101850 - protein, 380 aa, Thermosynechococcus elongatus BP-1
MRVLQWLDRVRLLGSDRLQQVQIADGKVAAIGANLIPPETVEVLDFAGDYLSLGGVDLQINGALGLPFPWLKTAEPLPTISHYLWQQGIDAYAPTIVTAPLAEIHTALGVIHEYAPNGQASEAKILGVHLEGPFLNPQKRGAHPPSHLQPLTLERVQTVLGEFSDSIEILTLAPELDASGEVLPYLRQLGITVSLGHSLATVEEAQAAFDAGATMITHAFNAMPPLHHREPGLLAAALTDQRVWCGVIGDGVHVHPQMLKLLWQCAGDRLFLVSDALAPLGLGDGIYPWDQRHIEVKNGTARLEDGTLCGTTVPLLAMVGRLVDWGVCDFEAALALATLNPRRAVGLRTELVGQPVSHLLRWRSPHHYERLPVIGRFAEL

SEQ ID NO: 101851 - DNA, 1149 bp, Streptococcus agalactiae 2603V/R
  CDS (1)..(1149): transl_table=11
atgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgaaagatggaggtaatttagctggttctattcttaagctcaaagatggattaaaaaatgttgtagaatggggaattgctactccggaagaggcagtgcgtatggcgagttatgttccggcagtgtctgtaggcattgataatgtctgtggacagataaaagaaggttatgcagcggattttattgtattagataaacatctagatttagttgcaacataccttgatggggaaaaacgttggcaatcttga

SEQ ID NO: 101852 - protein, 382 aa, Streptococcus agalactiae 2603V/R
MTKYIKADRFFYADHVKENGYLEIKDNHFGKWIENISGQEEILDYSGYQIAPGLVDTHIHGFAGADVMDCDSEGILRMSAGLLSTGVTSFLPTTLTSDTKRLEEASKSVAAVAGKEQGAKIQGIYFEGPYFTEEYKGAQNPIYMRNPNLEEFAQWQKAAKGLITKIALAPEREGVEEFVSAITKQGVTVALGHSNGTYKEAKKAVKAGASVWVHAYNGMRGLTHREPGMVGAVYNLPNTYAELICDGHHVDPVACDILMTQKGHNHVALITDCMAAGGAPDGDYMLGELPVVVSNGTARLKDGGNLAGSILKLKDGLKNVVEWGIATPEEAVRMASYVPAVSVGIDNVCGQIKEGYAADFIVLDKHLDLVATYLDGEKRWQS

SEQ ID NO: 101853 - DNA, 1176 bp, Oceanobacillus iheyensis HTE831
  CDS (1)..(1176): transl_table=11
atggggaatgatgcagtttggattaaaaaaataaaaacaatctatatggaagataaacaagtcatgaacgctggattattattaaaaaacggaaaaattgatcgatttatttctgcggaagagcattttgagccaacagaagatacggaaataattgatgcaaaatacgaatggagtgcaatcccagggtttattgatgggcatattcatggcggttatggcgtagacgtgatggatgcgaaggaggatacattactccgattagcagagaatcttcctggtgaaggtacgacaagttttttggctacgacaattacccaatcacctgaagagattgaaaaagctcttttgaatgtagattcgtttgacaataaacctggtatagcagaaatggtaggtgttcacctggaaggaccatttgtcgaagtgtcgaaagccggggcacaaccgaaagagtatattgcagaaccgaatttagatcaatttcgacattggcagcatgcatctggaaatagtattcgcaccattacaatggcaccagagcatgatgtggatggggaattcattgaaagcttgtatcattcaggggtaaatgtttcagctggccatacagatgcttcattcgctcaaatgaaaacagctgtaaatcaaggagttcgccaattaacgcatttatgtaatgcgatgaacggtattcaccaccgtgatataggcgcggtcggagcagcttttcaattagaagatctacgtgctgaattaatcacagatgaagtgcatgtggtaccagagatgatgcagttaatttacgattccatgggagcagaacgaattattattattacagatgcgatgcgcgcaaaaggattagaagacggagattatgaattaggcggtcaacctgtaacagtaaaagagggaagagcaacacttgaaaatggtagtctagctggaagtgtgctgcgaatgatcgatggcgtcaagaatatgctagatttaaacggcgtagaaatagaagacattgtccgaatggcttctgtaaacccggctaagcaagttggcatttttgatcagaagggaagcattgatgtaggaaaggatgcagatattctccttgtgaatgatcaaatggacattgaatatacgatatgccgtggagaaacggcttaccgtaagtaa

SEQ ID NO: 101854 - protein, 391 aa, Oceanobacillus iheyensis HTE831
MGNDAVWIKKIKTIYMEDKQVMNAGLLLKNGKIDRFISAEEHFEPTEDTEIIDAKYEWSAIPGFIDGHIHGGYGVDVMDAKEDTLLRLAENLPGEGTTSFLATTITQSPEEIEKALLNVDSFDNKPGIAEMVGVHLEGPFVEVSKAGAQPKEYIAEPNLDQFRHWQHASGNSIRTITMAPEHDVDGEFIESLYHSGVNVSAGHTDASFAQMKTAVNQGVRQLTHLCNAMNGIHHRDIGAVGAAFQLEDLRAELITDEVHVVPEMMQLIYDSMGAERIIIITDAMRAKGLEDGDYELGGQPVTVKEGRATLENGSLAGSVLRMIDGVKNMLDLNGVEIEDIVRMASVNPAKQVGIFDQKGSIDVGKDADILLVNDQMDIEYTICRGETAYRK

SEQ ID NO: 101855 - DNA, 1284 bp, Bifidobacterium longum NCC2705
  CDS (1)..(1284): transl_table=11
atgtctgataggaacgagatagtctcgcgcgtgaccgcggcactggagggcaagccggctccggtggcgattcgtaacgcgcgcaaggtggatgcgcgcggcgaacggcgcggatattgggtcgtctccgatgccgccggcgtcatcgtggcggccggcacgggggaggagaccttcgagcactactgccgcacggtggggctcgacccggccgatcgcaacgcggtcatcgacgccgaaggccgtattctgacccccggctacgtggacatccacgcgcacggcgcatgggagaagagcttcgatgacgggccggacggcatcgacgtggcgcgggccggccacgccgtgcatggcaccacgcgccaggtgctctcgctgatcaccaaccccgtggacgtgatctgccgcaacatccgcaccgtccgcgccacaatggagtccggccgccccgacatcctaggctgccatctggaaggcccgttcctggccctggcccgcaagggcgcacatgacccggaatgtctcaaggatccggtgcctgacatcgtcgataagatgcttgaggcctccggtgccgaccccgcctccggcaagcttggctgcatccgccagatcaccatcgcccccgaactgccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcatcaccgcgaacccggtccgattccggccgcggtggaggacccgcgcgtcaccatcgagctcatcaacgacggattccacgtgcaggatccgatggtgagcctctccttccggttcgcgcctcaccgcacggccttcgtgaccgacgcgatggccgccaccgactgcccggacggcgcctacaagttgggcgcgctggacgtgaacgtggtcggcgggcatgcgcgcctggtctccaacggcgccatcgccggctccactctgctgctggaggtcgccgtgcgccgtgcggtgtgcgaactgggcttcagcccggtggacgcggtcgaggcggccactctgacgccggccaaggcgttcggcttcgaccggccgaacccggtcaccggggtgccgatcggcctcatcgcccccggcttcgccgccgatttcaaccttgcggacccggccgactggacggtcgaacaggtgtggtgcgcgggccgcaagctcaagtag

SEQ ID NO: 101856 - protein, 427 aa, Bifidobacterium longum NCC2705
MSDRNEIVSRVTAALEGKPAPVAIRNARKVDARGERRGYWVVSDAAGVIVAAGTGEETFEHYCRTVGLDPADRNAVIDAEGRILTPGYVDIHAHGAWEKSFDDGPDGIDVARAGHAVHGTTRQVLSLITNPVDVICRNIRTVRATMESGRPDILGCHLEGPFLALARKGAHDPECLKDPVPDIVDKMLEASGADPASGKLGCIRQITIAPELPHGISAIRQFAAAGVVPAVGHCDADYETAKAGFDAGAGIMTHMFNAMNGLHHREPGPIPAAVEDPRVTIELINDGFHVQDPMVSLSFRFAPHRTAFVTDAMAATDCPDGAYKLGALDVNVVGGHARLVSNGAIAGSTLLLEVAVRRAVCELGFSPVDAVEAATLTPAKAFGFDRPNPVTGVPIGLIAPGFAADFNLADPADWTVEQVWCAGRKLK

SEQ ID NO: 101857 - DNA, 1167 bp, Brucella suis 1330
  CDS (1)..(1167): transl_table=11
atgatgaagaaatcagcaattgcaggcgcgcgcatcttcgacggtgagcgctttcatgaccagagcgcgctggtattcagtgatggccagatcgaggccatcgtaccggaagcatcgcttgccgagggccacgaaatcgaaaggctgaagggcggcgttcttgcccccggtttcatcgatgcgcaggtgaatggcggcggcgggcgtatgctcaatgacgagccgacgctcgaaaccatgttcgtgattgccggcgggcacaggaaatacggcacgaccagcctgttgccgacgctcatcaccgatacgatgcccgtgcgtgaccgcgccattgaggcggcgattgaagcggtgaaggctgacaggggggttgctggcctgcatctggaaggcccgcatctggcgccagcgcgcaaaggcgcgcatctggcggaactgatgcgcccggtcaatgatgccgatattgcgctctatatccatacagccaggcagattggcaccttgctggtgacgctcgcggccgaacaggtgacgcctgaacaggtgcgccgcttgagcgatggaggcgtgatcgtcagcattggccacagcgacacgaccgctgaagaagccttccggcgcttcgatgccggtgcgcgcagcgtgacgcatctttataatgccatgagccagattggtcatcgcgcgccgggtcttgccggtgcggcgctcgatcatcccgatatctggtgcggtatcgttgcggatgggcatcatgtcgatccgatggcgctgcggctggcgctgcgtgccaagcgcggcgatgcgcatctgttcctcgtgacggacgccatggcgcttgtcggatcggatgcggaaagcttcgagataaacgggcgcagcgttcgccgtgtgccgggcggcatctgctccaagctggtcctgccggatggcaccattgccggttccgatctcgacatggcttcggcggtgcggtttgccgtggcagaactggaactgacgcttgccgaggcgctgcgcatggcaagcctctatccggcgcgctatctgcgccttaatgatcgcggccggttccgtccgggaatgcgcatggatgccgtgcatctggatgacgggctgttcgccaaatccacatggctttccggcgaaaagcagattgcaggctga

SEQ ID NO: 101858 - protein, 388 aa, Brucella suis 1330
MMKKSAIAGARIFDGERFHDQSALVFSDGQIEAIVPEASLAEGHEIERLKGGVLAPGFIDAQVNGGGGRMLNDEPTLETMFVIAGGHRKYGTTSLLPTLITDTMPVRDRAIEAAIEAVKADRGVAGLHLEGPHLAPARKGAHLAELMRPVNDADIALYIHTARQIGTLLVTLAAEQVTPEQVRRLSDGGVIVSIGHSDTTAEEAFRRFDAGARSVTHLYNAMSQIGHRAPGLAGAALDHPDIWCGIVADGHHVDPMALRLALRAKRGDAHLFLVTDAMALVGSDAESFEINGRSVRRVPGGICSKLVLPDGTIAGSDLDMASAVRFAVAELELTLAEALRMASLYPARYLRLNDRGRFRPGMRMDAVHLDDGLFAKSTWLSGEKQIAG

SEQ ID NO: 101859 - DNA, 1137 bp, Shewanella oneidensis MR-1
  CDS (1)..(1137): transl_table=11
atgaaattcactttaattgccgagcaattatttgatggcgaatccttccatcaggatgtgcctgtcaccattgaggatggcctgattgcaagctttgataccgctcttggtgctaaagaagtccgctatacaggaacgctggtgccaggttttatcgatgtgcaagttaacggcggcggcggagcattattcaatactagtcctacagtcgcttgcatcgagaccataggtaaggcgcatgcgcgttttggcaccacaggttttttacccacgttgattaccgataatgtgcaggtgatggctaaggcggccgatgccgttgctcttgcggttgcgcaaaaaagtgctggtgtattaggggtacatttcgaaggtccgcatttatctgtgcctaaaaagggtgtgcatccacaaggctttatccgtgagatcaccgaagcggaactggcgatcttttgccgtcaggatttaggtatccgcgttgtcactttagcacctgaaaacgtctctcctgaggtgatccgcttattagtcgagtcaggagttaaggtctgtttagggcactccaacgcagattacgatacggttgttgcggctttaaaggctggggcgacaggttttacccatctatataatgcgatgtcacccttaggttcccgcgagcctggtgtggtgggtgcggcaattgagagcgaaacggcttggtgtggcttaattgttgatggtcatcatgtgcatcccgctgcagctcgaattgctctgcgggcaaaacctcgtggcaagatgatgttagtgactgatgccatgccacctgtgggtatggacgatgaaaccagttttgagttgtttggtactcaggtgttgcgtgtcggtgaccgattaaatgcggtcaccggtgagctggctggttgtgttttagacatggcaagtgcagtccataatacggtgaatatgcttggtttaccgctaggtgaagcgttgagaatggcggccttgtatcctgctgagttccttggcattgccgatagtgttggtcggttagccgtagggcagcgcgccgatttagtgctgctggataatcagtatcaagtgctggcaaactacattgccggaaatgcggtctatgttcgcccgtaa

SEQ ID NO: 101860 - protein, 378 aa, Shewanella oneidensis MR-1
MKFTLIAEQLFDGESFHQDVPVTIEDGLIASFDTALGAKEVRYTGTLVPGFIDVQVNGGGGALFNTSPTVACIETIGKAHARFGTTGFLPTLITDNVQVMAKAADAVALAVAQKSAGVLGVHFEGPHLSVPKKGVHPQGFIREITEAELAIFCRQDLGIRVVTLAPENVSPEVIRLLVESGVKVCLGHSNADYDTVVAALKAGATGFTHLYNAMSPLGSREPGVVGAAIESETAWCGLIVDGHHVHPAAARIALRAKPRGKMMLVTDAMPPVGMDDETSFELFGTQVLRVGDRLNAVTGELAGCVLDMASAVHNTVNMLGLPLGEALRMAALYPAEFLGIADSVGRLAVGQRADLVLLDNQYQVLANYIAGNAVYVRP

SEQ ID NO: 101861 - DNA, 1179 bp, Streptococcus mutans UA159
  CDS (1)..(1179): transl_table=11
atgaaagtaacaatatggaggtgtaaagtgacgacatacattaaagcaaataagttttattatccttatgaaacaaaattgggtggttatttagaactagttgatgattcttttggaaaatggctgagcactgttccagaaggtgctcaagtacttgattattcaggatatgaaattgcgcctggacttgttgacacacatatccatggctttgcaggagccgatgtaatggataataaagaagaatccttagcgacaatgagtcgagaattgctctcggctggtgtgactagttttttaccaacagggctaacagcttcctttgaaactttaaataaagtctgtcaaacgatagccaaatttgcaggtaaggaaacgggtgctcgcattcaaggtctgttctttgaaggtccttatttcactgaaaagtataaaggtgcgcaaaatccttcttatatgcgaaatccctcaactagtgaattggatcagtggttagcaagttccaagggactcttaaagaagattgcccttgcacctgagcgtgaaggaacagctgaatttatctcttatgcatgcaagcgaggagttgttgtggctttaggacattctgatgcaacctatcaagaagctgttgaggcagttgaagctggtgcctctgtttgggtgcatgcttataatggtatgcgggggctcaatcatcgtgaaccgggtatggtcggagctgtttatgacattcctaatacttatgccgaattgatttgtgatggttaccatgtgcatacttgtgcttgtgacattcttctgcatcaaaagcgacctgatcatgtggttttgattacggattgtatgtcagctggcggtcagcctgatggaaattacatgttgggagaataccctgttactgttgaaaatggcactgctcgattgaaatcaaatggtgccttggcgggttctattttgcaattgaaagatggtgtcaaaaatattgttgattggggccttgtctctaaagccaatgccattatgatggcaagtcttattccagctatatctgttggtatagatgaagtttgcggtcaaataaaagaaggacacctagcagattttatcgtgttggataaagagatgaacttacgcgcaacttatttagcaggtaaaaaagtttatgaatgtcaataa

SEQ ID NO: 101862 - protein, 392 aa, Streptococcus mutans UA159
MKVTIWRCKVTTYIKANKFYYPYETKLGGYLELVDDSFGKWLSTVPEGAQVLDYSGYEIAPGLVDTHIHGFAGADVMDNKEESLATMSRELLSAGVTSFLPTGLTASFETLNKVCQTIAKFAGKETGARIQGLFFEGPYFTEKYKGAQNPSYMRNPSTSELDQWLASSKGLLKKIALAPEREGTAEFISYACKRGVVVALGHSDATYQEAVEAVEAGASVWVHAYNGMRGLNHREPGMVGAVYDIPNTYAELICDGYHVHTCACDILLHQKRPDHVVLITDCMSAGGQPDGNYMLGEYPVTVENGTARLKSNGALAGSILQLKDGVKNIVDWGLVSKANAIMMASLIPAISVGIDEVCGQIKEGHLADFIVLDKEMNLRATYLAGKKVYECQ

SEQ ID NO: 101863 - DNA, 1155 bp, Escherichia coli CFT073
  CDS (1)..(1155): transl_table=11
atgtccggtcgaggaaggaatatgacacacgttctgcgcgccagaaggctgctgactgaagagggatggctcgatgaccatcagttgcgtattgctgacggtgtaatcgcagcaatcgaaccgattccagtgggcgtgactgaacgcgatgcggaactgctctgtcccgcttacatcgacacccatgtacacggtggtgcgggcgttgatgtaatggatgacgcgccggatgtgctcgacaagctggcaatgcacaaagcacgcgaaggtgtcggcagttggttaccgaccaccgtaaccgcgccgcttaataccattcatgcggcgctggaacgtattgctcaacgttgccaacgcggcggacctggtgcgcaagtgctggggagttatctcgaaggaccgtacttcacgccgcagaataaaggcgcgcatccaccggagctgttccgcgagctggaaattgccgagctggatcaattgattgccgtttctcagcataccttgcgcgtggtggcgctggcaccggaaaaagaaggggcattgcaggccatccgccatcttaaacagcaaaacgtacgggtgatgctggggcatagcgcggcgacctggcaacaaacccgtgccgcgtttgatgctggtgccgacggcctggtgcattgctataacgggatgacaggtttacatcaccgcgaaccgggaatggttggcgcgggattaacagacaagcgcgcctggctggaactgatagccgatggtcatcatgtacatccggcggcaatgtcgctctgttgttgctgtgcgaaagagaggatcgtactgatcaccgacgcgatgcaggcagccgggatgccggatggtcactatacgttatgtggtgaagaagtgcagatgcgcggtggcgttgtccgtaccgcgtccggtgggctggcgggcagtacgctgtctgtcgatgcggcagtgcgcaacatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttga

SEQ ID NO: 101864 - protein, 384 aa, Escherichia coli CFT073
MSGRGRNMTHVLRARRLLTEEGWLDDHQLRIADGVIAAIEPIPVGVTERDAELLCPAYIDTHVHGGAGVDVMDDAPDVLDKLAMHKAREGVGSWLPTTVTAPLNTIHAALERIAQRCQRGGPGAQVLGSYLEGPYFTPQNKGAHPPELFRELEIAELDQLIAVSQHTLRVVALAPEKEGALQAIRHLKQQNVRVMLGHSAATWQQTRAAFDAGADGLVHCYNGMTGLHHREPGMVGAGLTDKRAWLELIADGHHVHPAAMSLCCCCAKERIVLITDAMQAAGMPDGHYTLCGEEVQMRGGVVRTASGGLAGSTLSVDAAVRNMVELTGVTPAEAIHMASLHPARMLGVDGVLGSLKPGKRASVVALDSGLHVQQIWIQGQLASF

SEQ ID NO: 101865 - DNA, 1185 bp, Mycoplasma penetrans HF-2
  CDS (1)..(1185): transl_table=4
atgaaattattatttaaaaatgctgaaattgttttatttgataaaaacatctctggttctttattgacagaagataaaattattaaaacaattggtgatactgattctacttataattatgaaatagattgtaaagatttaaaaatatttccaggatttatagatagtcatgttcatggaggatatggttttgattttgagcaaaactcaatagaatcatataaagactttgctagtaatattgttaaagaaggtgtgactaaatttgttttagcttcagttacttctactccagataaaatatcttcatgtttaaaaactttttctcagttttataaccaacaagaattaacaagctctaaatgtttaggtgttcatctagaggggccatttatttcaaaagaaaaaaaaggagcacataaagaaagtttaatcataaagccaaatatagatttggtaaaacaatgaattcaagattctaataacttaattaaaataattacttttgatattgaacatgatgaagatagtcaatttttaaaatttctaaatgataataacattattggttcaattggtcattcaaatatatctaataaaacttttaaatctaaaactaaagatgttcctttttatagagtaactcacttatttaatgggatgagtggattattacacaacaaccctggagtagctgcagctgcattaaatgatgatagagttttatgtgaattaatatgtgatggattccatgttgataaagatttaattagaattacatatttatgtaaaggtagtaaaaaaattactttaattacagatgcaatgagtgctaaagggatggataatggcaattacatgttaggtgaattagaagtagaaaaaaaggatgaaatatgtgttttaaaaaacacttctacattagctggaagtgtttgcacatatagcaagtgttttaaaaactttcatgattgaataaatcctacagatcaagaattggcacacgtaagttcatataatagtgctattcaattaggtttaaaaaatactggattaataaaagaagactatttagcagatttagtattagttaataatgactatgaagtagtaatgactgtatgtgaaggaataattacatacatagacaataaatataaaaatagattaattaaaaaaggataa

SEQ ID NO: 101866 - protein, 394 aa, Mycoplasma penetrans HF-2
MKLLFKNAEIVLFDKNISGSLLTEDKIIKTIGDTDSTYNYEIDCKDLKIFPGFIDSHVHGGYGFDFEQNSIESYKDFASNIVKEGVTKFVLASVTSTPDKISSCLKTFSQFYNQQELTSSKCLGVHLEGPFISKEKKGAHKESLIIKPNIDLVKQWIQDSNNLIKIITFDIEHDEDSQFLKFLNDNNIIGSIGHSNISNKTFKSKTKDVPFYRVTHLFNGMSGLLHNNPGVAAAALNDDRVLCELICDGFHVDKDLIRITYLCKGSKKITLITDAMSAKGMDNGNYMLGELEVEKKDEICVLKNTSTLAGSVCTYSKCFKNFHDWINPTDQELAHVSSYNSAIQLGLKNTGLIKEDYLADLVLVNNDYEVVMTVCEGIITYIDNKYKNRLIKKG

SEQ ID NO: 101867 - DNA, 1137 bp, Vibrio vulnificus CMCP6
  CDS (1)..(1137): transl_table=11
atgtacgcgctaactaactgtaaaatctatacaggaagtgatgttctctctgagcacgctctcatcatcgaaaatgatttgatccaatcgatcgtaccagcagcggatctaccctctggaattgaagtcaaagacctcgcaggcgctaacgttagtccaggtttcatcgatctacagttgaatggctgcggcggtgtgatgctgaatgacgaaatcacagcagaaacgatgcaaatcatgcacaaggcgaacttaaagtccggctgtaccagctttctgccaacgctaatcacttcatcagatgaagacatgcgcgctgccatttctgccgcacgtgaataccatgcccaatatcaaaaccaatcacttggtttacaccttgaaggtccttaccttaatgtgatgaaaaaaggcattcacagcgtggattacattcgtccttctgacaccagcatggtggactttatttgcgaaaacgcggatgtcgtagccaaagtgactcttgctcctgagctaaacgatcctgaacacattgaaaaactgcgcaacgcgggcatcgttgtttctatcggtcacactaacgccacttacgcagaggcgcgtaaaggctttgaagctggcatcaccttcgccacgcacttgttcaatgccatgacaccgatggttggccgtgagcccggcgtggttggtgccatttacgatacacctgatgtgtatgctggcatcattgcagacggtttccacgttgactatgcaaacatcagaattgcgcacaagatcaaaggcgagaagcttgtattagtgaccgatgccacagctcctgcaggcgcaaacatggattactttatttttgttggtaagaaagtatattaccgagatggcaaatgtgttgatgaaaatggcacattaggcggttcagcgttgacgatgatcgaagcggtccagaatacggttgaacatgtcggaatcgctttagatgaagctctacgaatggcgactctctacccagcaaaagcaattggtgtagacgcgcagctaggtcgaattaagaaaggttacattgcgaacctgacgattttcgatcgagacttcaatgttaaagcgacggttgttaacggacaatacgagcaaaattaa

SEQ ID NO: 101868 - protein, 378 aa, Vibrio vulnificus CMCP6
MYALTNCKIYTGSDVLSEHALIIENDLIQSIVPAADLPSGIEVKDLAGANVSPGFIDLQLNGCGGVMLNDEITAETMQIMHKANLKSGCTSFLPTLITSSDEDMRAAISAAREYHAQYQNQSLGLHLEGPYLNVMKKGIHSVDYIRPSDTSMVDFICENADVVAKVTLAPELNDPEHIEKLRNAGIVVSIGHTNATYAEARKGFEAGITFATHLFNAMTPMVGREPGVVGAIYDTPDVYAGIIADGFHVDYANIRIAHKIKGEKLVLVTDATAPAGANMDYFIFVGKKVYYRDGKCVDENGTLGGSALTMIEAVQNTVEHVGIALDEALRMATLYPAKAIGVDAQLGRIKKGYIANLTIFDRDFNVKATVVNGQYEQN

SEQ ID NO: 101869 - DNA, 1137 bp, Vibrio vulnificus CMCP6
  CDS (1)..(1137): transl_table=11
atgaccatacatgctattgcagccaaacgaatatttgatggcgtccgttttcatcacgacgccgctctggtttggcagggacaacatattatgggtttggtgcctcgccatcaattgagcctagacgtcatcacttacgattaccctgatgccactctcacaccaggttttattgatcttcaagtcaacggcggtggcggcgtgatgtttaatacccaaacggacatcgttgccatggaacaaatttgtcatggtcaccgaaagcatggcactgcacatttactgccgacgttaatcagcgacacgcccgcacaactcaaacgtgcactaaaagcggcggaggcggcgctcaacgacaagataccaggcgtgcttggcgttcatcttgaggggccatggctaaactccgagaaaaaaggggctcacaataacgagctcttttacgcccccacaattgctgagcttgaaacctttccttggccagagaaagcgaaagtgctcatcacattggcaccagaacaaattgaagcgggggtccttcagtggctccatcaacaagatattgctctcttctgtggccatagtaacgcccggtatgagcaattaacctcaaaactgcggtaccttcacggctttactcacctttacaacgcgatgtccccttttgaaggtcgtgaaccgggtgtcgttggtacggcactcatggccgataatcaatggtgctctattattgccgatggcatacatgttcatccacaaagtgtgttgcttgctcaacgcattaaaccgcatggaaaattgctgcttgttaccgatgccatggcgaccgtgggcagtgagaagaacttcttcgaactgaatggcgaaaccattcaagtggtagataatgcactcgtcaacggcaatggtaatttggctggtgctcacatcggcatggatcagtcggtcatcaatctgattgagtggggtgtcgctgaggaagaggcgctgcgcatggcatcaacctatcccgcagaggccatcggcttaaccgacttggggtatcttcgtccagattaccgtgccagcgtcacgattttacgtgatgactacagcacgcaagccgtattggttgatggcacgctctttgagcaataa

SEQ ID NO: 101870 - protein, 378 aa, Vibrio vulnificus CMCP6
MTIHAIAAKRIFDGVRFHHDAALVWQGQHIMGLVPRHQLSLDVITYDYPDATLTPGFIDLQVNGGGGVMFNTQTDIVAMEQICHGHRKHGTAHLLPTLISDTPAQLKRALKAAEAALNDKIPGVLGVHLEGPWLNSEKKGAHNNELFYAPTIAELETFPWPEKAKVLITLAPEQIEAGVLQWLHQQDIALFCGHSNARYEQLTSKLRYLHGFTHLYNAMSPFEGREPGVVGTALMADNQWCSIIADGIHVHPQSVLLAQRIKPHGKLLLVTDAMATVGSEKNFFELNGETIQVVDNALVNGNGNLAGAHIGMDQSVINLIEWGVAEEEALRMASTYPAEAIGLTDLGYLRPDYRASVTILRDDYSTQAVLVDGTLFEQ

SEQ ID NO: 101871 - DNA, 1194 bp, Vibrio vulnificus CMCP6
  CDS (1)..(1194): transl_table=11
atggcatctgaacaacaacactatcgcgctcagcgaattttacacggtgatcactggttgcaagacgcggtgctcagtgtggattcgcaaggcaacatcagcgcgatagcggcatatgacccgcaacaacatcgaacagtgaccgacttgggcgctgtgaacttaatgcccggcttgatcgacagtcatgtccatggcagccaagggtgcgatgtgatggacgcaacacatgccagtttaaataccatgtcgcgatacttcgccagcttaggcgtcaccgcttttgtggccaccacggtcactgcgccagtggccaagattcgctcggcactagcgcaagtggcgaaaagcaagcagcaaggcgttgagggggccgagatcctcggtgcgtatttagaagggccttatttcaccgagaagaacaaaggcgcacacccaacgcaatggttccgcgagttggcggtggaagaactggataactggatttcctacagtgacaaccaactgttgaaagtggcactcgcgccggaaaaagagggggctctggcggcgattcgctacttagccaaccaaggcattagcgtcatgctgggccacaccgacgccagttaccagcaggtcaaactcgcgcttgatgcgggcgcaaagggcatcgtccattgttacaacggcatgcgaggcctacaccatcgcgaccccggagtggtcggggcggggctacttcaccctgaatgctatgtcgagatgatcgccgatggtcatcatgttcatcccgcggcgattgaagtggcgcaccgctgctgtggctcacgcatgaccttaattaccgatgccatgtgcgccacaggcatgcccgatggccaatacaccttgggggaatatcaggtggagatgaaacaaggtgtggtcacgactcaagaaggggggctcgcgggcagcacattaaccctgattgaaggggtaaaaaatattcaacgctggctcaatttgccgtttgagcaagcgtggttgatggcgtcacacacgcccgccaaatcgttaggcattcaacatcaactaggcacattagaagtcggcaaacgcgcttcaatggtggctttaggttccgatttctcaattgataaaacgtgggtgaatggtcgtctggtgtttgacgccgtggtttcccctcgtcaggaggctttatgtatctga

SEQ ID NO: 101872 - protein, 397 aa, Vibrio vulnificus CMCP6
MASEQQHYRAQRILHGDHWLQDAVLSVDSQGNISAIAAYDPQQHRTVTDLGAVNLMPGLIDSHVHGSQGCDVMDATHASLNTMSRYFASLGVTAFVATTVTAPVAKIRSALAQVAKSKQQGVEGAEILGAYLEGPYFTEKNKGAHPTQWFRELAVEELDNWISYSDNQLLKVALAPEKEGALAAIRYLANQGISVMLGHTDASYQQVKLALDAGAKGIVHCYNGMRGLHHRDPGVVGAGLLHPECYVEMIADGHHVHPAAIEVAHRCCGSRMTLITDAMCATGMPDGQYTLGEYQVEMKQGVVTTQEGGLAGSTLTLIEGVKNIQRWLNLPFEQAWLMASHTPAKSLGIQHQLGTLEVGKRASMVALGSDFSIDKTWVNGRLVFDAVVSPRQEALCI

SEQ ID NO: 101873 - DNA, 1230 bp, Mus musculus
  CDS (1)..(1230)
atgcgtagcgggcagtgtgcagcgggggccccggtgctccagttcaccaactgccgcatcctgcgtggcggcacgctcctcagggaggatctgtgggtgcgcgggggccgaatcctggacccagaaaagctgttttttgaggagaggcgtgtggctgatgagcagcgggactgcggaggccgcatcctggcgcctggctttatcgatgtgcagatcaacggtggatttggtgttgacttctccaaggctacggaggacgtgggttcgggggtcgccctagtggcccggaggctcctgtcccacggtgtcacctccttctgtcccaccctggtcacctccccaccagaggtttatcacaaggtccttcctcagatccctgtgaagagtggaggtccccatggggcaggggtcctcggggtgcacttggagggcccattcatcagccgggaaaagcggggtgcacaccctgaggcctacctccgctcctttgaagccaatgcttttcatgatgtgttggccacatatgggcccctggacaacgtctgcattgtgacacttgcccctgaactagaccggagccatgaagtgatccaggcactgacagcccaaggcatccgtgtgtctctagggcactcagtggccgacctgcgggctgcagaagtggcagtgcagagtggggccaccttcatcactcacctcttcaatgccatgttgcctttccaccaccgtgacccaggcatagtagggcttctgaccagtgaccagctgcccccaggccactgcatcttctatgggatgattgctgatggcatacacaccaaccctgcagctctgcgcattgctcaccgggcccatccccaggggctggtgctggtcactgatgctgtccctgccctgggcttgggcaatggccgccatacgctgggacagcaggaggtggaggtagatgggctaatagcgtacattgcaggcaccaagacactgggtggcagcatagcccccatggatgtgtgcgtccggcatttcctgcaggctacaggctgtagtgtggagtcggccctggaagctgcctccctccaccctgcccagatgctggggctggagaagaccaaggggagcctggactttggtgctgatgcagactttgtggtgctcgacgacactctccatgtccaggccacttacatctctggtgaactggtgtggcaggcagaggaagctgggccgtga

SEQ ID NO: 101874 - protein, 409 aa, Mus musculus
MRSGQCAAGAPVLQFTNCRILRGGTLLREDLWVRGGRILDPEKLFFEERRVADEQRDCGGRILAPGFIDVQINGGFGVDFSKATEDVGSGVALVARRLLSHGVTSFCPTLVTSPPEVYHKVLPQIPVKSGGPHGAGVLGVHLEGPFISREKRGAHPEAYLRSFEANAFHDVLATYGPLDNVCIVTLAPELDRSHEVIQALTAQGIRVSLGHSVADLRAAEVAVQSGATFITHLFNAMLPFHHRDPGIVGLLTSDQLPPGHCIFYGMIADGIHTNPAALRIAHRAHPQGLVLVTDAVPALGLGNGRHTLGQQEVEVDGLIAYIAGTKTLGGSIAPMDVCVRHFLQATGCSVESALEAASLHPAQMLGLEKTKGSLDFGADADFVVLDDTLHVQATYISGELVWQAEEAGP

SEQ ID NO: 101875 - DNA, 1161 bp, Xylella fastidiosa Temecula1
  CDS (1)..(1161): transl_table=11
gtgatgggtgtttcttctggcatcacagggttcatcaatggccgcattctgaccgataccgggttccgtcatgatctggcggtgttgttgcgtgagggcagcattcacgcactggtgccacatgatgatccgtgggtgatggaggttgcgcagtgggtggacttgcagggaggtctgttgctgcctgggtttatcgatattcaggtgaatggcggcggcggcgtgctgttcaataatgcgcgtgatgtggatggcttggccacaattgcgcgtgcgcaccgtcgctacgggacgacgggactgttacccacattgattagtgacactgtggaggtgatggctgaggccattgctgccacgcgtgccgcgattgctcagggggtaccgggaatcctggggattcacttggaaggcccttacctcaatcccctgcgtaaagggatccatgaccatactcaattccgtgtgccgcagttgcatgagctgatgcggtgcacggcattggataacggggtgactctggtgacgttggcgcctgagcaggtgccggttgagatgattcgtgtttttgtcgagcgtggtgcgatcgtctttgccgggcataccgcagcgacgtatgagcaagtgcgggctggcattgcagcgggtgtcacagggtttacgcatctgtacaacgcgatgtcgcagttagtcgggcgcgagccgaatgtggtgggtgctgcgctggaagatccgaatacatggtgcgggatcattgttgatggcgtacacgtacatccggcgagtctgcgtgtggccttagccgccaagccgcgcggtaaggtgctgctggtgaccgatgcgatgccaccagttggcagtgacagtgttcactatgatctctatggtgaaacgattacggtgatggatggtgtggtccgtaatgcggctggtgcgttggcgggtgccgcgctggatatggcaacggcggtgcgcaatacggtgcattggttgggtgttgatttggctgaggctgtgcgcatggcctcgacctatccggcgcagtgcattgggttaggggatcgtctggggaggattgcgcctggttatcaagccgacctggtgtgggttgatgacgacgtgcaggtacagggcacgtggattgctggtgtgggcgcttga

SEQ ID NO: 101876 - protein, 386 aa, Xylella fastidiosa Temecula1
MMGVSSGITGFINGRILTDTGFRHDLAVLLREGSIHALVPHDDPWVMEVAQWVDLQGGLLLPGFIDIQVNGGGGVLFNNARDVDGLATIARAHRRYGTTGLLPTLISDTVEVMAEAIAATRAAIAQGVPGILGIHLEGPYLNPLRKGIHDHTQFRVPQLHELMRCTALDNGVTLVTLAPEQVPVEMIRVFVERGAIVFAGHTAATYEQVRAGIAAGVTGFTHLYNAMSQLVGREPNVVGAALEDPNTWCGIIVDGVHVHPASLRVALAAKPRGKVLLVTDAMPPVGSDSVHYDLYGETITVMDGVVRNAAGALAGAALDMATAVRNTVHWLGVDLAEAVRMASTYPAQCIGLGDRLGRIAPGYQADLVWVDDDVQVQGTWIAGVGA

SEQ ID NO: 101877 - DNA, 1137 bp, Lactobacillus plantarum WCFS1
  CDS (1)..(1137): transl_table=11
atgagcaaagtgttaaaacatgccatcatttatactggtctagaaaagatcgatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagaccattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaagttgtcgggtggtcgggttaagttgattacttacgcgccggaagatcctggttcgcgtgaatttgaaaagtactgcttggaaaatggcattgtgccttcagtaggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaacattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataa

SEQ ID NO: 101878 - protein, 378 aa, Lactobacillus plantarum WCFS1
MSKVLKHAIIYTGLEKIDDGYIRFGKEIEAVGPMDDYVAQPDDDIEFVSGKTIVPGFIDVHSHGGYSFDSMDGNPAEINEMVNDMVAREGITSYFCTTMTQSNENLDHSMAGINKAADENPVIQGVHLEGPFISATFKGAQPEKYIKNPNVDLLDNWNKLSGGRVKLITYAPEDPGSREFEKYCLENGIVPSVGHSNATREQLLASKATHVTHLYNAQREFKHREPGVTGHAMLENNMYCELICDGFHIVPDMIKLAYEQKGVDRIELVTDSMRAKGEPDGISELGGQKVIVKDGQARLEEGNLAGSVLTFINAFKNIQKFTGCGIAEAVKMASVNQAREFGLTKKGTLEAGKDADINILDGNQDLVATYSYGKKAAK

SEQ ID NO: 101879 - DNA, 1137 bp, Vibrio parahaemolyticus RIMD 2210633
  CDS (1)..(1137): transl_table=11
atgtacgcgctaagtaactgtaaaatctataccggtagtgatgttcttaccgatcatgcggtcatcgttgaaaacgatctaattcaatccattgtgcccgttgctgaactaccgaaaggcattgaagtaaaagatctgaatggagctaacttaagtcctggttttatcgacctgcaactgaacggttgtggcggcgtcatgttgaacgatgctatcacagcagaaacgatgcaaatcatgcacgaagcaaacctaaagtcgggttgtaccagcttccttcctacgctgatcacttcttctgatgaagatatgcgcgcggcaatctccgcagctcgcgaatatcacaaaaaataccaaaaccaatcgcttggcttacatcttgaaggcccataccttaacgtcgcgaaaaaaggtattcatagcgttgacttcatccgtccatccgatgacggcatgattgaccttatttgctcaaatgcagacatcattgccaaagtaactcttgcgccagagcagaacgaccctgaacatatcgcacgcctaaaaactgcaggcattgtggtatcaatcggtcacacaaacgcgacctatgctgaagcacgcaaaggttttgaggccggtattacttttgcaactcacctattcaatgcgatgactcctatggttggtcgagagccaggagtggttggtgctatttacgatacaccagagatctacgcaggcatcattgctgacggcttccacgtagactacgcaaacattcgaattgctcataaaatcaaaggtgaaaagcttgttttggtgaccgatgccacagctccggcaggtgctaacattgatcactttatttttgtcggtaagaaagtatattaccgagatggtaagtgtgttgatgaaaacggcacactaggcggctcagctctgactatgattgaagcagttcagaacacagttgagcacgcaggtatcgctttagaagaagctctacgaatggctacactgtacccagcgacagcaattggcgttgaggaccgtctcggccgtattcgaaaaggcatggttgcaaacctgactattttcgatcgtgacttcaacgttaaagcgacggttgttaacggacaatacgagcaaaattaa

SEQ ID NO: 101880 - protein, 378 aa, Vibrio parahaemolyticus RIMD 2210633
MYALSNCKIYTGSDVLTDHAVIVENDLIQSIVPVAELPKGIEVKDLNGANLSPGFIDLQLNGCGGVMLNDAITAETMQIMHEANLKSGCTSFLPTLITSSDEDMRAAISAAREYHKKYQNQSLGLHLEGPYLNVAKKGIHSVDFIRPSDDGMIDLICSNADIIAKVTLAPEQNDPEHIARLKTAGIVVSIGHTNATYAEARKGFEAGITFATHLFNAMTPMVGREPGVVGAIYDTPEIYAGIIADGFHVDYANIRIAHKIKGEKLVLVTDATAPAGANIDHFIFVGKKVYYRDGKCVDENGTLGGSALTMIEAVQNTVEHAGIALEEALRMATLYPATAIGVEDRLGRIRKGMVANLTIFDRDFNVKATVVNGQYEQN

SEQ ID NO: 101881 - DNA, 1149 bp, Streptococcus pyogenes SSI-1
  CDS (1)..(1149): transl_table=11
atgacatgctatcttaaagcagattgtttttattacccaacagaggtgaaaccggctggctacctaagtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaagtaaaaggtgctaaaatacaaggtatctactttgaaggtccttattttaccgaagaatataagggtgctcaaaacccaagttatatgaaaaccccacgcttggaggaatttgatgcttggcaaaaagctgctaaagggctcatcaaaaaaattgcccttgctcctgagcgtgagggtgtcaaagaatttgtgtccgcagtgacaaaacaaggcgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagctatgattacggactgtatgcgagcaggtggttcaccagatggtgattacctcttgggagaattctctgtggttgtggcaaatggcactgctcgtcttaaagagagtggaaacttggcaggatctattttgaaattaaaagacggccttagaaatgtagtggcctggggaatcgcaactccggcagaagccattcatatggcaacctatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcctaa

SEQ ID NO: 101882 - protein, 382 aa, Streptococcus pyogenes SSI-1
MTCYLKADCFYYPTEVKPAGYLSLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKTPRLEEFDAWQKAAKGLIKKIALAPEREGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 101883 - DNA, 1155 bp, Salmonella enterica subsp. enterica serovar Typhi Ty2
  CDS (1)..(1155): transl_table=11
atgtatgctttaacccagggccggatctttaccggtcacgaaattcttgatgaccatgcgcttgttgtcgctaatggcctgattgaccgcgtttgtccgatggccgagctgccgccgggaatagaacaacgctcattgaatggggccattctctcccccggttttattgatgtgcagctaaacggctgcggcggagtgcagtttaacgataccgcagaagccgtcagcgttgaaacgctggaaattatgcagaaagccaatgaaaaatcgggctgtactaactttctgccaacgcttatcactaccagcgacgaattgatgaaacagggtattcgcgtcatgcgcgagtatctggaaaaacatccgcaccaggcgctgggtctccacctggaaggcccctggcttaatctggtaaaaaaaggcacccataatcctgatttcgtgcgtaaaccagacgctgcgctggtcgatttcttatgcgataatgccgacgtcatcaccaaagtcactctcgcgccggaaatggtgcctgctgacgtaatcgctaaactggcgaatgcgggcattgtggtttccgcaggtcactccaacgcgacgttaaaagaggcaaaagcgggcttccgcgccgggattacctttgcgactcacctgtttaacgcgatgccgtacattacagggcgtgagccgggccttgctggcgctgttctggacgaagcggatatttattgcggcgttatcgccgatggtctgcatgtcgactacgccaacattcgcaatgccaaacgcctgaaaggcgacaaactttgtctggtgacagacgccaccgcaccggcgggggccaatattgagcagttcattttcgcaggtaaaacaatatactaccgcaatggactgtgtgtggatgaaaacggtacgttgagcggttcgtccttaaccatgattgaaggcgtacgcaacctggtcgcgcattgcggcatcgcgctggatgaagtgctgcgcatggcaacgctctatccggcacgcgctatcggcgttgataagcatctcggtagcattgcgccgagtaaagtcgccaacctgaccgcgttcacccacgattttaaaattatcaagaccatcgttaatggtgacgaggtcgttgacttgagtaagtga

SEQ ID NO: 101884 - protein, 384 aa, Salmonella enterica subsp. enterica serovar Typhi Ty2
MYALTQGRIFTGHEILDDHALVVANGLIDRVCPMAELPPGIEQRSLNGAILSPGFIDVQLNGCGGVQFNDTAEAVSVETLEIMQKANEKSGCTNFLPTLITTSDELMKQGIRVMREYLEKHPHQALGLHLEGPWLNLVKKGTHNPDFVRKPDAALVDFLCDNADVITKVTLAPEMVPADVIAKLANAGIVVSAGHSNATLKEAKAGFRAGITFATHLFNAMPYITGREPGLAGAVLDEADIYCGVIADGLHVDYANIRNAKRLKGDKLCLVTDATAPAGANIEQFIFAGKTIYYRNGLCVDENGTLSGSSLTMIEGVRNLVAHCGIALDEVLRMATLYPARAIGVDKHLGSIAPSKVANLTAFTHDFKIIKTIVNGDEVVDLSK

SEQ ID NO: 101885 - DNA, 1167 bp, Bacteroides thetaiotaomicron VPI-5482
  CDS (1)..(1167): transl_table=11
atgttaacacaaatcattaatgcgcgcatcctcacccctcagggctggttgaaggatgggtccgtacttattcgtgatcataaaattctggaagtgactaactgcgacctggcggttatcggagcaaaactgattgatgccaagggcatgtatatcgttccgggaggagtagaaattcatgttcatggcggtggtggaagagactttatggaggggacggaagacgccttccggacagcgattaaagctcacatgcaacacggaactaccagtattttccccacactttcttcttctactattcctatgatccgtgcagccgcagaaacaactgaaaagatgatggcagagccggacagtcccgtactcggcctgcatctggaaggacattacttcaatatggagatggcaggcggacagattccggagaatatcaaaaatcctgatccggaagagtatatccctttgctggaagaaacccattgcatcaaacgttgggatgcggcaccggaacttccgggggctatgcagttcggaaagtatatcaccgcaaaaggcgtattggcatctgtaggacatacacaggctgaatttgaagatatccagactgcgtatgaggcaggatatacgcatgctacacatttctacaatgctatgcccggatttcacaaacggaaggaatataagtatgaaggtacggtagaaagtatttatttgattgatgatatgacagtggaagtcgtggccgatggcattcatgtgcctcctaccattcttcgtctggtctataagataaaaggagtggagcgtacgtgcctgatcactgatgcgctggcttgtgcggcaagtgacagtaagactgcttttgatccgcgtgtcattatcgaagacggtgtgtgcaaactggcagaccgctctgcattggcaggaagtgtggcgacgatggaccgtctgatccgtacgatggtgcagaatgctgaaattcctttggcggatgctgtgaggatggcttccgagactccggcccgtatcatgggagtgctcgaccgcaaaggtacgttggaacgtggcaaggacgcggatattattgctttggatagagatctgaatgtaagagcggtctgggcgatgggacaattggtagaaggtacaaacaagctgttttaa

SEQ ID NO: 101886 - protein, 388 aa, Bacteroides thetaiotaomicron VPI-5482
MLTQIINARILTPQGWLKDGSVLIRDHKILEVTNCDLAVIGAKLIDAKGMYIVPGGVEIHVHGGGGRDFMEGTEDAFRTAIKAHMQHGTTSIFPTLSSSTIPMIRAAAETTEKMMAEPDSPVLGLHLEGHYFNMEMAGGQIPENIKNPDPEEYIPLLEETHCIKRWDAAPELPGAMQFGKYITAKGVLASVGHTQAEFEDIQTAYEAGYTHATHFYNAMPGFHKRKEYKYEGTVESIYLIDDMTVEVVADGIHVPPTILRLVYKIKGVERTCLITDALACAASDSKTAFDPRVIIEDGVCKLADRSALAGSVATMDRLIRTMVQNAEIPLADAVRMASETPARIMGVLDRKGTLERGKDADIIALDRDLNVRAVWAMGQLVEGTNKLF

SEQ ID NO: 101887 - DNA, 1173 bp, Bacteroides thetaiotaomicron VPI-5482
  CDS (1)..(1173): transl_table=11
atgttaactcaaataatcaacggtagaatacttactccgcaaggctggctgaaagacggctctgtattgatttgtgatggaaaaatattagaggtaaccaacagtgatctggcagttatcggtgcaacagtgattgatgcgagaggaatgacaatcgtaccgggatttgtcagtatgcatgcgcatggtggcggcggccatgattttaccgaagcaacggaggaggctttccgtatcgcagcaactgctcatttgaagcatggagctaccggcatatttcctactttgtcatctacttcgtttgagaggatatatcaggcggtcgatgtttgtgagaagctgatgaaggaaccggagtctccgattctcggtctgcatatcgaagggccttatctgaatccgaagatggcaggaagccagtatgacggttttctgaaaactcccgatgaaaatgaatatgtgccgctgttggaacatacttcctgtatcaagcgctgggatatcagtcccgaattgcatggggcacatgattttgcaaaatacactcgttccaagggaattatgacagccgttactcatacggaggctgaatatgatgagattaaggcagcgtatgcggtaggattctcgcatgctgctcatttctataatgcgatgcccggttttcataaacgtcgcgaatataaatatgaaggtacggtagagagtgtatatctgacagatggaatgacggtagaagttattgcagacggtattcacttgcctgctactattctgaaactggtttataaactgaaaggggtagagaatacttgtctggtgactgatgcgttggcttatgctgccaatgaagggaacgagccgattgatccgcgttatattattgaggacggagtatgtaagatggcggatcattctgcattagccggtagtctggcgactatggatgtgttggttcgtacgatggtgaagaaagcaagtattcctttggaagatgctgtgcgtatggcttccgaaactcctgcccgtctgattggtgtgagcgatcggaaaggggcattgtctaaaggtaaagatgctgatattgtgatacttgataaggaattgaatgtacggtgtgtctggtcgatgggaaaagttgttccggggactgatagattgctgcataaatga

SEQ ID NO: 101888 - protein, 390 aa, Bacteroides thetaiotaomicron VPI-5482
MLTQIINGRILTPQGWLKDGSVLICDGKILEVTNSDLAVIGATVIDARGMTIVPGFVSMHAHGGGGHDFTEATEEAFRIAATAHLKHGATGIFPTLSSTSFERIYQAVDVCEKLMKEPESPILGLHIEGPYLNPKMAGSQYDGFLKTPDENEYVPLLEHTSCIKRWDISPELHGAHDFAKYTRSKGIMTAVTHTEAEYDEIKAAYAVGFSHAAHFYNAMPGFHKRREYKYEGTVESVYLTDGMTVEVIADGIHLPATILKLVYKLKGVENTCLVTDALAYAANEGNEPIDPRYIIEDGVCKMADHSALAGSLATMDVLVRTMVKKASIPLEDAVRMASETPARLIGVSDRKGALSKGKDADIVILDKELNVRCVWSMGKVVPGTDRLLHK

SEQ ID NO: 101889 - DNA, 1188 bp, Bacteroides thetaiotaomicron VPI-5482
  CDS (1)..(1188): transl_table=11
atggaaagactgattattatcaatggggaactaatactccctaccggcatcgaaaccaataaaataatggtttgccggaatggtaagatagaacagattgtatcatccgaagcatatattcctcaagctgacgaccggatcatagatgccaaccaacaatatgtctccccaggatttatcgatatacatgttcacggtggcggaggtcatgactttatggatggaaccgtagaggcctttctgggagtagccgaaactcatgccagatatggaacaacagccatggtacctacaacactgaccagcacaaacgaagagctaatgacgacctttgccgtttatcaaaaagccaaaagtcttaataaaaaaggtgcccaatttatcgggctgcatctggaagggccctacttctcgcctaagcagtgtggagcccaagaccccaatcatttgaaaacgcctcatccggacgaatataacacaatactggaagcttcacaagatattgtacgatggagtattgctccggaactggcaggagcaattgaactgggggaaaagctcaatagctgtcacattctcccatccatcgcacataccgatgccatttatgaagaagtggtaaaagcatacgaagcagggtatactcatatcactcatttatattcagcgatgtcaaccatcacccgtagaaatgcctatcgctatgcaggtgtggtagaggcagcttatctgattgatggtatgacagtagaaatcattgcggacggcattcatctgcccaaacctttactacaattcgtatataagttcaagggggccgataaaacagcactttgcacagatgccatgcgaggtgcgggaatgccggacggtgaatccatattaggcagcctgaccaacggtcagaaagttattattgaagacggagtagccaaacttcccgatcgttcggcatttgccggaagcgtagctaccgccgatcgtttggtaagaaccatgataaatatagccggcatacccctaatcgatgctatccgaatgataacccttacccccgcccgcattctgcatgtggattcccaaaagggttctttggaggaaggtaaagatgccgacatcgtcaccttcgacaatcaaattaacgtaacaacaactatatcaaaaggccatgttatctacaatcaatga

SEQ ID NO: 101890 - protein, 395 aa, Bacteroides thetaiotaomicron VPI-5482
MERLIIINGELILPTGIETNKIMVCRNGKIEQIVSSEAYIPQADDRIIDANQQYVSPGFIDIHVHGGGGHDFMDGTVEAFLGVAETHARYGTTAMVPTTLTSTNEELMTTFAVYQKAKSLNKKGAQFIGLHLEGPYFSPKQCGAQDPNHLKTPHPDEYNTILEASQDIVRWSIAPELAGAIELGEKLNSCHILPSIAHTDAIYEEVVKAYEAGYTHITHLYSAMSTITRRNAYRYAGVVEAAYLIDGMTVEIIADGIHLPKPLLQFVYKFKGADKTALCTDAMRGAGMPDGESILGSLTNGQKVIIEDGVAKLPDRSAFAGSVATADRLVRTMINIAGIPLIDAIRMITLTPARILHVDSQKGSLEEGKDADIVTFDNQINVTTTISKGHVIYNQ

SEQ ID NO: 101891 - DNA, 1149 bp, Enterococcus faecalis V583
  CDS (1)..(1149): transl_table=11
atgaaaacatttatctttgcagacaagttctttttaaaaagcgatgttaaaggacctggttatttagaaatcacggatggtatctttggtaattatacaaaagatgaaccgcaaggggacgtaaaaattattcgtgaggaaggcaaatggattgccccaggtttagtcgatactcatattcatggttacatgaatcatgacgtaatggataacgatgcagaaggcattaaagtgatgtctgaaggcttattatcttgtggtgtaacttcatttttaccaacaacgttaacttcaagtaaagaacgtttaacagacgttgcacgtacgattggtcaagtctaccaagaagtacctggtgcaaaaattcaagggatttactttgaaggacctttctttactgaagaacataaaggcgcacaaaatccaagttattttggagatccagaccttgatacattccacgaatggcaagaagcttcaggcggaattattaagaaaattgcgttggcaccagaacgtaatggtgtgaaagaatttgttgaaaccgttacagatgaaggtgtcgttgttgctttaggccatagtaatgcgaccttagaagaagctgatgtggcagttgaagcaggcgctagcgtttttgttcatgcatataatgggatgcgcggcttaaatcaccgtgaaccagggatggttggtgcattgttaacgttacaacacgttttctctgaattaatttgtgatggacaccatgtacatccgcaagcggctgaagtattgatggaaaaagcgggccatgatcacgttgcgttaattacagactgcatgatggctggcggtatgccagatggcaactataatttaggtgaatttcctgttgtggtagcagaaggaacggctcgtttggatactgggaacttagcaggtagtattttaaaactaaaagaagcaattaaaaatgtagttgattggggtattgcaacacctgcacaagcaattatgatggcttcattagttcctgcgattagctgtaaaattgatgatcaatgtggcatgattgcaaatggtcgcgatgctgactttatcgtattagaaccaaccatggaattagcagccacttatttagatggcgtagaacgttatcgagcataa

SEQ ID NO: 101892 - protein, 382 aa, Enterococcus faecalis V583
MKTFIFADKFFLKSDVKGPGYLEITDGIFGNYTKDEPQGDVKIIREEGKWIAPGLVDTHIHGYMNHDVMDNDAEGIKVMSEGLLSCGVTSFLPTTLTSSKERLTDVARTIGQVYQEVPGAKIQGIYFEGPFFTEEHKGAQNPSYFGDPDLDTFHEWQEASGGIIKKIALAPERNGVKEFVETVTDEGVVVALGHSNATLEEADVAVEAGASVFVHAYNGMRGLNHREPGMVGALLTLQHVFSELICDGHHVHPQAAEVLMEKAGHDHVALITDCMMAGGMPDGNYNLGEFPVVVAEGTARLDTGNLAGSILKLKEAIKNVVDWGIATPAQAIMMASLVPAISCKIDDQCGMIANGRDADFIVLEPTMELAATYLDGVERYRA

SEQ ID NO: 101893 - DNA, 1152 bp, Enterococcus faecalis V583
  CDS (1)..(1152): transl_table=11
atgattattcaaagtaaaaacgtatggattaacgaacaatttcaaccagctcaagttgaagtgtcagaacaacgaattgttgcaattctaccgtacaatgaaaaagctgtcgacaaagaatacggagaaaagcgcattcttccaggatttattgatattcacgatcatggttggcatggtggggatgccaatcatgccaatcatgaatttatcaaagagtggcaagcttaccttccagaagaagggattacagcttttttgccaacaacgtcaacaacatttccaaaagacttggaacattcatttgaagtgattggttcatttattgaggaagaccaaggaaccaacggagcacaaatcttagggattcatgcggaaggaccaatgatttctgaagaatttcgtggctctcataatccagagttattagtaaaaccatccgttgagacatttaaaaaatggcaagagttagcaaaagggcacataaaattaatgacgttggcaccagaaaatgatgtagagaatgccttgactacatattgtcatgaacatgatgtagtcatttcaattggccatacggctgcaacctatgaacaagcaatggcagctgtcgaagcaggtgcaaaaagttttacccatacgtttaatggaatggaagatatcagtcaccggaaaccaaccgcagtagttgctgctttggatagtgaagaaacgtttgctgaaattattgctgatggggtacatgttgattattcattagtacgtgtgttagccaaactaaaaggcaaggactatttaattgctgtgacagattctatctgggccaaagggtgtcaaccaggcgtttatccaaaaccagaaaaagggatcgaaatggttattgatgaacaaaatgtggtccgtttagccaatggcaagttagctggaagtacgaaccatttaaataatatggttcgcaaccttgttgaaaaagcattacttccagaagtgattgctattaattcagtcacgaaaaatccagctcgtttgttgaatgtgaacgaatctatgggagaaatcaaactagggcttttaggtaattttacaattattgatgagaaatatgaagtgctagaaaccttagtaaatggtgaaacagtttataaaaagtag

SEQ ID NO: 101894 - protein, 383 aa, Enterococcus faecalis V583
MIIQSKNVWINEQFQPAQVEVSEQRIVAILPYNEKAVDKEYGEKRILPGFIDIHDHGWHGGDANHANHEFIKEWQAYLPEEGITAFLPTTSTTFPKDLEHSFEVIGSFIEEDQGTNGAQILGIHAEGPMISEEFRGSHNPELLVKPSVETFKKWQELAKGHIKLMTLAPENDVENALTTYCHEHDVVISIGHTAATYEQAMAAVEAGAKSFTHTFNGMEDISHRKPTAVVAALDSEETFAEIIADGVHVDYSLVRVLAKLKGKDYLIAVTDSIWAKGCQPGVYPKPEKGIEMVIDEQNVVRLANGKLAGSTNHLNNMVRNLVEKALLPEVIAINSVTKNPARLLNVNESMGEIKLGLLGNFTIIDEKYEVLETLVNGETVYKK

SEQ ID NO: 101895 - DNA, 1146 bp, Streptomyces avermitilis MA-4680
  CDS (1)..(1146)
atggccactagcaacgtgctcgccggtgcccgggtggtgctgcccacggggatcgtggacggcggccgggtgatcgtcgagggaacgcgcatcgcgggcgcctcctccgaggacgccccggtcgtggacctgtccggccactggctggtcccgggcttcgtcgatctgcacaaccacggcggcggcggcgcgtccttcacctcgggcaccgccgaggaggttctccggggcgtccacacccaccgcctgcacggcaccaccaccgtcgtcgcctccaccgtcaccggcgagatggacgtgctggcccagcgcgcggggctgctctccgagctggccgagcagggcgacatcgccggcatccacttcgagggcccgttcatctcgccgtgccgcaagggcgcccactccgaggaactgctgcgcgacccggacccggccgaggtccgcaagctgatcgacgcggcgcgcggcagggcgaagatggtcacgctggccaccgaactgccgggcggcatcgactccgtacgcctgctggccgagcacggggtgatcgccgcgatcgggcacacggacgcgacgtacgagcagacggtggaggccatcgacgcgggtgcgacggtcgccacgcacctgttcaacgcgatgcccgcgctcggccaccgcacgccgggcccgatcgccgccctcctggaggacgagcggatcacggtcgagctgatcaacgacggtacgcatctgcacccggccgccctccagctggcgttccatcacgcgggcgccggccgggtcgcgttcatcacggacgcgatggacgcggcgggcttcggcgacggccgctatctgctcggcccgctggaggtcgaggtcagtgagggcgtggcgcggctgatggagggcggttcgatcgcgggctcgacgctcacgctggaccgcgccctcaagcgggcggtcaccgtcgacgggctgccggtcgaggacgcggtggcggccctgtccgccaacccggccaggctgctcggcgtgtacgaccaggtgggctcgctggagcccggcaaggacgccgacctggtggttcttgacgcggagttcacgctcaagggcgtgatgcgcaagggcgaatgggtggtcgatccccaactggggtga

SEQ ID NO: 101896 - protein, 381 aa, Streptomyces avermitilis MA-4680
MATSNVLAGARVVLPTGIVDGGRVIVEGTRIAGASSEDAPVVDLSGHWLVPGFVDLHNHGGGGASFTSGTAEEVLRGVHTHRLHGTTTVVASTVTGEMDVLAQRAGLLSELAEQGDIAGIHFEGPFISPCRKGAHSEELLRDPDPAEVRKLIDAARGRAKMVTLATELPGGIDSVRLLAEHGVIAAIGHTDATYEQTVEAIDAGATVATHLFNAMPALGHRTPGPIAALLEDERITVELINDGTHLHPAALQLAFHHAGAGRVAFITDAMDAAGFGDGRYLLGPLEVEVSEGVARLMEGGSIAGSTLTLDRALKRAVTVDGLPVEDAVAALSANPARLLGVYDQVGSLEPGKDADLVVLDAEFTLKGVMRKGEWVVDPQLG

SEQ ID NO: 101897 - DNA, 1143 bp, Bacillus cereus ATCC 14579
  CDS (1)..(1143): transl_table=11
atgaaaacgcaaattgtcatcaatgccaaaatttacacaggtcaagaaatagtggaaaacggatttattcgttacgcagaaaccattaaagaaattggtttgatggctcaatatgtaccacaagaaaatgaaactgtttttgatgctacagggaagattataattccaggtatgatcgatgttcatattcatggtggatacgatattgatgcgatggatgcaaatagcgatgggttagtaactctaggtaaagaaatgttaaaagaaggggttacaacttacttcccaacaacaatgacacaagctccagaggcaattgaagcagcgttaactgctgcgaaagaagcaaaagaaaaaggagcgcatttcgaatatattcatttagaaggaccttatgtttcaaagaaacgtgcaggtgcacagccacttgaacatatcgttcctgcaaatattgagcaatttaaacaatggcaagaagcaagtgggaacttaattaaattagtaacatatgcaccagaagaagagggagcattagagtttgaacaatatcttgctgaaactggtgtagttggcacaatgggacatacagatgcaattgatgcgcaactaaaaaatagaaagattacacatgcgacacatttatacaatcaaatgcgtggattacatcaccgtgaaccaggagttgtgggtcatgtgttattaaatccagatgtaatggttgaagtaattacagatggtattcatattcaccctgacatggtgaaattagcatataagttaaaaggaccgaaaaaagtaagtgttattactgacgcaatgcgtgcaaaaggtcttgaagatggattatatgagcttggcggacagccagtacatgtaaaagatggtagtgctcgattagaagatggaacgttagctggtagtattctaaaaatggatcaagctttccgaaatgtaattgaatttacaggttgttcaatcgaagatgcagtacttatgacatcagttaaccaagcagaagagtttggattaaataataaaggtgcattagcggtaggaaaagatgcagactttgttgtgatgaatgaagatttacatgtatatgatacggttcgtttaggaattcatatgaaggaagggaagtaa

SEQ ID NO: 101898 - protein, 380 aa, Bacillus cereus ATCC 14579
MKTQIVINAKIYTGQEIVENGFIRYAETIKEIGLMAQYVPQENETVFDATGKIIIPGMIDVHIHGGYDIDAMDANSDGLVTLGKEMLKEGVTTYFPTTMTQAPEAIEAALTAAKEAKEKGAHFEYIHLEGPYVSKKRAGAQPLEHIVPANIEQFKQWQEASGNLIKLVTYAPEEEGALEFEQYLAETGVVGTMGHTDAIDAQLKNRKITHATHLYNQMRGLHHREPGVVGHVLLNPDVMVEVITDGIHIHPDMVKLAYKLKGPKKVSVITDAMRAKGLEDGLYELGGQPVHVKDGSARLEDGTLAGSILKMDQAFRNVIEFTGCSIEDAVLMTSVNQAEEFGLNNKGALAVGKDADFVVMNEDLHVYDTVRLGIHMKEGK

SEQ ID NO: 101899 - DNA, 1218 bp, Rhodopirellula baltica SH 1
  CDS (1)..(1218): transl_table=11
ttgcttcgaaggaatcccgtgccccaactttgcattcttaatggcaccgccatcttgcccgaccggttgctttccgatgcggttgttgtctgccgagacgatcgaatcacctacgtcggaaccgcacaatctcgaattccggcctcggccgagatcgttgacgcgaaaggcggctacatcaccccaggctttgtcgacatccacatccatggtggcggtggtgctgacgtgatggatggcagtgcagacgcggtcaagaccgtgtgccaatcccatgctcgccacgggacaacgaccatgttccccacaaccagcaccggaaccgacgaccaaattcacgcgatgctggcggcatgcggcgaagtccgtgacacttggaacatcgaatccggcagcaagatcgccggcgtgcatctctacggcccgtacttcgccgaaggcaaaacggggtgtcacgacgagtccgtttgccgggctcccgaggcggccgagtatcgtcgctactttgaatccggcatcgttggaatcgcgacttgcgcagcagaacttcccggagcagcggcgttttaccgacacgcgaccaaacgcggttgtctggtgacctgcggtcattccaattccagttggaacgagatggaaactgcctttcaaaatggcatgcgacacgtcgatcacttttggtgtgcgatgagtaacgtgtcttcggttcgcaaacgtctcggcgtaccaatgcaaggcagcatgctggaatacgtgttgtccaatcctgaaatgagcaccgaggtcatcgccgatgggatgcacttggcaccggaacttctgagttttgcctggcggatgaaacgcagtgagcgattgtgtttggtcaccgactgcaatcgggccctcgacatgcctcctggaaaatatcgatttggtcctgaagaggacggttcctggttcaccagcgacggcaaagtcggctgggcgtcaccgggctctttggccagttccgtgatggggatggaccacatggtccgcacgatgcacaagctcggaaacgtcccgctgcaagacgccgttcgcatggccaccctgactcccgccgagcgaaccggcatcgatcaacaagtcggcagcctcaccgccggcaaacaagccgacatccttgtgctcagcaagacactgaaggtgaagcaggtccacatcagcggggagcgttgggcacaaagtcgttga

SEQ ID NO: 101900 - protein, 405 aa, Rhodopirellula baltica SH 1
MLRRNPVPQLCILNGTAILPDRLLSDAVVVCRDDRITYVGTAQSRIPASAEIVDAKGGYITPGFVDIHIHGGGGADVMDGSADAVKTVCQSHARHGTTTMFPTTSTGTDDQIHAMLAACGEVRDTWNIESGSKIAGVHLYGPYFAEGKTGCHDESVCRAPEAAEYRRYFESGIVGIATCAAELPGAAAFYRHATKRGCLVTCGHSNSSWNEMETAFQNGMRHVDHFWCAMSNVSSVRKRLGVPMQGSMLEYVLSNPEMSTEVIADGMHLAPELLSFAWRMKRSERLCLVTDCNRALDMPPGKYRFGPEEDGSWFTSDGKVGWASPGSLASSVMGMDHMVRTMHKLGNVPLQDAVRMATLTPAERTGIDQQVGSLTAGKQADILVLSKTLKVKQVHISGERWAQSR

SEQ ID NO: 101901 - DNA, 1146 bp, Haemophilus ducreyi 35000HP
  CDS (1)..(1146): transl_table=11
atgaaatatgcgttaacgaatggcgttatttatacggctaaagacgtattgtatggttatgcggtcgttgttgaaaatggcatcattcaagcggtcgtgcgccaaaccgagttggcgagtgggctagccaagattgatttacaaggaaataatttgaccgctggttttattgatctgcaattaaatggttgtggtggcgttatgtttaatgaagaaccgacagttcgcaccttagagattatgcaacaaaccaatttgcgttcgggtacaaccagttttttaccaacttttattacagctccagatgaggatatgaaacacgcggtgcagactatgcgcgcttatttagcaacacaccaaaatcaggcattagggttgcatttagaagggccatatctcagcctagagaaaaaaggcgtgcatcgtgcggaatatgtacgaacactttcgccaccgatgaaacaattcttattggataatgccgatgttattagcaaaattaccttagcggctgaaaatcctgccgctgaagcgattcctgagtttgtccaaaaaggcattgttgtgtcaataggccattcaaatgcaacttatccggtggcgaaacaagcttttgcaaagggcgcaagttttgctacgcatttacataatgctatgtcgccaattagcagtggccgagcgatgggtgtcgtaggtgctgtgttggacagcgatgatgtttatgcgggtattattgtggatggattacacgtggagtttggcaatatcaaaattgctaaacgcgccaagggtaataagttatgtattgtgaccgattcaaccgcagcagctggggccgagattgaacaattcacctttgtgggtaaaacagtctatgttcgtgatggcaaatgtgtagatgcgaatggtactttgggcggggcttcaattacgatgattgaatcaattaagaatgcggtagaacaagtgggcatttcattagcagagagtttgcgtatgtgtaattattatccagcacaagcaataggtgttgcggataaattaggttccattgaggtaggtaaaattgctaatttaaccgcttttaatcaccgttttgaagtggtggctagtagcgtaaatggtgaatggtatgcttttaattaa

SEQ ID NO: 101902 - protein, 381 aa, Haemophilus ducreyi 35000HP
MKYALTNGVIYTAKDVLYGYAVVVENGIIQAVVRQTELASGLAKIDLQGNNLTAGFIDLQLNGCGGVMFNEEPTVRTLEIMQQTNLRSGTTSFLPTFITAPDEDMKHAVQTMRAYLATHQNQALGLHLEGPYLSLEKKGVHRAEYVRTLSPPMKQFLLDNADVISKITLAAENPAAEAIPEFVQKGIVVSIGHSNATYPVAKQAFAKGASFATHLHNAMSPISSGRAMGVVGAVLDSDDVYAGIIVDGLHVEFGNIKIAKRAKGNKLCIVTDSTAAAGAEIEQFTFVGKTVYVRDGKCVDANGTLGGASITMIESIKNAVEQVGISLAESLRMCNYYPAQAIGVADKLGSIEVGKIANLTAFNHRFEVVASSVNGEWYAFN

SEQ ID NO: 101903 - DNA, 1158 bp, Prochlorococcus marinus subsp. marinus str. CCMP1375
  CDS (1)..(1158): transl_table=11
atgcgtcatctaattaatatccgattaccaagttcattacctttttctcttaaagagagtttgtggtggatcaaagttgacgaagacggaaagattttatctcttaacccaatgtccgatacaacacctgttaagggagaagattggtctggtgattggataagcccaagagctgttgatcttcaaattaatggtggacttggattatcttttgtagatcttgatattcagcaattacctaagctcattgaattgttggattttctttgggctgaaggagtagaggcgatttcaccaacattagtaagttgcagtattaaagctttacgcaattccttagatgtttttcgattagctcgtcaacaaagtagtagtagtagatgcaaacttcttggagctcatctagaaggcccttttttatcaaaggattttaaaggtgctcatgattcgaaacatatttgtttgccaagtttgcttgctttagaagaaagaattagaggttttgaaaaagaaatcactttggttacccttgctcctgaattgccagggtctttagaagtaataagtaaattgagagagcttggaattattatttctttaggtcattctgcagctgattcagaaacttctaatttagcttttaagtcaggagtgagcatgatcactcatattttcaatgcaatgcctggccttcatcacagattcccaggacctataggagaggctttgtctcatggagagatttctttgggtttaattgctgacggggttcatgtacatccaaatattgcatcaatattgcaaaagttagcgtccgatcagatctttttagttagtgatgcattagctccttacggtttatctaaaaatcaatttgactgggacaaaagagttttgcttattgaagaaggaatctgcagattagaagaaggtacattggcaggaacaaccttgccgcttttagatggctgtaagcgatttgcaagatggaccaagcaaccctctgctgctatttgggctgcaacggtatcgcctagaatatttttacaaaaacgcaaaaatattcacgaatttttcattggccaatccttgcagaaattgttgagatggcattgtaattttgattctaattctcttaattggaatattgctgagtag

SEQ ID NO: 101904 - protein, 385 aa, Prochlorococcus marinus subsp. marinus str. CCMP1375
MRHLINIRLPSSLPFSLKESLWWIKVDEDGKILSLNPMSDTTPVKGEDWSGDWISPRAVDLQINGGLGLSFVDLDIQQLPKLIELLDFLWAEGVEAISPTLVSCSIKALRNSLDVFRLARQQSSSSRCKLLGAHLEGPFLSKDFKGAHDSKHICLPSLLALEERIRGFEKEITLVTLAPELPGSLEVISKLRELGIIISLGHSAADSETSNLAFKSGVSMITHIFNAMPGLHHRFPGPIGEALSHGEISLGLIADGVHVHPNIASILQKLASDQIFLVSDALAPYGLSKNQFDWDKRVLLIEEGICRLEEGTLAGTTLPLLDGCKRFARWTKQPSAAIWAATVSPRIFLQKRKNIHEFFIGQSLQKLLRWHCNFDSNSLNWNIAE

SEQ ID NO: 101905 - DNA, 1155 bp, Candidatus Blochmannia floridanus
  CDS (1)..(1155): transl_table=11
atgtatgctttaattaatagtagaatgtatactggttatgatattttagatcatcatgtactgatagtagatgatggatatataaaggcaattcatccattaaatgaattgcctttatatataaaaacgtatgatttatctggattaattttatctcctggatttatagatttacaactgaacggttgtggtggggttcaatttaatgataacattgaatcaattactgttcagacattagaaaatatgaataataccaatcgttgttttggatgtactaattttcttcctaccttaattactagtcatgacgttttaatacaaaaagcagtggaatcagtgcgtatttttttaaaacataatcaaaatcaggtattaggtttacatttagaaggtccgtttattaatatcaaaaaaaaaggaatacataatgcttcattaatacgtaccccaacaaaaaaaatgatacattatctatgtaaaaatagtgatattataaaaaaaattactcttgcaccagaattattagatatgatcgttattgaaaaattgaaagaatctggtatttgtatatctgtggggcattctaatgctacatatcaagaaacaaaattaggttttttggcaggagtaacattcgggacacatttatttaatgcaatgcctgcattaactgcacgtgaacctggagttattggagcgattttcgattcttatcatatctattgtagtataatagctgatggaatacatgtacattggtccaatataaaatattcgaaaaaaattaaagaaaagcacttaattttaattactgatggaacaagtccatctggattaccatcggatcaaattactaattttatttttgctggagaaactatattccatcataataatacatgtataaataaacatggcacacttgctgggtcaaatttaactatgattaggtcaatacaaaatatagtagaatatgctcatattcctttagatgaagcattacgcatggcaactttatatcctgctcaagctattggggctcatcattatctaggtagtttagaaatcaataaagttgctaatttaactgcttttaattctcaatttcaagtgaaaaaaactattgttaatggaattatatacactatataa

SEQ ID NO: 101906 - protein, 384 aa, Candidatus Blochmannia floridanus
MYALINSRMYTGYDILDHHVLIVDDGYIKAIHPLNELPLYIKTYDLSGLILSPGFIDLQLNGCGGVQFNDNIESITVQTLENMNNTNRCFGCTNFLPTLITSHDVLIQKAVESVRIFLKHNQNQVLGLHLEGPFINIKKKGIHNASLIRTPTKKMIHYLCKNSDIIKKITLAPELLDMIVIEKLKESGICISVGHSNATYQETKLGFLAGVTFGTHLFNAMPALTAREPGVIGAIFDSYHIYCSIIADGIHVHWSNIKYSKKIKEKHLILITDGTSPSGLPSDQITNFIFAGETIFHHNNTCINKHGTLAGSNLTMIRSIQNIVEYAHIPLDEALRMATLYPAQAIGAHHYLGSLEINKVANLTAFNSQFQVKKTIVNGIIYTI

SEQ ID NO: 101907 - DNA, 1206 bp, Prochlorococcus marinus str. MIT 9313
  CDS (1)..(1206): transl_table=11
atgacgacaatgccatggtcccgcactagcaccgcctggccacctcccatgcatcggatcacccacatccgcctgcccgaacctctcaacaaagccgtggacaccaagctgtggtggatggccgtagatgagcacgagcgggtgctcagtgttcaacccatggcagatggctctgccatggacggggagagctggcagggcgactggctcagccccatgggcatcgatctacaaatcaatggagggctgggattggccttccccgagctcaccgccaaagacattccccagctcctgaagctgctcgacagactctggcaagacggtgtacaggcaatctgccccacggttgtgagctgcggcgtagcagccctgcgtcaatctttaacggtgctgcatgcagcccgagaacaacactgcccgcaacgctgtgaactactaggggcccaccttgaaggcccttttctggcaacagcacgccacggcgcccatcccctggagcatctctgtgctccgagcctaagggcactggatgaacgcattcgcggctttgagcaagacatcagtttgatgaccctggctccagaactgcccggatcatctgaagtgattgaacgactaaggaccctaggcatcgtgatatgcctagggcactcgaacgcagatggggaagcctctgccgatgccttctcccagggagtgggaatgctgacccactccttcaatgccatgcccggtcttcatcatcgtgcagctggcccggtgggggaagcctgcatgcatggagaaatcgctatgggactaatcgccgatggagttcatgttgaccccaccatggcggtgctattgcaaagactggcaccacaacagctgatacttgtgagcgatagtctcgctccctacggcctcaaagatggcaaatatcgctgggatgaaagagttctgctggtcgaaaaaggaacctgtcgtttggaagatggcactctggcaggagtcacattgccgctcctggaagggagtcgacgtttagccacttggagtggtgaacctgccgcggccatctgggctgccaccatggcccctcgtcaggtgatgggcaatggccgcacactggatgagctacttgtgaatcagcccttaacagacttactccgctggcagtggaaaccggatactgaagagctgatctggaagcatgctgcttaa

SEQ ID NO: 101908 - protein, 401 aa, Prochlorococcus marinus str. MIT 9313
MTTMPWSRTSTAWPPPMHRITHIRLPEPLNKAVDTKLWWMAVDEHERVLSVQPMADGSAMDGESWQGDWLSPMGIDLQINGGLGLAFPELTAKDIPQLLKLLDRLWQDGVQAICPTVVSCGVAALRQSLTVLHAAREQHCPQRCELLGAHLEGPFLATARHGAHPLEHLCAPSLRALDERIRGFEQDISLMTLAPELPGSSEVIERLRTLGIVICLGHSNADGEASADAFSQGVGMLTHSFNAMPGLHHRAAGPVGEACMHGEIAMGLIADGVHVDPTMAVLLQRLAPQQLILVSDSLAPYGLKDGKYRWDERVLLVEKGTCRLEDGTLAGVTLPLLEGSRRLATWSGEPAAAIWAATMAPRQVMGNGRTLDELLVNQPLTDLLRWQWKPDTEELIWKHAA

SEQ ID NO: 101909 - DNA, 1149 bp, Synechococcus sp. WH 8102
  CDS (1)..(1149): transl_table=11
atgcgacggatcaccgatgtgcgcctgcccgcacccctcggcagcgagacggagcgaccccattggatcggcctcaacgacgagggccgaatcgtcgaaatccagccccagattgacgatgaaacctgccctggctcgagttggcacggagattggctgagcccccgcggcatggacctgcagatcaacggtgggctcggcctggccttcccggaactgagcgcgacggatctgccgcggctgatcgggctgctggagctgctctgggccgatggagtcgaggccatcgctccaaccctggtgacctgcggcatcgccccacttcgccaggccctggcggtgttgcaccaggcgcgactgcagcaccaaccgggccgctgccgattgctgggagcccatctggagggcccctttctggcggaggcccgccgcggggcccatccgatcgagcatctggcagcgcccagcctggaggccctggaccaccgcatcaggggatttgaatccgacatcgccctggtgaccctggcgccggaacttgcgggggccaacactgtgatcagcgcgctgcgtcaacgcaacatcaccgtggccctgggccacagtgccgccaaagcagaacaggcggggcaggcttttgagcagggcgtggggatgctcacccatgccttcaatgccatgccaggcctgcaccaccgggctccgggacctgtgggggaagcctgccgccgcggcgacatcgccctgggcctgatcgccgacggggtgcacgtcgatccgacgatggcggtgctgctgcaacggctggcgccggaacagctggtgctggtgagcgatgccctggccccctacggcctggcggatggcgagcatcgctgggacgaaagggtgctgttggtgcagaacggcacctgccggctggaggacggcaccctggctggcgtgaccctgccgcagctggagggggtgaaacggctggcgacctggagcggcgcagcaggcgcagcaatctggggagccacggtcgcaccacgacgggtgatcggcaccgctgggaccttgaacgacgcgctggtgggccagcggctgaccaacctgctgcgctggagccaacgcgagggggagctccactgggcctgcgctgcttaa

SEQ ID NO: 101910 - protein, 382 aa, Synechococcus sp. WH 8102
MRRITDVRLPAPLGSETERPHWIGLNDEGRIVEIQPQIDDETCPGSSWHGDWLSPRGMDLQINGGLGLAFPELSATDLPRLIGLLELLWADGVEAIAPTLVTCGIAPLRQALAVLHQARLQHQPGRCRLLGAHLEGPFLAEARRGAHPIEHLAAPSLEALDHRIRGFESDIALVTLAPELAGANTVISALRQRNITVALGHSAAKAEQAGQAFEQGVGMLTHAFNAMPGLHHRAPGPVGEACRRGDIALGLIADGVHVDPTMAVLLQRLAPEQLVLVSDALAPYGLADGEHRWDERVLLVQNGTCRLEDGTLAGVTLPQLEGVKRLATWSGAAGAAIWGATVAPRRVIGTAGTLNDALVGQRLTNLLRWSQREGELHWACAA

SEQ ID NO: 101911 - DNA, 1122 bp, Chromobacterium violaceum ATCC 12472
  CDS (1)..(1122): transl_table=11
atgactgaaacgcagaccttgcagggccgcatcctgaccgcttccggctggatggacggcgcagtgcgcctggcggccgacggccgcatcgccgcgatagacgcccggctggcgtcgggccgccagcccgagcgctacatcctgcccggcttcatcgatctgcacgtgcacggcggcggcggcgtggacatcatggagggcggcgccgccgtcaaccatgtggcccggctgcacgcccgcttcggcaccacctccctgctggccaccacgatgaccgcgccgccggaggagatttcccgcgtgctggccgacatcggccgctgcagccgggagcgggcgccgggcggcagccgcgtgctgggcgtgcacctggaaggtccgtacatcaatcccggcaaactgggcgcccagcccgacgacgcctgtcaggcggcgatggcgcagatagacggctaccgcgcgctggcgccgatctcgctgatcacgctggcgccggaaatcccggggcacctcgacatcatccgcacgctgagcgcccagggcgtcaggatgcagatgggccacaccctcggcagctacgagcaggcggtggccgcgctggagcagggcgcgtccggcttcacccatctcttcaacgccatgaccggcctgcatcaccgcgagccgggcatggtgggcgcggcgctggcgcatgccgagtacgccgagctgattcccgatttgctccacgtccatcccggcgccatccgcaccgcgttgcgcgcgatcccgcgcctctattgcgtcaccgactccaccgccgccgccggcatgcccgacggacagtacaagctgggttcgcacgcggtcaccaagtgcatgggcggggtgcgcctggccgacggcacgctggccggcagcacgctgaccatggatcaggcgctgcgcaacctggtgtccatcggcctgccgctggccgacgcctccaaccgcctgtcgctgtacccggccgattatctggggctggccgaccgcggccggctagaggccggggcctgggccgacatcgcggtgctggatgccgaactgaatctgcagcaagtctatgttgagggagaagaaattggcctcgttgatgcttga

SEQ ID NO: 101912 - protein, 373 aa, Chromobacterium violaceum ATCC 12472
MTETQTLQGRILTASGWMDGAVRLAADGRIAAIDARLASGRQPERYILPGFIDLHVHGGGGVDIMEGGAAVNHVARLHARFGTTSLLATTMTAPPEEISRVLADIGRCSRERAPGGSRVLGVHLEGPYINPGKLGAQPDDACQAAMAQIDGYRALAPISLITLAPEIPGHLDIIRTLSAQGVRMQMGHTLGSYEQAVAALEQGASGFTHLFNAMTGLHHREPGMVGAALAHAEYAELIPDLLHVHPGAIRTALRAIPRLYCVTDSTAAAGMPDGQYKLGSHAVTKCMGGVRLADGTLAGSTLTMDQALRNLVSIGLPLADASNRLSLYPADYLGLADRGRLEAGAWADIAVLDAELNLQQVYVEGEEIGLVDA

SEQ ID NO: 101913 - DNA, 1194 bp, Gloeobacter violaceus PCC 7421
  CDS (1)..(1194): transl_table=11
atggcgggcggaaaagtgagaatgacgcgcttgcgcattggttacactctactcagcgaggggctcgacaggatgcggcagatacgcaacgcccgctgggcgggagacgggaatctctacagtctactggtggccgagggacaactgcaggcggtggacccatcgggcgactgctgggaagggagcgccgactcgatcgatctggcgggagcctgggtgagcccggggctggtggatctgcagctcaacggcgctctgggggtcgaattttcggaactggaaggcgacgagggcctggagcaactggggcgcatctcgacctatctctggtcgattggcctctcggcctggttgcccaccttgatcagcgtcccggtcgaaaagctgcagggagccctcgcggtgattggccgctttcggccccccaaaagcggcgcgcgcatcctgggggtgcacctcgaaggaccgtttctcaaccccgagtacgaaggcgcccacatgcgccggtacctgctgccgctcaccgtcgaagacgccaagtgcgtcctgggggattacgcctccctggtgaagctcgtcaccctcgcccccgaactcgacccggacggccagacgatcccctggctggtcgcccagggcatccacgtgagcctcggccacaccgccgccaccttcgagcaggcgcagcgggccttcgacgcgggggcgcggctggtgacccatatttttaatgcccagcgccccttccaccaccgcgagcccggcgtggtgggggcggctttgctggatgagcgggtgcaatgcctgtgcattcccgacggcatccacctgcacccggctgccacccaattgctgctgcgcgccaagggcgaagcgggcctcatcccggtgagcgatgcggtggcacccttgggaatcgccgacggtcgctacgactggcatggcctcgccattaccgtgcgcgccgggcaggtgaccctcgaagacggtcggctcgccggtagcgccctcagcctcaccgatgtactggcgcggctggtgggccagtgcggggtcgatccgggcgtggccctgcgcctgggggcgctccagccgcggcgggtcctgggcgaaccggtcgattggccgccggatgccgatttgctggtgtggcccccgggcaaagaccggcccgagcgcttggaggtacgatga

SEQ ID NO: 101914 - protein, 397 aa, Gloeobacter violaceus PCC 7421
MAGGKVRMTRLRIGYTLLSEGLDRMRQIRNARWAGDGNLYSLLVAEGQLQAVDPSGDCWEGSADSIDLAGAWVSPGLVDLQLNGALGVEFSELEGDEGLEQLGRISTYLWSIGLSAWLPTLISVPVEKLQGALAVIGRFRPPKSGARILGVHLEGPFLNPEYEGAHMRRYLLPLTVEDAKCVLGDYASLVKLVTLAPELDPDGQTIPWLVAQGIHVSLGHTAATFEQAQRAFDAGARLVTHIFNAQRPFHHREPGVVGAALLDERVQCLCIPDGIHLHPAATQLLLRAKGEAGLIPVSDAVAPLGIADGRYDWHGLAITVRAGQVTLEDGRLAGSALSLTDVLARLVGQCGVDPGVALRLGALQPRRVLGEPVDWPPDADLLVWPPGKDRPERLEVR

SEQ ID NO: 101915 - DNA, 1161 bp, Photorhabdus luminescens subsp. laumondii TTO1
  CDS (1)..(1161): transl_table=11
atgtatgctttaaccaactgcattatatataccggtcacaatagactagatgagcatgccgttatcattgcagacggcttaattaaacgaatttgcctaacacaagagttacccgaacatattgaaaaacgtgatctaaatggtgcaattctttgccccggctttattgatctgcaagtgaatggttgtggtggtgttcagttcaacgatcagttggaaaacatttcagaaaaaacgctggatatcatgcaaagaaccaatgaacgctctggctgcaccagctatttgccgactctgattaccagcacagacgaattgatgatggcctctgttgaggtaatgcgcacttatcttaaacataatcagcatcaggctttaggcttgcatctggaaggaccttatctcaacccagcaaagagaggcactcataatcccgagcttatccgtaagcccacatctgaaatgataaatttcctgtgcaataacgctgatgtcatcactaagttgaccctcgcaccggaaatggttgagcaaaagtatattcagcagttggtagaagccggtattattgtttctgccggtcattcaaatgccagttatgaagaggcccgacaaggattccaaaacggaattactatctcaacccacctttataatgccatgccagctatttcgggacgccaacccggcttgattggcgctatctttgatacacctgaaatctatgctggcatcatcgctgatggtttacacgtttcatggccaaatattcgtaatactaagcgtttgaaaaatgataaattaattctggtaacggatgcgaccatcccagcaggacttgatcccgccatcagtaaaatggcacatttcacctttgcgggtaagaccatatactatcgcaacggattatgtgttgatcaaaacggcgttttaagtggctcctctctcactatgatagatgccgttaaaaatagcgttgaacatgttggtattgcattggatgaagcactgaggatggcaactctttaccctgcccgcgcaattggtgttgataaatatcttggcactgttgaaaccgggaaaatcgctaacctctgtgttttcaatcacgaccttaaaatctgcacgaccatcgttaacggaaaagaaactgaactttga

SEQ ID NO: 101916 - protein, 386 aa, Photorhabdus luminescens subsp. laumondii TTO1
MYALTNCIIYTGHNRLDEHAVIIADGLIKRICLTQELPEHIEKRDLNGAILCPGFIDLQVNGCGGVQFNDQLENISEKTLDIMQRTNERSGCTSYLPTLITSTDELMMASVEVMRTYLKHNQHQALGLHLEGPYLNPAKRGTHNPELIRKPTSEMINFLCNNADVITKLTLAPEMVEQKYIQQLVEAGIIVSAGHSNASYEEARQGFQNGITISTHLYNAMPAISGRQPGLIGAIFDTPEIYAGIIADGLHVSWPNIRNTKRLKNDKLILVTDATIPAGLDPAISKMAHFTFAGKTIYYRNGLCVDQNGVLSGSSLTMIDAVKNSVEHVGIALDEALRMATLYPARAIGVDKYLGTVETGKIANLCVFNHDLKICTTIVNGKETEL

SEQ ID NO: 101917 - DNA, 1137 bp, Vibrio vulnificus YJ016
  CDS (1)..(1137): transl_table=11
atgaccatacatgctattgcagccaaacgaatatttgatggcgtccgttttcatcacaacgccgctctggtttggcagggacaacatattatgggtttggtgcctcgccatcaattgagcctagacgtcatcacttacgattaccctgatgccactctcacaccaggttttattgatcttcaagtcaacggcggtggcggcgtgatgtttaatacccaaacggacatcgttgccatggaacaaatttgtcatggtcaccgtaagcatggcactgcacatttactgccgacgttaatcagcgatacgcccgcacaactcaaacgtgcactaaaagcggcggaggcggcgctcaacgacaagataccaggcgtgcttggcgttcatcttgaggggccatggctaaactccgagaaaaaaggggctcacaataacgagctcttttacgcccccacaattgctgagcttgaaacctttccttggccagagaaagcgaaagtgctcatcacattggcaccagaacaaattgaagcgggggtccttcagtggctccatcaacaagatattgctctcttctgtggccatagtaacgcccggtatgagcaattaacctcaaaactgcagtaccttcacggctttactcacctttacaacgcgatgtccccttttgaaggtcgtgaaccgggtgtcgttggtacggcactcatggccgataatcaatggtgctctattattgccgatggcatacatgttcatccacaaagtgtgttgcttgctcaacgcattaaaccgcatggaaaattgctgcttgttaccgatgctatggcgaccgtgggtagtgagaagaacttcttcgaactgaatggcgaaaccattcaagtggtagataatgcactcgtcaacggcaatggtaatttggctggtgctcacatcggcatggatcagtcggtcatcaatctgattgagtggggtgtcgctgaggaagaggcgctgcgcatggcatcaacctatccagcagaggccatcggcttaaccgacttgggatatcttcgtccatattaccgtgccagcgtcacgattttacgtgatgactacagcacgcaagccgtattggttgatggcacgctctttgagcaataa

SEQ ID NO: 101918 - protein, 378 aa, Vibrio vulnificus YJ016
MTIHAIAAKRIFDGVRFHHNAALVWQGQHIMGLVPRHQLSLDVITYDYPDATLTPGFIDLQVNGGGGVMFNTQTDIVAMEQICHGHRKHGTAHLLPTLISDTPAQLKRALKAAEAALNDKIPGVLGVHLEGPWLNSEKKGAHNNELFYAPTIAELETFPWPEKAKVLITLAPEQIEAGVLQWLHQQDIALFCGHSNARYEQLTSKLQYLHGFTHLYNAMSPFEGREPGVVGTALMADNQWCSIIADGIHVHPQSVLLAQRIKPHGKLLLVTDAMATVGSEKNFFELNGETIQVVDNALVNGNGNLAGAHIGMDQSVINLIEWGVAEEEALRMASTYPAEAIGLTDLGYLRPYYRASVTILRDDYSTQAVLVDGTLFEQ

SEQ ID NO: 101919 - DNA, 1194 bp, Vibrio vulnificus YJ016
  CDS (1)..(1194): transl_table=11
atggcatctgaacaacaacactatcgcgctcagagaattttacacggtgatcactggttgcaagacgccgtgctcagtgtggattcgcaaggcaacatcagcgcgatagcggcatatgacccgcaacaacatcgcacagtgaccgacttgggcgctgtgagcctaatgcccggcttgatcgacagtcatgtccatggcagccaagggtgcgatgtgatggacgcaacacatgccagtttaaataccatgtcgcgatacttcgccagcttaggcgtcaccgcttttgtggccacgacggtcactgcgccagtggccaagattcgcgcggcactagcgcaagtggcgaaaagcaagcagcaaggcgttgagggggccgagatcctcggtgcgtatttagaagggccttatttcaccgagaagaacaaaggcgcacacccaacgcaatggttccgcgagttggcggtggaagaactggataactggatttcctacagtgacaaccaactgttgaaagtggcactcgcaccggaaaaagagggggctctggcggcgattcgctacttagccaaccaaggcattagcgtcatgctgggccacaccgacgccagttatcaacaggtcaaactcgcgcttgatgcgggcgcaaagggcatcgtccattgttacaacggcatgcgaggcctacaccatcgcaaccccggagtggtcggggcggggctacttcaccctgaatgctatgtcgagatgatcgccgatggccatcatgttcatcccgcggcgattgaagtggcgcaccgctgctgtggctcacgcatgaccttaattaccgatgccatgtgcgccacaggcatgcccgatggccaatacaccttgggggaatatcaggttgagatgaaacaaggtgtggtcacgactcaagaaggggggctcgcgggcagcacattaaccctgattgaaggggtaaaaaatattcaacgctggctcaatttgccgtttgagcaagcgtggttgatggcgtcacacacgcccgccaaatcgttaggcattcaacatcaactaggcacattagaagtcggcaaacgcgcttcaatggtggctttaggttccgatttctcaattgataaaacgtgggtgaatggtcgtctggtgtttgacgccgtggtttcccctcgtcaggaggctttatgtatctga

SEQ ID NO: 101920 - protein, 397 aa, Vibrio vulnificus YJ016
MASEQQHYRAQRILHGDHWLQDAVLSVDSQGNISAIAAYDPQQHRTVTDLGAVSLMPGLIDSHVHGSQGCDVMDATHASLNTMSRYFASLGVTAFVATTVTAPVAKIRAALAQVAKSKQQGVEGAEILGAYLEGPYFTEKNKGAHPTQWFRELAVEELDNWISYSDNQLLKVALAPEKEGALAAIRYLANQGISVMLGHTDASYQQVKLALDAGAKGIVHCYNGMRGLHHRNPGVVGAGLLHPECYVEMIADGHHVHPAAIEVAHRCCGSRMTLITDAMCATGMPDGQYTLGEYQVEMKQGVVTTQEGGLAGSTLTLIEGVKNIQRWLNLPFEQAWLMASHTPAKSLGIQHQLGTLEVGKRASMVALGSDFSIDKTWVNGRLVFDAVVSPRQEALCI

SEQ ID NO: 101921 - DNA, 1059 bp, Mycobacterium avium subsp. paratuberculosis K-10
  CDS (1)..(1059): transl_table=11
gtgggactgatcgccgcggggacgatggtggcatccgggcgggtccgccgcccgggctgggtcgagacgtccggcgggcatatcgcggcgtgcggcaccggcccgccgccgcgcccggccgaccgcgagttccccgatggcacgctggtgcccggcttcgtcgacatgcacgtgcacggcggcggcggcgcctcctacaccgagcccgacggcatcgcgaaggccgccgccttccatctgcgtcacggcaccaccaccacgatggccagcctggtgaccggctcgccggccgagctgctgggcggggtgcgcgcgctcgccgaggccacccgggatcgcacggtcgcgggcatccacctggagggcccgtggttgagccgcgcccgctgcggcgcccacgacgcccgccggatgcgcgaccccgacccgcacgagatcgacgcggtgctcgacgccggcggcggcgcgatcaggatggtcaccctggcgcccgagctgcccggggccgacgcggcgatccggcgtttcgcggacgcgggagtcgttgtggcagttgggcatacgaatgccgactaccggcagacccggcacgccatcgcgctgggcgccactgtcggcacgcatctgttcaacgcgatgccgccgctgcatcaccgcgagcccggccccgcgctggccctgctgcgcgacccgcgggtcaccgtcgagctgatcgccgacggcgtgcacgtgcatcccgacgtggtgcacgcggtgatcgacgcggccgggccggagcgggtcgcgctggtcaccgatgcgctcgcggccgccggccgccccgacggcgcgttccggctgggcccggtgcacatcgacgtcgtcgccggcggtcgcgcgggtgcacgggacgacgacgatcgcgggcagcaccgccaccatggaccggctctttcgcaccgtggccgggtcaggcgccgaccgcgacgccgcgctcgaggccgcggtgcagatgacgtccacgacgccggcgcgcgcgctggggctcgatcgggtgggcagcctgcaggccggccctga

SEQ ID NO: 101922 - protein, 352 aa, Mycobacterium avium subsp. paratuberculosis K-10
MGLIAAGTMVASGRVRRPGWVETSGGHIAACGTGPPPRPADREFPDGTLVPGFVDMHVHGGGGASYTEPDGIAKAAAFHLRHGTTTTMASLVTGSPAELLGGVRALAEATRDRTVAGIHLEGPWLSRARCGAHDARRMRDPDPHEIDAVLDAGGGAIRMVTLAPELPGADAAIRRFADAGVVVAVGHTNADYRQTRHAIALGATVGTHLFNAMPPLHHREPGPALALLRDPRVTVELIADGVHVHPDVVHAVIDAAGPERVALVTDALAAAGRPDGAFRLGPVHIDVVAGGRAGARDDDDRGQHRHHGPALSHRGRVRRRPRRRARGRGADDVHDAGARAGARSGGQPAGRP

SEQ ID NO: 101923 - DNA, 1158 bp, Lactobacillus johnsonii NCC 533
  CDS (1)..(1158): transl_table=11
atgtcatattacatccatgcgggaaaattctttttagaaaatagaactgaaaagggaggttatcttgaggttcaagatgatggtaactttggtctatattatcgagaagatgaaaagccgagtcatggcttaattaaagaatatggcgatcaatggattgcccctggttatgtagatacacatattcatggtttgcttgatgaagatacgatgaagagtgactgggaaggcattgacaagatctcaaatggcttattacaagcaggtgtaactagctggttaccaacaactattactgctagtgacaaagaattaacagaaacttgtgaaaagtttgctgcacataagggtgaagaaactggtgctaaaattcaaggtttgcattttgaaggacctttctttactccaaagcatggtggagcagaaaatccaaagtacatgactgatccatcaattatgcttttgaaaaaatggcgtaaagcttcagatgacatgctaattaagatttcaatggcacctgaaagaaaaaatgctcgtcagtttgtacgtgagacagtaaaaatgggcttggtcgttgccttaggtcactcagattctaattttgaagacgctattgggtgtgttgaagctggtgctagcgtatttactcatacattcaacggaatgaatagtttatcacaacactcacctaatattattggtgctgctttttcttcacgtttaacaacagatgaattaatctgcgatggtcaccatgttgaagaaccagctgttcgtgctttggtaaatgcacgtggaccagaacatattgccttgattacagattgtatgcaagcaggtttaatgccagatggggactatgttttaggtgaattgccagtttatgttaaggatggaatggcacgtctaaaagaaactaataatttggcaggtagtattttgctcttaaaggatgcagttaagaatgtagttgattggaatgttgcaacacctgaagatgcagttatgatggcgagttatgtgccagctaagagttgtaatttacttgataagtgtggagtgattaagccagatcacccagctgattttgttgtattaaaccatgatatgactgtaagtgaaacttatttaaatggtgaatcacgttacaaagcttaa

SEQ ID NO: 101924 - protein, 385 aa, Lactobacillus johnsonii NCC 533
MSYYIHAGKFFLENRTEKGGYLEVQDDGNFGLYYREDEKPSHGLIKEYGDQWIAPGYVDTHIHGLLDEDTMKSDWEGIDKISNGLLQAGVTSWLPTTITASDKELTETCEKFAAHKGEETGAKIQGLHFEGPFFTPKHGGAENPKYMTDPSIMLLKKWRKASDDMLIKISMAPERKNARQFVRETVKMGLVVALGHSDSNFEDAIGCVEAGASVFTHTFNGMNSLSQHSPNIIGAAFSSRLTTDELICDGHHVEEPAVRALVNARGPEHIALITDCMQAGLMPDGDYVLGELPVYVKDGMARLKETNNLAGSILLLKDAVKNVVDWNVATPEDAVMMASYVPAKSCNLLDKCGVIKPDHPADFVVLNHDMTVSETYLNGESRYKA

SEQ ID NO: 101925 - DNA, 1158 bp, Mycoplasma mycoides subsp. mycoides SC str. PG1
  CDS (1)..(1158): transl_table=4
atgatattaaaaaatgccaaaattgttttagaaaataaaattattaataatggttatttgattattaaagataaaaaaatacttgaaattggatctgattataaaaaaaagaatggaattgatttaaataatcagtgattattaccaggatttattgattgtcatgttcatggtggatatggagttgattttgaaactggaaataaaaatagatttaaatattttgcagataacataataaaagaaggagttactagatacattcaaacaagtgtaactaatagtgttaaaaaaaacaaccaaatttataaagaatttggagagtttataaaattaaataatggtaaagctaagtgtttaggagctcatttagaaggaccttttatttctaaatttaacaaaggtgctcatcaagaaaacttgttattaaatccagatattaatttaactaaaaaatgaaataaattatctaataatagtttaaaaatagttacttatgctagtgaattagatgatggaacttatactcaatttttaattaataatcaaattattccaagtattggtcattctaatttaaaagcaaatcaatttgaacaaccttatttattaggtgttagacatattactcatttatttaatggaatgagtggagttgatcaacataatcctggtttagttgttgctagttttaatcataaagatgttttatgtgaaattataagtgatggaatccatttagataaagaaattttaaaaatgatttacaattttaaaacagcagataatttatgtattatcactgattctatgaatgctaaaggtttagatgatggtgaatataaattaggtaatttagaagtttataaaaaaggtatagaaattagattaaaaaataataatgctttagctggagctggttcaacttatgatcataatgttagagttataaaacaagtttgtgatgttaaaatgaccgatttaattaaaatgacttctattaatatagcaaaacaattaaatatttttgacaatactggaagtatagaagtaaataagttagctgatttagtagttttagatgataatttatatgtaaataaagtactagttgaaggaaaaattgtttttaaaaatactaaaaataaaaaattataa

SEQ ID NO: 101926 - protein, 385 aa, Mycoplasma mycoides subsp. mycoides SC str. PG1
MILKNAKIVLENKIINNGYLIIKDKKILEIGSDYKKKNGIDLNNQWLLPGFIDCHVHGGYGVDFETGNKNRFKYFADNIIKEGVTRYIQTSVTNSVKKNNQIYKEFGEFIKLNNGKAKCLGAHLEGPFISKFNKGAHQENLLLNPDINLTKKWNKLSNNSLKIVTYASELDDGTYTQFLINNQIIPSIGHSNLKANQFEQPYLLGVRHITHLFNGMSGVDQHNPGLVVASFNHKDVLCEIISDGIHLDKEILKMIYNFKTADNLCIITDSMNAKGLDDGEYKLGNLEVYKKGIEIRLKNNNALAGAGSTYDHNVRVIKQVCDVKMTDLIKMTSINIAKQLNIFDNTGSIEVNKLADLVVLDDNLYVNKVLVEGKIVFKNTKNKKL

SEQ ID NO: 101927 - DNA, 1164 bp, Bacillus cereus ATCC 10987
  CDS (1)..(1164): transl_table=11
atgaactactatgtcaaagcatctatgtatctactagaagatggtgttcgtgagggtggatatttacatattgtaaatggctactttctaaaacatgttgaagaaatagtagacggagcgttagtaatggattttgaaggaagtattatttctccaggatttgtggatacacatattcacggtgtagcgggacatgatgtaatggatagcacatatgaatcgttaaacaatatttctattatgttattggaaaatggtgttacgagttttttacccacaacattaactgattcttcggaaaatataatgaaagctttaaaaaatatagctcatgcaaaaaaaagaggagtggaaggggccaatattattggagcttttcttgagggaccttgttttacggaggtctataaaggtgcacaaaactctaaatattttattgatccaaccattgaaatgttagaggagtggattgttgcatcagaagggacaattaaaaaaattgccatggcaccagagaggaaaggtgctattgcgtgtatacatcatgctgtgaaaaagaatattcatgtagcaattgggcatacgaatgcaaactatgagatatgccagaatgcgattcaagcaggagcgacgatttttgtgcatacgtttaatggaatgaaaggattacatcaccgtgaacctggcgttgttggagcggtactctcaactgagcatgtgtatggtgaaatcattgtagatggacatcatgtacatccaagcgtagtgaatattttatataaatgtaaaggatacgacaaaacttgtttagttagtgactgtatgcgagcgggcttattaggggatggcacatataatttaggagaatttgttgtccaagtgcaagacggcattgcccaaacagaggcgggttctttagcaggaagtacacttcgatttattgatggtgtgaagaatatagagaaatggacaaatgcatcgttatgggaatgtgttcatatgggatcgttaattcctgctaaaagtattggagttgataatgaaattggaagtatagcactagggaaaagagctgattttcttatattaacagaggatttagatcttataggaacagttgtagggggagaaatgaaatataaaaagaataaagagaggatttga

SEQ ID NO: 101928 - protein, 387 aa, Bacillus cereus ATCC 10987
MNYYVKASMYLLEDGVREGGYLHIVNGYFLKHVEEIVDGALVMDFEGSIISPGFVDTHIHGVAGHDVMDSTYESLNNISIMLLENGVTSFLPTTLTDSSENIMKALKNIAHAKKRGVEGANIIGAFLEGPCFTEVYKGAQNSKYFIDPTIEMLEEWIVASEGTIKKIAMAPERKGAIACIHHAVKKNIHVAIGHTNANYEICQNAIQAGATIFVHTFNGMKGLHHREPGVVGAVLSTEHVYGEIIVDGHHVHPSVVNILYKCKGYDKTCLVSDCMRAGLLGDGTYNLGEFVVQVQDGIAQTEAGSLAGSTLRFIDGVKNIEKWTNASLWECVHMGSLIPAKSIGVDNEIGSIALGKRADFLILTEDLDLIGTVVGGEMKYKKNKERI

SEQ ID NO: 101929 - DNA, 1143 bp, Bacillus cereus ATCC 10987
  CDS (1)..(1143): transl_table=11
atgaaaacgcaagttgtcatcaatgccaaaatttatacaggtcaagaagtagtggaaaacggatttattcgttacgcagaaacaattaaagaaattggtttgatggctcaatatgtatcacaagaaaatgaagcggttttagatgcggcaggaaaaattgtgattccaggtatgattgatgttcatattcatggtggatacgatattgatgcgatggatgcaaatagcgatgggttagtaactctaggtaaagaaatgttaaaagaaggagttacaacttacttcccaacaacaatgacacaagctccagaagcaatcgaagcagcactacatgctgcgaaggaagcgaaagaaaaaggagcacatttcgaatatattcacttagaaggaccgtatgtttcaaagaaacgtgcgggtgcacaaccacttgaacatattgttcctgcgaatattgaacaatttaaacaatggcaggaagcaagcggaaatttaattaaattagtaacatatgcacctgaagaagaaggtgcgttagagtttgagcagtatcttgctgaaactggtgttgttggcacaatgggacataccgatgcaattgatgcacaactaaaaaatagaaacattacacatgcaacgcatttatataatcaaatgcgtggattacatcaccgtgaaccaggagttgttggtcatgtgttattaaatccagatgtaatggttgaagtaattacagatggtattcacattcaccctgatatggtgaaattagcatataaattaaaaggaccgaaaaaagtaagtgttattactgacgcaatgcgtgcaaaaggtcttgaagatggattatatgagcttggcggacagccagtacatgtaaaagatggtagtgctcgattagaagatggaacgttagctggtagtattctaaaaatggatcaagctttccgaaatgtaattgaatttacaggttgttcaatcgaagaagcagtactaatgacatcagtgaaccaagcagaagagtttggattaaataataaaggtgcattagcggtaggaaaagatgcagactttgttgtgatgaatgaagatttacatgtatatgatacggttcgtttaggaattcatatgaaggaagggaagtaa

SEQ ID NO: 101930 - protein, 380 aa, Bacillus cereus ATCC 10987
MKTQVVINAKIYTGQEVVENGFIRYAETIKEIGLMAQYVSQENEAVLDAAGKIVIPGMIDVHIHGGYDIDAMDANSDGLVTLGKEMLKEGVTTYFPTTMTQAPEAIEAALHAAKEAKEKGAHFEYIHLEGPYVSKKRAGAQPLEHIVPANIEQFKQWQEASGNLIKLVTYAPEEEGALEFEQYLAETGVVGTMGHTDAIDAQLKNRNITHATHLYNQMRGLHHREPGVVGHVLLNPDVMVEVITDGIHIHPDMVKLAYKLKGPKKVSVITDAMRAKGLEDGLYELGGQPVHVKDGSARLEDGTLAGSILKMDQAFRNVIEFTGCSIEEAVLMTSVNQAEEFGLNNKGALAVGKDADFVVMNEDLHVYDTVRLGIHMKEGK

SEQ ID NO: 101931 - DNA, 1215 bp, Danio rerio
  CDS (1)..(1215)
atgccgtcgaataagagtgtgtcagatgccccgatcacgcagtttgtgaactgcaggatcctgaaaaaccacaaactgcaatgggaagacctgtgggttcgagagggcaagattttaaacccagagaagctgtttttcgatgaacagggttttgcggatcacagagtggactgcgagaataaaatcattgcacctggattcatagatgtgcaactgaatggtggatatggcattgacttctcacaggccagcagtgacatcagagggggtgtggctctggtggccaaaaagattctagaacacggtgtcacttccttctgccccaccctcgtcacgtctccaccacacatataccataaggttattcctgagctcagagttcaggatggaggacctgaaggtgcaggagttttaggtattcatctggagggcccgttcatcagtgaagagaagcgaggcgctcaccctccaaagttcttgcgaacctttcagtccggtggtgtggcagacctgatggagacctacggccagctggaaaatgtggcaatggtgactctggcacccgaactgaccaatagtgcagctgcaatccatgagctgtccagcaggggcataacagtgtcagtgggacactcgatggctgatctctctcaggctgaggaggctgtgcagaacggagccacgttcattacacacttatttaacgccatgttgccttttcatcacagagacccgggcatcgtgggattgctgacaagtgatcgtattcctccaggtcggacggtttactacggtatgatcgcagacgggattcacactcaccccgcagcgctgcgcatcgcacacagagctcatcccgcagggttggtgttggtcactgacgctgtaacagcgatgggtcttcctcctggtcgacacacactcggacagcagcagattgacatccaggggcttcacgcttacgtcgcaggcactactactttgagtggcagcatcgcgaccatggacatgtgtgtgagacacttcagagaggcatcaggctgtactgtagaagctgcattagaggccgcatctctgcatccggctcagctactgggcatcagccacaggaagggaacgctggagtttggtgcagatgcagattttatagtactcgacgacatgctgacagtcagggaaacctacattgctggacagcaggtctggaggaagtga

SEQ ID NO: 101932 - protein, 404 aa, Danio rerio
MPSNKSVSDAPITQFVNCRILKNHKLQWEDLWVREGKILNPEKLFFDEQGFADHRVDCENKIIAPGFIDVQLNGGYGIDFSQASSDIRGGVALVAKKILEHGVTSFCPTLVTSPPHIYHKVIPELRVQDGGPEGAGVLGIHLEGPFISEEKRGAHPPKFLRTFQSGGVADLMETYGQLENVAMVTLAPELTNSAAAIHELSSRGITVSVGHSMADLSQAEEAVQNGATFITHLFNAMLPFHHRDPGIVGLLTSDRIPPGRTVYYGMIADGIHTHPAALRIAHRAHPAGLVLVTDAVTAMGLPPGRHTLGQQQIDIQGLHAYVAGTTTLSGSIATMDMCVRHFREASGCTVEAALEAASLHPAQLLGISHRKGTLEFGADADFIVLDDMLTVRETYIAGQQVWRK

SEQ ID NO: 101933 - DNA, 1218 bp, Apis mellifera
  CDS (1)..(1218)
atgtctcaaaaagatcaacaaattttaaaacaattttataattgttgtattttacgtgatggaaaaattttaaacgaagatttgtgggttcgtgatgggaaaattgtaaatccagagaaaattttttatgatgaaaagataaaaccaaatataagaatcaattgtaacggagcgttaatttctcctgggtacattgatcttcagattaatggcggatttggcatagattttacacataatgtaaacaatgtacaagaaggaattaataaagtagccaaaaaattattagaatttggtgtaacatcattttgtccaactttggttacgtcacctagtgaaacttatcataaaataattccaaatattaagagaaccaaaggtggaaaacatggtgcaactgtattaggtattcatttagaaggaccatttattagtccaagtaaaaaaggagctcatttagagtgtcacataaaacaatttgaaaaaggttacaagtcattaactgatatgtatggaagtttagaaaatgtgagtcttattacattggcacctgaacttcccaatacccagtctgtgatcatagaattatgtaaaagaaatattaaagtttctcttggacattctatagcaaatttgaaagaaggagaagaggctgtaaaaaatggagcatcctttattactcatctttttaatgcaatgttaccatttcatcatagagatccaggattagttggtctcttaacatctgatcaaatctttcctggaagaattatccattatggtataattgcagatggtattcatactcatccagctgcattacgtatagctcacagaactcatcctgaaggattagttctagttactgatgcattgtcagcattaggtttagaagaaggagtacatcaattaggacagcttaaaatcgaaatacgttcgggacgtgcatatattgctggaacagatacactgtgtggaagtacagcggaaatgacaaaatgtgttcgtcatttcaaagaagtaacaggctgttcaatagtagaagctttagaagcagcaactcttcatccggcaaaaactctcggtattgaaaaaacgaaaggaactttgaattatggggcagatgctgatatagtaatgttagataatgatttagaattattgtcaacatggatatcaggagaatgtgtttatagtaaacataaatgctgccgataa

SEQ ID NO: 101934 - protein, 405 aa, Apis mellifera
MSQKDQQILKQFYNCCILRDGKILNEDLWVRDGKIVNPEKIFYDEKIKPNIRINCNGALISPGYIDLQINGGFGIDFTHNVNNVQEGINKVAKKLLEFGVTSFCPTLVTSPSETYHKIIPNIKRTKGGKHGATVLGIHLEGPFISPSKKGAHLECHIKQFEKGYKSLTDMYGSLENVSLITLAPELPNTQSVIIELCKRNIKVSLGHSIANLKEGEEAVKNGASFITHLFNAMLPFHHRDPGLVGLLTSDQIFPGRIIHYGIIADGIHTHPAALRIAHRTHPEGLVLVTDALSALGLEEGVHQLGQLKIEIRSGRAYIAGTDTLCGSTAEMTKCVRHFKEVTGCSIVEALEAATLHPAKTLGIEKTKGTLNYGADADIVMLDNDLELLSTWISGECVYSKHKCCR

SEQ ID NO: 101935 - DNA, 1068 bp, Thermus thermophilus HB27
  CDS (1)..(1068): transl_table=11
gtgaccctggaaggccggatcctctcccctcggggcttcgtgcggggaaggctccacttttccgagcgcatcctggccgtggaggaggcccccgtggagggcccctacatcctccccggcttcctggacctccacgtccacggggggctaggggcggacgccatggaggggaaggaggccgtgctcaggatggcccgcttccacctccaacacggcaccacgggcctcctcgccaccacggtcaccgcacctccggaggacctcaggcgggccctctcggggatcgccgaggccatggcggaatgcgaggccctcctcggggcccacctggaaggccccttcctcagccccaagcgcctcggcgcccagcccccatttccccagaagcccgaccccgccttgatggaggacctcctggccctcgcccccgtccgggtggtgaccctggcccccgagctccccggggccttggagctggtgcgcctcctggtaggccggggcgtccgggtgcagctcggccacaccgccgtaggctacgaggaggccctccacgccctggaggcgggggccgtgggcttcacccacctcttcaacgccatgacccccctccaccaccgcgcccccggggtggcgggcctcgccctggagcggggcctttgggcggagctcatccccgacggcctccacgtgcaccccgccgccttgcgcctcgccctgaagagcgtccccggcctctacttcgtcaccgacgccgtggccgcggcggggatgccggatggggtctaccccttgggggcccaccaggtggagaagcggggggagggggtgtggctcggggaaagcctggcggggagcaccctcaccatggaccaggccctccgcaagctggtggccttcgggctttccctggaggaggcggcgcggaggctttccacctaccccgcccgctacctgggcctaaaggaccggggggagatcgcccctggcaagcgggcggaccttttggtgctgggcgaggacctgcgggtggaggcggtgtacctggggggaaggcgggtggcccggtag

SEQ ID NO: 101936 - protein, 355 aa, Thermus thermophilus HB27
MTLEGRILSPRGFVRGRLHFSERILAVEEAPVEGPYILPGFLDLHVHGGLGADAMEGKEAVLRMARFHLQHGTTGLLATTVTAPPEDLRRALSGIAEAMAECEALLGAHLEGPFLSPKRLGAQPPFPQKPDPALMEDLLALAPVRVVTLAPELPGALELVRLLVGRGVRVQLGHTAVGYEEALHALEAGAVGFTHLFNAMTPLHHRAPGVAGLALERGLWAELIPDGLHVHPAALRLALKSVPGLYFVTDAVAAAGMPDGVYPLGAHQVEKRGEGVWLGESLAGSTLTMDQALRKLVAFGLSLEEAARRLSTYPARYLGLKDRGEIAPGKRADLLVLGEDLRVEAVYLGGRRVAR

SEQ ID NO: 101937 - DNA, 1134 bp, Listeria monocytogenes str. 4b F2365
  CDS (1)..(1134): transl_table=11
atgactaataaagtaattactaacgctacaatttatactggtaaaggtgttctagaaaatgctttcgtacgttttgacaaacaaattttagaggttggctcgatggctgatttccaagcggacaaagcagaagaagtaatcgatgccaaaggacaaaaacttgttccaggtttcattgatgttcattcccacggtggttatagttttgacgcaatggatgcagatccagaagcacttagaaaacaagtgaatggaatgttaaatgaaggaattactacttacttcccaacaacgatgacacaatcacatgaaaatattgaaaaagcattaaaagtgatcaatgaggttgctcaaacagaacctgttattggtggaattcatttggaaggtccatttgtttctaaagtctttaaaggcgcacaaccagaagaatatattcaagcacctgacttggaacttttcaaaaagtggtttgatatttctggtggtttaattaaattagtaacatatgcaccagaacatgatacttcagctgattttgaaaatttgtgttttgaactaggggttgttccgagtattggtcactctaatgatgttcgtgagcacttgaaaacaagtaaagcgacacacgcgacacatttatataatgcttgtcaccgtatgacgcaccgtgagccaggcgttccaggtcatgttttactagaacgcggtattaatgcagaactaatcgttgatggcattcacgttcatcctgatatggtgaaattagcttatcaaatgaaagggccagaacatttatgcattatcactgactccatgcgagcaaaaggtatgccagaagggaaatctgaacttggcggccaaactgttatcgtgaaagataaacaagctcgtttagaagatggaactttagctggaagtgtactcacttatgacgatggcttccgcaacatgattaaatttactggatgctcggtagaagaggcagttcttatgtcttctggaaaccaagcacgcgaatttaatttaacacaaaaaggtgcaatcgaggctggtaaggatgcagatttcaacttacttgacgaagatttacacattacagcaacttattcattcggaaaaaaacattcttga

SEQ ID NO: 101938 - protein, 377 aa, Listeria monocytogenes str. 4b F2365
MTNKVITNATIYTGKGVLENAFVRFDKQILEVGSMADFQADKAEEVIDAKGQKLVPGFIDVHSHGGYSFDAMDADPEALRKQVNGMLNEGITTYFPTTMTQSHENIEKALKVINEVAQTEPVIGGIHLEGPFVSKVFKGAQPEEYIQAPDLELFKKWFDISGGLIKLVTYAPEHDTSADFENLCFELGVVPSIGHSNDVREHLKTSKATHATHLYNACHRMTHREPGVPGHVLLERGINAELIVDGIHVHPDMVKLAYQMKGPEHLCIITDSMRAKGMPEGKSELGGQTVIVKDKQARLEDGTLAGSVLTYDDGFRNMIKFTGCSVEEAVLMSSGNQAREFNLTQKGAIEAGKDADFNLLDEDLHITATYSFGKKHS

SEQ ID NO: 101939 - DNA, 1134 bp, Listeria monocytogenes str. 4b F2365
  CDS (1)..(1134): transl_table=11
atggccgttatcaaaaatgtgaaaatttacaaagaaaatgaattaattgatgcagcagttattacagaaggaaatttgataaaagaagtttgctcaactactcctgaaaagtattcagatgagccaacttttgatggaaatggacagttgctaattcccggaatgatcgacgttcatattcatggggcaaataattatgatatgatggatggctcaacagaaagcatccaagctgtttcgatggcttgtgcggaaaccggatgtactagtttcttagtcacctcggttagttcttcttttgaagacttgatccaaatgattaagcaaactaaaaaagtcattggaaaagagaaaggtgccaaaattgcaggaattcatttagaaggcccctaccttaatatagaaaaaaaaggaatgcaaaatccagcctatttaagacaccccgatttaaaagaaatgaaaaagatcttcgatgaagcagatggtctgataaaaatggtcacaattgctccagaattgcctgggggtatcgaactcattgacttcttgaaaaaaagaggagttgtggtcgccattgcacattccaatgcaacttatgaagaggcgcaaaatgctttcgaacaaggagcaacccacatcacacattgcttcaatgctatgccagccattcatcaccgggcaccaggacttgttacagcagccttggaaaatgattcggtaagcgttcaaaccattgtagacggtgtccatctccatcccggaatcgtgcgccttattcacaaaattaaaggaccagataaaatggttctcacaaccgatgcccttcaagcaatgggagttggcgacggggagtatatttttggcggtcaccaagtaacggttaaggaaggcatagctcgcttaaaagacgggacattagcttcaagtaccgtgacgatgaataaatccttaaagttaagtaatgaatttgggattcacttacaagacgctattcaaatggcagcaagtacaccggcagacattttaggaatgaacaattttggtcgaatcgaaaaaggctatgtcgctgatttagttttacttgataaaaattttgaagttctaactacatggattgatggtgaaatatattaa

SEQ ID NO: 101940 - protein, 377 aa, Listeria monocytogenes str. 4b F2365
MAVIKNVKIYKENELIDAAVITEGNLIKEVCSTTPEKYSDEPTFDGNGQLLIPGMIDVHIHGANNYDMMDGSTESIQAVSMACAETGCTSFLVTSVSSSFEDLIQMIKQTKKVIGKEKGAKIAGIHLEGPYLNIEKKGMQNPAYLRHPDLKEMKKIFDEADGLIKMVTIAPELPGGIELIDFLKKRGVVVAIAHSNATYEEAQNAFEQGATHITHCFNAMPAIHHRAPGLVTAALENDSVSVQTIVDGVHLHPGIVRLIHKIKGPDKMVLTTDALQAMGVGDGEYIFGGHQVTVKEGIARLKDGTLASSTVTMNKSLKLSNEFGIHLQDAIQMAASTPADILGMNNFGRIEKGYVADLVLLDKNFEVLTTWIDGEIY

SEQ ID NO: 101941 - DNA, 1137 bp, Picrophilus torridus DSM 9790
  CDS (1)..(1137): transl_table=11
atgaattacagcctccttgcaggtattataccaacgcctgatggcatctataatgattattatataaatatatctggcagcatgataaaaagcataaccaggcatccggattatttattaaaggacaggcttaatgcatacattgcaatgcccggatttatagatatacatacacacggatactacggtatagacgccatggaatcaaatgcatctgatatacataaatgggcctcgatgcttgcaatgcatggcgtcacatcatttataccggcatgcgtctcgtctcctgtggatgatataattaaattcattaaaaagattgaatattcaatgtcatcacaggacgttaacgaggcaaggataatcggtgccagaagtgaggggccatatataaatgtaaaaaagaggggtgcacataaccctgattttataagaaaaatagataaaaatgaaattttaagtattttaaatgcgtcgaataatacattaaagatcattgatatcgccccggagctggataatttccaggaggcactatcaatgtttaatagttcaggaacaattgtttcaattggtcattcaaatgctgattttaatagggcatcaatggcaattaactcaggtgcaatgttaatgacgcatttttataatgccatgacggcttttaaccacagggcgcctggcatgatagacgccggctttttatcagatgtcttccttgaggtcattcctgatatgcaccatgtatcatgggaatctataaatataatgctgaaaatcaggggcccgaaaagaataatagcaataacggactcgctttcaataggcggtacagacaaatattcaggaacccttggcggccttggcatagatataaaggatggcgttgcatggatctctggaacagaaacaatagcaggcagcgtcttaaccatggaacgtgcatttaaaaatctttatgaacatggcattaacatagatgaactggcggaaatgctctccggaaatgcggccaggctcctcggcatggagaattatggaatgatatggcccggaatgattgcagatataaacattgtcaatgaaaatattgatattgtaaatacaataataaatggaaatccattaaaatga

SEQ ID NO: 101942 - protein, 378 aa, Picrophilus torridus DSM 9790
MNYSLLAGIIPTPDGIYNDYYINISGSMIKSITRHPDYLLKDRLNAYIAMPGFIDIHTHGYYGIDAMESNASDIHKWASMLAMHGVTSFIPACVSSPVDDIIKFIKKIEYSMSSQDVNEARIIGARSEGPYINVKKRGAHNPDFIRKIDKNEILSILNASNNTLKIIDIAPELDNFQEALSMFNSSGTIVSIGHSNADFNRASMAINSGAMLMTHFYNAMTAFNHRAPGMIDAGFLSDVFLEVIPDMHHVSWESINIMLKIRGPKRIIAITDSLSIGGTDKYSGTLGGLGIDIKDGVAWISGTETIAGSVLTMERAFKNLYEHGINIDELAEMLSGNAARLLGMENYGMIWPGMIADINIVNENIDIVNTIINGNPLK

SEQ ID NO: 101943 - DNA, 1143 bp, Bacillus anthracis str. Sterne
  CDS (1)..(1143): transl_table=11
atgaaaacgcaagttgtcatcaatgccaaaatttatacaggtcaagaagtagtagaaaacggatttattcgttacgcagaaacaattaaagaaattggtttgatggctcaatatgtatcacaagaaaatgaaactgttttagatgcagcagggaagattgtgattccaggtatgattgatgttcatattcatggtggatacgatattgatgcgatggatgcaaatagcgatgggttagtaactctagggaaagaaatgttaaaagaaggagttacaacttacttcccaacaacaatgacacaagctccagaagcaatcgaagcagcactacatgctgcgaaggaagcgaaagaaaaaggagcacatttcgaatatattcacttagaaggaccgtatgtttcaaaaaaacgtgcaggtgcacaaccacttgaacatattgttcctgctaatattgaacaatttaaacaatggcaggaagcaagcggaaatctaattaaattagtaacatacgcacctgaagaagaaggagcattagagtttgagcagtatcttgctgaaactggtgttgtcggcacaatggggcatacagatgcaattgatgcgcaattaaaaaacagaaacattacacatgcaacgcatttatacaatcaaatgcgtggattacatcaccgtgaaccaggagttgttggtcatgtgttattaaatccagatgtaatggttgaagtaattacagatggtattcacattcaccctgatatggtgaaattagcatataaattaaaaggaccgaaaaaagtaagtgttattactgacgcaatgcgtgcaaaaggtcttgaagatggattatatgagcttggcggacagccagtacatgtaaaagatggtagtgctcgattagaagatggaacgctagctggtagtattctaaaaatggatcaagctttccgaaatgtaattgaatttacaggttgttcaatcgaagatgcagtactgatgacatcagttaaccaagcagaagagtttggattaaataataaaggtgcattagcggtaggaaaagatgcagactttgttgtgatgaatgaagatttacatgtatatgatacggttcgtttaggaattcatatgaaggaagggaagtaa

SEQ ID NO: 101944 - protein, 380 aa, Bacillus anthracis str. Sterne
MKTQVVINAKIYTGQEVVENGFIRYAETIKEIGLMAQYVSQENETVLDAAGKIVIPGMIDVHIHGGYDIDAMDANSDGLVTLGKEMLKEGVTTYFPTTMTQAPEAIEAALHAAKEAKEKGAHFEYIHLEGPYVSKKRAGAQPLEHIVPANIEQFKQWQEASGNLIKLVTYAPEEEGALEFEQYLAETGVVGTMGHTDAIDAQLKNRNITHATHLYNQMRGLHHREPGVVGHVLLNPDVMVEVITDGIHIHPDMVKLAYKLKGPKKVSVITDAMRAKGLEDGLYELGGQPVHVKDGSARLEDGTLAGSILKMDQAFRNVIEFTGCSIEDAVLMTSVNQAEEFGLNNKGALAVGKDADFVVMNEDLHVYDTVRLGIHMKEGK

SEQ ID NO: 101945 - DNA, 1182 bp, Staphylococcus aureus subsp. aureus MRSA252
  CDS (1)..(1182): transl_table=11
gtgtcagaattaattatatataacggcaaagtttatactgaagatgacaaaatcgataatggttacattcatgtgaaagatggacagattgttgcaattggagaagtggatgataaagcagcgattgataatgatacgacaaataaaattcaagtgattgatgcaaaaggtcatcatgtattaccaggttttatcgatatacatattcatggtggttatggacaggatgcaatggatgggtcatacgatggcttaaaatatctatccgaaaatttgttgtctgaagggacgacatcgtacttggccactacaatgacgcaatcgactgataaaatagataaagcacttataaatattgctaaatatgaagtggagcaagatgttcacaatgcagcggaaattgtaggtatacatttggaagggccatttatatctgaaaataaagttggtgctcaacatccgcaatacgttgtacgcccatttatcgataaaattaaacattttcaagagactgctaacggactaataaagattatgacgtttgcacctgaagttgaaggtgcaaaagaagcgcttgaaacgtataaagatgacattattttttcaattggtcatacagtggcaacatacgaagaagcagttgaagctgctgagcgaggagctaaacatgtcacgcatttatataatgcagcgacgtcattccaacatagagaaccaggtgtttttggagcagcatggttgaatgatgctttacataccgaaatgattgttgatggcacacattctcatccggcatcggttgcaattgcttaccgtatgaaaggtaatgaacgtttttatttaattaccgatgcaatgcgtgcaaaaggtatgcctgaaggagaatatgatttgggtggtcaaaaagtaactgttcaatcgcaacaagcacgtcttacaaatggtgcacttgctggtagtattttaaaaatgaatcatgggttacgtaacttaatatcatttacaggtgatacattagatcatttatggcgtgtaacaagtttaaatcaagccattgcattaggtatcgatgatagaaaaggtagtattaaagtaaataaggatgcagatcttgttattctagatgatgacatgaatgtaaaatctacaataaaacaaggtaaggttcacacatttagctaa

SEQ ID NO: 101946 - protein, 393 aa, Staphylococcus aureus subsp. aureus MRSA252
MSELIIYNGKVYTEDDKIDNGYIHVKDGQIVAIGEVDDKAAIDNDTTNKIQVIDAKGHHVLPGFIDIHIHGGYGQDAMDGSYDGLKYLSENLLSEGTTSYLATTMTQSTDKIDKALINIAKYEVEQDVHNAAEIVGIHLEGPFISENKVGAQHPQYVVRPFIDKIKHFQETANGLIKIMTFAPEVEGAKEALETYKDDIIFSIGHTVATYEEAVEAAERGAKHVTHLYNAATSFQHREPGVFGAAWLNDALHTEMIVDGTHSHPASVAIAYRMKGNERFYLITDAMRAKGMPEGEYDLGGQKVTVQSQQARLTNGALAGSILKMNHGLRNLISFTGDTLDHLWRVTSLNQAIALGIDDRKGSIKVNKDADLVILDDDMNVKSTIKQGKVHTFS

SEQ ID NO: 101947 - DNA, 1182 bp, Staphylococcus aureus subsp. aureus MSSA476
  CDS (1)..(1182): transl_table=11
gtgtcagaattaattatatataacggcaaagtttatactgaagatggcaaaatcgataatggttacattcatgtgaaagatggacagattgttgcaattggagaaggggatgataaagcagcaattgataatgatacgacaaataaaattcaagtgattgatgctaaaggtcatcatgtattaccaggttttattgatatacatattcatggtggttatggtcaagatgcaatggatgggtcatacgatggcttaaaatatctatccgaaaatttgttatctgaagggacgacatcatacttggccactacaatgacgcaatctactgataaaatagataaagcacttacaaatattgctaaatatgaagcggagcaagatgttcacaatgcagcggaaattgtaggtatacatttagaaggaccatttatatctgaaaataaagttggtgctcaacatccgcaatacgttgtacgcccatttatcgataaaattaaacattttcaagagactgctaacagattaataaagattatgacgtttgcacctgaagttgaaggtgcaaaagaagcgcttgaaacgtataaagatgacattattttttcaattggtcatacagtggcaacatacgaagaagcagtcgaagctgttgagcgaggagctaaacatgtcacgcatttatataatgcagcgacgccattccagcatagagaaccaggtgtttttggagcagcatggttgaatgatgctctacataccgaaatgattgttgatggcacacattctcatccggcatcggttgctattgcttaccgtatgaaaggtaatgaacgtttttatttaattaccgatgcaatgcgtgcaaaaggtatgcctgaaggagaatatgatttgggtggacaaaaagtaactgttcaatcgcaacaagcacgtcttgcaaatggtgcgcttgctggtagtattttaaaaatgaatcatgggttacgtaacttaatatcatttacaggtgatacattagatcatttatggcgagtaacaagtttaaatcaagccattgcattaggtatcgatgatagaaaaggtagtattaaagtaaataaggatgcagatcttgttattctagatgatgatatgaatgtaaaatctacaataaaacaaggtaaggttcacacatttagctaa

SEQ ID NO: 101948 - protein, 393 aa, Staphylococcus aureus subsp. aureus MSSA476
MSELIIYNGKVYTEDGKIDNGYIHVKDGQIVAIGEGDDKAAIDNDTTNKIQVIDAKGHHVLPGFIDIHIHGGYGQDAMDGSYDGLKYLSENLLSEGTTSYLATTMTQSTDKIDKALTNIAKYEAEQDVHNAAEIVGIHLEGPFISENKVGAQHPQYVVRPFIDKIKHFQETANRLIKIMTFAPEVEGAKEALETYKDDIIFSIGHTVATYEEAVEAVERGAKHVTHLYNAATPFQHREPGVFGAAWLNDALHTEMIVDGTHSHPASVAIAYRMKGNERFYLITDAMRAKGMPEGEYDLGGQKVTVQSQQARLANGALAGSILKMNHGLRNLISFTGDTLDHLWRVTSLNQAIALGIDDRKGSIKVNKDADLVILDDDMNVKSTIKQGKVHTFS

SEQ ID NO: 101949 - DNA, 1149 bp, Erwinia carotovora subsp. atroseptica SCRI1043
  CDS (1)..(1149)
atgatgtacgcgttaacccatagccggattttcaccggccatcagattctggataatcacgccgtcgtgattgccaatgggctgatcgagcgaatctgctcggttgctgagctccctgccggcattgaacaacacgacctgagcggtgcgtttctcgctccaggatttatcgatctccaactgaacggctgcggcggtgtgcaatttaacgactcgctggacacgatctccgtcaaaacgctggagatcatgcagcaggcgaaccagcgttcaggctgtaccagttttttacccacgctgattacctccagcgatgagtttatgaaacacagcatcaacgtaatgagagactggctggcgcagaataagcatcaggcgcttggactacatctcgaaggcccgtggctaaacgtgataaaaaaaggcacacatgaccctgcctttatccgcaagccaacgcaagcgctcgtcgattttctgtgtgtcaacgcagatgccattacgaaaatcacgctggcaccggaagaagtcgaaccggcagttatccgccagttaacggcggcgggcattatcgtctccgccggacactctaacgcgacctgggaacaggctaagcagggtttttccgctggcattcgcttcgccactcacctgttcaacgcaatgccatatctgactggccgtgaacccgggctagtcggcgcaatttacgatgccccggaagtctattgcggcattatcgcggatggacgtcacgtagactgggccaatattcgcaacagcaagcgcattaagggcgataaactggtgctggtgaccgacgccacagcaccagcgggcgcagatattgaccagttcatttttgctggtaaaaccatatactaccgtgatggcatttgtgtcgatgaacacggcaccctaagcggctctgcactgacaatgatcgacgccgtgcgtaatagcgtcgaacacgctggaatcgcactggatgaagctattcggatggcaacgctctatccggctcgtgccatcggcgtcgataagcagttaggcagcattgaaagcggtaaagtggctaatctgaccgcatttgaccgtgattatcacattctcaagacgtttgttaacggtaatcctgtttggggataa

SEQ ID NO: 101950 - protein, 382 aa, Erwinia carotovora subsp. atroseptica SCRI1043
MMYALTHSRIFTGHQILDNHAVVIANGLIERICSVAELPAGIEQHDLSGAFLAPGFIDLQLNGCGGVQFNDSLDTISVKTLEIMQQANQRSGCTSFLPTLITSSDEFMKHSINVMRDWLAQNKHQALGLHLEGPWLNVIKKGTHDPAFIRKPTQALVDFLCVNADAITKITLAPEEVEPAVIRQLTAAGIIVSAGHSNATWEQAKQGFSAGIRFATHLFNAMPYLTGREPGLVGAIYDAPEVYCGIIADGRHVDWANIRNSKRIKGDKLVLVTDATAPAGADIDQFIFAGKTIYYRDGICVDEHGTLSGSALTMIDAVRNSVEHAGIALDEAIRMATLYPARAIGVDKQLGSIESGKVANLTAFDRDYHILKTFVNGNPVWG

SEQ ID NO: 101951 - DNA, 1131 bp, Propionibacterium acnes KPA171202
  CDS (1)..(1131): transl_table=11
atgatcacccgcattgcttctcaccacgtcgtcgatcgcgatggtagtgattcaccagcgacgatcaccgtcgaggctggacgcattagtgacgtcagcgagggtattgatcccaaggccgaactcgttgatgagtggattttgcccggatatgtcgacactcactgtcacggtggcgccggtgctgacttcaccgaccctgaccgcgaggccgctttgcgcgccgtccattaccaccgcagccaggggtcgacgactcttttcgcatcgacggtgaccgcagcgattgacgacgtcgtcgcgcagattgggcgactccgccagcttgtcgaccttgacgagatcgccggcatccatttagaggggccgttcttggctgaatcgcggaagggggcccacgccgtcgagctgctgtgtgacccagatccggtgtccgtgggtcgtctcatcgaagctggcggttcggctctcaagatggtgactattgcgccagaacgtgcgcacggcttggaagcggtgaccaccttcaccacagccggagtgcacgctgctatcggccatactgagtgtgacaccaccacggctagtgccgcagtcgacgcgggagcagacgtcatcacccatctgttcaacgcgatgccgtcgatccatcatcgaaagcccggtccggtgccgccaatgctcactgattcgcgagtggtctgcgaactcatttgcgacggcgtccacttggccccggacgtcattcggatggcgatgtcgagcgccggcccgaagcgcatcgccctggtgaccgatgccatgagcgcgaccggtcagcctgacggcgactacattctgggcagcctgccagtgaaagttgtggatggaagagcccgtttgttggccgctgacggttcgctgggagcgatagcaggatcgactctgacgatgggtcgagcggtcgaattcgtcacgtccgttgtgggtatcccgctgggacaggtcgccgtcatggcggccacaacaccggccaagctccatggtttgaacgaggttggcgtcatcgaagagggccactgggctgacttgtgtcttactgacgcgaagggtcatctggtgcgcgtcattcaccggggtgaggctgtctga

SEQ ID NO: 101952 - protein, 376 aa, Propionibacterium acnes KPA171202
MITRIASHHVVDRDGSDSPATITVEAGRISDVSEGIDPKAELVDEWILPGYVDTHCHGGAGADFTDPDREAALRAVHYHRSQGSTTLFASTVTAAIDDVVAQIGRLRQLVDLDEIAGIHLEGPFLAESRKGAHAVELLCDPDPVSVGRLIEAGGSALKMVTIAPERAHGLEAVTTFTTAGVHAAIGHTECDTTTASAAVDAGADVITHLFNAMPSIHHRKPGPVPPMLTDSRVVCELICDGVHLAPDVIRMAMSSAGPKRIALVTDAMSATGQPDGDYILGSLPVKVVDGRARLLAADGSLGAIAGSTLTMGRAVEFVTSVVGIPLGQVAVMAATTPAKLHGLNEVGVIEEGHWADLCLTDAKGHLVRVIHRGEAV

SEQ ID NO: 101953 - DNA, 1149 bp, Streptococcus pyogenes MGAS10394
  CDS (1)..(1149): transl_table=11
atgacatgctatcttaaagcagattgtttttattacccaacagaggtgaaaccggctggctacctaagtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatttactttgaaggtccttattttaccgaagaatataagggtgctcaaaacccaagttatatgaaaaacccacgcttggaggaatttgatgcttggcaaaaagccgctaaagggctcatcaaaaaaattgcccttgctcctgagcgtgatggtgtcaaagaatttgtgtccgcagtgacaaaacaaggcgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgaagcaaaaagggcatgatcatgtagctatgattacggactgtatgcgagcaggtggttcaccagatggtgattacctcttgggggaattctctgtggttgtggcaaatggcactgctcgtcttaaagagagtggaaacttggcaggatctattttgaaattaaaagacggccttagaaatgtagtggcctggggaatcgcaactccggcagaagccattcatatggcaacctatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcctaa

SEQ ID NO: 101954 - protein, 382 aa, Streptococcus pyogenes MGAS10394
MTCYLKADCFYYPTEVKPAGYLSLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKNPRLEEFDAWQKAAKGLIKKIALAPERDGVKEFVSAVTKQGVTVALGHSNGTYQEAKEAVQAGASVWVHAYNGMRGLTHREPGMVGAVYNLPNTYAELICDGHHVSPIACDILMKQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 101955 - DNA, 1170 bp, Leifsonia xyli subsp. xyli str. CTCB07
  CDS (1)..(1170): transl_table=11
gtggggatgtccactcacctcatccactcagcccgcctcgtcagcgagggccgcatcacgcacgccggctgggtccgcttcgcggacgacaaaatcgccgagatcggggccggtgacacctggcgtgccgcagtcgcgggcgacccggaggcgatcgtcaccgacgccgacggcagctggctgacacccggcttcgtcgacatccacagccacggaggcgagggcgcgagcttcgacgacggccccgacgcgatccgtgcggcgctcgtcctccacagccggcacgggacgacccgtgctgttatttcgctcgtgaccgctccggttccgcagctggcggagagcctccgcggtgtgcgggagctcgcggcgaacgacccgcgcgtcctgggctcgcacctggagggtccgttcctcgacgcagggcacaaaggcgcgcacgaccccggactcctccgctcggcgaccggcgacgacatcgcactgctgctcgacgccgccggcggcaccctgcggcagatcacgatcgcgccggagctccccggcgggatggcggccgtgcgcgccttcgcggaagccggcaccgctgtcgcggtcgggcacaccgccgccgactacgggcagaccctggcggcgttcgaggcgggcgcccgcatactgacccacgccttcaacgcgatggatggcctgcaccaccgtgcgcccggccccgtggcggcggcgacacgcaccccgggcgtgacgctcgaggtcatcaacgacggcacgcatgtacaccctgaggtcgtgcgggtgctgttcgcatcggctcccggccgcatcgccctgatcacagacgcgatggccgccgccgggtcagcggacggggactatctgctcggctcgctcgcggtcgaggtgcgcggcagcgtcgcccggctggccgagggcggctcgatcgcgggttcgacgctgacgctggacgacgctctgcgccgggccgtgatggaagtggggatcggtgtcgagcacgccgtgctcgccctcaccgagacgcccgccacggccatcggccgcggggacgagttcggccgcctcgcccccgggttcgccgcggacgcggtgctgctggacgacggtttccgggtggtgcaggtgtgggcggccggttcgccggtcgcgcggtcctga

SEQ ID NO: 101956 - protein, 389 aa, Leifsonia xyli subsp. xyli str. CTCB07
MGMSTHLIHSARLVSEGRITHAGWVRFADDKIAEIGAGDTWRAAVAGDPEAIVTDADGSWLTPGFVDIHSHGGEGASFDDGPDAIRAALVLHSRHGTTRAVISLVTAPVPQLAESLRGVRELAANDPRVLGSHLEGPFLDAGHKGAHDPGLLRSATGDDIALLLDAAGGTLRQITIAPELPGGMAAVRAFAEAGTAVAVGHTAADYGQTLAAFEAGARILTHAFNAMDGLHHRAPGPVAAATRTPGVTLEVINDGTHVHPEVVRVLFASAPGRIALITDAMAAAGSADGDYLLGSLAVEVRGSVARLAEGGSIAGSTLTLDDALRRAVMEVGIGVEHAVLALTETPATAIGRGDEFGRLAPGFAADAVLLDDGFRVVQVWAAGSPVARS

SEQ ID NO: 101957 - DNA, 1146 bp, Yersinia pseudotuberculosis IP 32953
  CDS (1)..(1146): transl_table=11
atgtacgctttaactcacggccgtatttataccagccatgaagtactggataatcatgctgttgtcgttgctgatggattgatcgaacgtatctgtcctgtcgatgaacttccggctggtattgagatatgcgatttgggtggtgccattctggcccccggttttatcgatgttcagctcaatggctgcggtggtgtgcagttcaatgactctctcgaggctatctcagcagagacgttggatatcatgcagcgagccaatgaaaaatcaggttgtaccagcttcctgcccacactgattacctgcagcgatgaatttatgaagcacggcgttgatgtcatgcgttcatatctgcaaaaaaaccagcatcaggcgctcggcttgcaccttgaaggcccttatatcagcccactgaagaaaggcacccacaatccggcctttatccgtaagcccagcgctgaaatgattgactatctgtgtgccaatgccgatgtgatcaccaaactcactctggcacctgaaatggttgatcctaaatatatacagcagctcacagaagcaggtattttggtttctgccgggcactcaaacgcaacctatcagcaagcccgtcaagggtttaccgccggtatccgatttgcgacccacctttataatgcaatgccgtacatttcggggcgtgaaccaggccttattggggccatttttgatacaccagaggtatacacaggcgtgattgccgatggcctgcatgttgactgggccaatattcgcaatgctaagcgcctaaaaggcgaaaaactggtgctggtaaccgatgccactgcgcctgccggtgctaaaattgaacaatttatttttgctggcaaaacaatatactatcgcgatggtttatgcgtagacgaaaatggcacattaagcggttcggcactaaccatgattgaagcggtgcaaaacagtgtcgaacatgtcggtatcgcgctggatgaagccctgcgtatggcaacactttatgcggcccgcgccattggcgtggataaacagttaggaagtattgaagtcggcaaagttgccaacctgactgcctttacccgcgattataaaatcactaaaaccatcgttaatggcaacgaggttttatcataa

SEQ ID NO: 101958 - protein, 381 aa, Yersinia pseudotuberculosis IP 32953
MYALTHGRIYTSHEVLDNHAVVVADGLIERICPVDELPAGIEICDLGGAILAPGFIDVQLNGCGGVQFNDSLEAISAETLDIMQRANEKSGCTSFLPTLITCSDEFMKHGVDVMRSYLQKNQHQALGLHLEGPYISPLKKGTHNPAFIRKPSAEMIDYLCANADVITKLTLAPEMVDPKYIQQLTEAGILVSAGHSNATYQQARQGFTAGIRFATHLYNAMPYISGREPGLIGAIFDTPEVYTGVIADGLHVDWANIRNAKRLKGEKLVLVTDATAPAGAKIEQFIFAGKTIYYRDGLCVDENGTLSGSALTMIEAVQNSVEHVGIALDEALRMATLYAARAIGVDKQLGSIEVGKVANLTAFTRDYKITKTIVNGNEVLS

SEQ ID NO: 101959 - DNA, 1167 bp, Yersinia pseudotuberculosis IP 32953
  CDS (1)..(1167): transl_table=11
atgcgtactgcctatctcgctgatcgcacttttactccgcaaggcattgaaaccggtgtcgcggttatcgtcgagcaaggcgagattgtggcagtaacacgcgagctgccagcggatgcagaaattgtgcatctgacagggaaaaccctgatcccaggtctgatcgacattcatattcatggtcgccagggggcggatgtcatggatgcctctgcggaggcattacgcaccattgcccgtgccctaccccaaaccggggttgttgcctgggtcggcaccaccgtcagtgcgccgatacaggatatctttgcggctctggcgcaggtgcgtgattttattgcagacccggataacgcacgtgatacccgcaccgcaaccctgctcggcagttttctggaggggccatatttcaccgcgcctttccggggttcacacccagaaaagtatctgacgacaccaacaccacaagagctggagcaattacggcattcggcgggtaacaccttgttgcgtgcagctatcgcacctgagtcacccgaggctttggccgcgatccgctggctggtgaatcacgggatcaaaacctctgtggcgcacactgcggctaattttgagcaagtgacggcggcctatcagcaaggtgcggattgcggcgtacatttgtataacggcatgtcagggttgcatcaccgtgaaccgggctgctgtggtgccgtgttgtatcacgacatgctggcagagctgattgccgatggcattcatgtgcatccggtgatgatgaatctggcgtatcgcatgaaaggttatcgccgcattgcactgatcaccgactgcatgcgcgcaggggggctgggtgaggggcgttatttactcggcgcacagcatatcacggtacgtcagggggaagcgcgcaccgatgatggttcactggcaggcagtacctgtagcttggatcaggcgctgcgtaacatgatccaacatgcgcaagtccccgagtgggaagctgtacaaatggccagcgcagtacccgccgcttatctgggattagcgtcaacactgggttcgatccagatgggtgcgcaagccagcatggtggtgatggagagcgactttaccgttgccgcaaccctgattaaaggtgaatgggcttatcgccactcagcctaa

SEQ ID NO: 101960 - protein, 388 aa, Yersinia pseudotuberculosis IP 32953
MRTAYLADRTFTPQGIETGVAVIVEQGEIVAVTRELPADAEIVHLTGKTLIPGLIDIHIHGRQGADVMDASAEALRTIARALPQTGVVAWVGTTVSAPIQDIFAALAQVRDFIADPDNARDTRTATLLGSFLEGPYFTAPFRGSHPEKYLTTPTPQELEQLRHSAGNTLLRAAIAPESPEALAAIRWLVNHGIKTSVAHTAANFEQVTAAYQQGADCGVHLYNGMSGLHHREPGCCGAVLYHDMLAELIADGIHVHPVMMNLAYRMKGYRRIALITDCMRAGGLGEGRYLLGAQHITVRQGEARTDDGSLAGSTCSLDQALRNMIQHAQVPEWEAVQMASAVPAAYLGLASTLGSIQMGAQASMVVMESDFTVAATLIKGEWAYRHSA

SEQ ID NO: 101961 - DNA, 1206 bp, Borrelia garinii PBi
  CDS (1)..(1206): transl_table=11
atgccaaatttttgcttattcaactcaaaatccgttttaactggaaacgacaaactagataattcagcggtccttattaaagataatgaaatttttgatattgtaacatctgatagacttaaaaaaatggatctcagggaatatcaaatgattgatgcaaaatgcaactatataactcctggactttacgacagccatattcatggatttcacggttatgggacagaccagtgctcaacagaatcaatacttaaaatgtcagagcatttggcacaatacggtgtcgtaggatttttaccaactctttatccaagaccaatagatgaaatgattcaaacaataaaagcttgtacagcagcaattggcaaggaaaagggtgctaaaattttaggacttcaccttgaagggccatttttctcccctgaaaaaagaggcgcacaccctgtttcttatcttcacgaaccgagcattaaagttatgcaaaaactaatagatgcagctggtggaatatttacaggatcaaacggccaaaaaaaaacacatataagcacaatgactgttgctcccgagcttaaaggaatgagagaacttgcaatgttttgccttgaaaacaatataaaccttcaagcaggacacacaaacgcaacatatgaaaatatgatcgaaggatttcaagttggaatacttcatacgacccattttttcaacgcaatgtcaaaacttgaccacagaaatccaaatgcaataggagcagtattaatacatggtgatgtttcttgtgaaattattgcagatggtcatcatatacacccaaaattagttttaatgatgagaaagcttaaagatataagtaaaatagtccttgtaactgacggacttactccaaattttcaaacttctggaaaactaattgcaaacggagatgaagtttatattgcagaggatggcttattccacagtgtgaaaagcaacacaatagctggatcaacgcttacaatgatacaaggtcttaaaaatttagtagaattcggctacagtttaagtgatgctgttcaagcaagctcttacaatccaacaagaattcttaatattgataaaaagggattaatatgccatggatatgatgcaaacatcaatgtcttagataaagatttcaatttaaaattaacaatgatagaatctaaaataatttttaacaatctctaa

SEQ ID NO: 101962 - protein, 401 aa, Borrelia garinii PBi
MPNFCLFNSKSVLTGNDKLDNSAVLIKDNEIFDIVTSDRLKKMDLREYQMIDAKCNYITPGLYDSHIHGFHGYGTDQCSTESILKMSEHLAQYGVVGFLPTLYPRPIDEMIQTIKACTAAIGKEKGAKILGLHLEGPFFSPEKRGAHPVSYLHEPSIKVMQKLIDAAGGIFTGSNGQKKTHISTMTVAPELKGMRELAMFCLENNINLQAGHTNATYENMIEGFQVGILHTTHFFNAMSKLDHRNPNAIGAVLIHGDVSCEIIADGHHIHPKLVLMMRKLKDISKIVLVTDGLTPNFQTSGKLIANGDEVYIAEDGLFHSVKSNTIAGSTLTMIQGLKNLVEFGYSLSDAVQASSYNPTRILNIDKKGLICHGYDANINVLDKDFNLKLTMIESKIIFNNL

SEQ ID NO: 101963 - DNA, 1158 bp, Symbiobacterium thermophilum IAM 14863
  CDS (1)..(1158): transl_table=11
atgaagcgctggttcagggccccgctcattcttccggaccgggtgattcccgacgggctgctggcgtacgatgccggcaggatcaccgatgtctgggacctggccgacccggccgccccgcctgttcccgctgaagccgaggtcgtggagcggggctacctggctccgggttacctggacatccacgtgcacgggggcggcggcggcgatttcatggatgcggaccccgaggccgtggtggcgatcacgaccatccacgcccgccacgggacggtcgggctcctggccacgaccctgaccgcgccggaggagcagattatccgggccatccgcacggtccggcaggccccccggaagggcgcccgggtgctgggctaccacatcgaggggccgtacatcaacctggcgcataagggggcgcagaatccggagtacgtgcggcccgcctccattgccgagatcgatcgttggatggcggagggcgggcccgaggaccggtggcacgtgacgctggcgccggagaccgacggtgcattggaagccatccgttacctggtccgccgcggcgccaccgtcagcgcaggccacaccgacgcgacgtatgaccagatgcgggcggcggtcgaggccggcctgtcccacgccactcacctgtacaacggcatgcggggcctgcaccaccgggagccgggcaccgtgggcagcgctctcgccctccccggtgtgacggtggagctgatcgccgacggcgtgcacgtgcaccccgccgcaatgcaggtggccgtgcgggcccggggcccggagcgcgtcctgctggtcaccgacgcaatgcgggccaccggcatgggcgacggcgagttcaccctgggcggactgcccgtcaccgtccggaacggggaggcccgcctgcacagcggctcgctggccgggtcggtgctgaccatggaccgggccgtgcagaacgcggtccgactcatcgggctcgacctgccgacggcggtggccatggcgaccctgcatccggcccgcctcctgcggctggacgaccggaagggctcgctcgcggtgggcaaggatgccgatctcctggtcctggacgaggatctgaacgtgaaagcgacgatcataggcggtgaggttgtgtatgatgagcggtaa

SEQ ID NO: 101964 - protein, 385 aa, Symbiobacterium thermophilum IAM 14863
MKRWFRAPLILPDRVIPDGLLAYDAGRITDVWDLADPAAPPVPAEAEVVERGYLAPGYLDIHVHGGGGGDFMDADPEAVVAITTIHARHGTVGLLATTLTAPEEQIIRAIRTVRQAPRKGARVLGYHIEGPYINLAHKGAQNPEYVRPASIAEIDRWMAEGGPEDRWHVTLAPETDGALEAIRYLVRRGATVSAGHTDATYDQMRAAVEAGLSHATHLYNGMRGLHHREPGTVGSALALPGVTVELIADGVHVHPAAMQVAVRARGPERVLLVTDAMRATGMGDGEFTLGGLPVTVRNGEARLHSGSLAGSVLTMDRAVQNAVRLIGLDLPTAVAMATLHPARLLRLDDRKGSLAVGKDADLLVLDEDLNVKATIIGGEVVYDER

SEQ ID NO: 101965 - DNA, 1197 bp, Symbiobacterium thermophilum IAM 14863
  CDS (1)..(1197): transl_table=11
atgggacgaccgattgcgctcaccggcgggcgggtcctgacgccgggccgcgagctggttccggcgacgctgctgatcgaggggacggaggtcgccggcctggcggcgccgggggaggcgctcccgccgtacgcccagacgatcgatgtgtccggctgcctcgtggcgccggggtttattgacacccacgttcacggaggcatgggctgcaacttcatgctcggaactccggaggccctggccgtcatctcggcgcgtctggtacagggcggaacgacggcctgcctggccaccacgaccagcgccccggcgcgcgatatcgcggtggcgctggacaccatcgcccgggcgagccgtgcgccccgaccgggacaggtggagatcctgggcgcccacctggaggggcccttcatcaacccggagaaagcggggtcgcaggcgcggcagcatctccgtccgcccgaaccggccgccgtgcaggcgctgtgggaagcggcggggggcgcgctccgggtggtgacgatcgcccccgaactgcccggcgccggggaggccatccgctacctggcggggatgggggtgcaggtgtcgctgggccacagcgcggccacctacgaggaggcgcgtgaggcgctggggtggggcgtgcgcagggccacgcacctgtacaacgccatgcccgccctgcagcaccgccggcccggcgcggccgccgccctgctggaggatccgcgcgtattcgtggagctcaccgtggacggccaccacgtccacccggcgatggtggccctgacctaccgcctggtgggaccggagcggctggtgctggtgaccgacggcgtggacgtggccggcctggaggatggcacctacacccgctgggagggcacgccggtgcggctgcagggcggcgagtgccgcacggagtccggctcgctggccggcagcaccctgcggctggaccaggcggtgcggaacatggtgcgcttcgccggcgtcccggtggcggaggcgctgcgcatggcctcggagacccccgcgcaggcgctggggatcgatcgcaagggccggctggcccccggcaaggacgcggacgtcgtggtgctcagcgaggacctggaagcgatactgaccatcgcccgcggacacgtggtgtacgacggccgccccggcggacgtgccgaaacgatcgggtga

SEQ ID NO: 101966 - protein, 398 aa, Symbiobacterium thermophilum IAM 14863
MGRPIALTGGRVLTPGRELVPATLLIEGTEVAGLAAPGEALPPYAQTIDVSGCLVAPGFIDTHVHGGMGCNFMLGTPEALAVISARLVQGGTTACLATTTSAPARDIAVALDTIARASRAPRPGQVEILGAHLEGPFINPEKAGSQARQHLRPPEPAAVQALWEAAGGALRVVTIAPELPGAGEAIRYLAGMGVQVSLGHSAATYEEAREALGWGVRRATHLYNAMPALQHRRPGAAAALLEDPRVFVELTVDGHHVHPAMVALTYRLVGPERLVLVTDGVDVAGLEDGTYTRWEGTPVRLQGGECRTESGSLAGSTLRLDQAVRNMVRFAGVPVAEALRMASETPAQALGIDRKGRLAPGKDADVVVLSEDLEAILTIARGHVVYDGRPGGRAETIG

SEQ ID NO: 101967 - DNA, 1206 bp, Symbiobacterium thermophilum IAM 14863
  CDS (1)..(1206): transl_table=11
atgatgctgtttacgtgctcacggatccacgccgagggcggcctggtcgacggctacgtgctggtggacggccggcgcatcgccgcggtggaggccgggccggtcccggcggagctgcagggcgtcgatagggtggacctgccggactgcgacctgatcccgggcatgatcgacctgcacatccacggcgccggcgggtggcccgtggaaggggcggacgtcgggctgctgcaggggctcggccggttcctggccggcttcggcgtgacgggcttcctgcccagcgcctccgcgcggcccctggaggagctggaggaggtggcccggcaggtccgggcggccacggaggcggaatacgacggcgccgccatcctgggcctccacctggaggggccgttcctgaacccgaagcggcccggggcgatgcacatccacaacctgcgcacgccctccgtcgccgaggccgagcggctgctggcggccggcggaggcacggtgcggcgggtctcgctggcgcccgagctgcccggcgccccggagctgatccgctacctcgtcgcgcagggggtgacggtggcaggcgcgcacaccgacgcgacgtacgcagagacggtggcgggcatcgaagccggggtctcgctggctacccacacctacaacgcgatgcgcgggctgcaccaccgggagcccggggcggtgggggcgtatctcaccgatgaccgggtgacctgcgagatcatctgcgacctgctgcacgtgcaccccgcggcggtccggatcgcgctgcgggcggcgggcccggaccgggtggccctgatctccgacgcgatccccgcggcggggctgaagcccggccactacctgctctggggccgggacctgtacatcgatgagcagggttactcgaagctggccgacggcaccatcgcgggatccaccaagctgatgctccacggcctgcgcaacctggtggaggtgctcggggtgccgtgggcggaggcggtgcggatggcgtccctgattccggcccgcgccatcgggctcgccgaccggaagggcagcctggcgccgggcaaggacgccgacctggtggccatcggcccgggctggcaggtggcctggtgcgtcgtcgagggccgggtggtgcgccggccgggggatccgcctcccgcgtacaacccggaggcaaaggcgatcgacgagtag

SEQ ID NO: 101968 - protein, 401 aa, Symbiobacterium thermophilum IAM 14863
MMLFTCSRIHAEGGLVDGYVLVDGRRIAAVEAGPVPAELQGVDRVDLPDCDLIPGMIDLHIHGAGGWPVEGADVGLLQGLGRFLAGFGVTGFLPSASARPLEELEEVARQVRAATEAEYDGAAILGLHLEGPFLNPKRPGAMHIHNLRTPSVAEAERLLAAGGGTVRRVSLAPELPGAPELIRYLVAQGVTVAGAHTDATYAETVAGIEAGVSLATHTYNAMRGLHHREPGAVGAYLTDDRVTCEIICDLLHVHPAAVRIALRAAGPDRVALISDAIPAAGLKPGHYLLWGRDLYIDEQGYSKLADGTIAGSTKLMLHGLRNLVEVLGVPWAEAVRMASLIPARAIGLADRKGSLAPGKDADLVAIGPGWQVAWCVVEGRVVRRPGDPPPAYNPEAKAIDE

SEQ ID NO: 101969 - DNA, 1206 bp, Bacillus licheniformis ATCC 14580
  CDS (1)..(1206): transl_table=11
gtgaaaaccaaaccatctcaacgctatatttttaaacatcttcatatttacagtgaaaatggaatgatagaagacggttttcttctgacgaatggagaaaaaatcgaggcttacggaccaatggctgatattccagcttccgcacaaacggcagaacagctgacatttccggagaacttcaaagtgctgccgggcatgatcgatgtccacattcacggggcaaacggcgcagatgtcatggacggaacagccgaggctttgcaaacaatggctgaagccctgccgaaagaaggaacgacaagcttcctggcgacgacgatgacccaagataaagccacgatcgagcatgcgctggcaaacgttcaccggtataaggaagccggcggacggcccggaacagccgaagtattaggcgttcacttagagggcccttttatttcagaaaagcggtgcggcgcccagccgccggatgacattatagcgccggatctttcgttatttaaagaatggcagcgcatctcagggaataacattaaattagtcacacttgcgccagagctggaagggtctttggaactaatttcctttttgaaggaaacaggggtcatcgcatccgcaggccattccgacgccggactcaaagagatggaagccgggattaaggccggcctctcccatgtcacccatttgttcaacggcatgcgggggctgcaccaccgcgagccggggactgccggtagcgctcttctgcatgatgaactgaaggctgaagtcattgccgacggcatccatgttcaccctgccgtcatcaagctggcatttcagcaaaaacagaaagaaggcatcattttaattacggatgccatgcgcgcaaaatgcttgaaaaatggaacctatacattaggcggacaggaggtgttcgtaaaaggcgataaagccgttttacgggatggtacgcttgccggcagcatcttgaagatgaaccaggctgcactgaacatgatggattttacgggatgttcactcgaagatatcgtctacatgacagcagtcaatcctgccagacagcttcatatttatgaccggaaaggcagcatacggagcgggaaagatgccgatttgatcattttaaatgaaaaaaatgaagttgtgatgacgctttgcaaaggcgtgattgctttcagcaaaagggaggtttcaccatga

SEQ ID NO: 101970 - protein, 401 aa, Bacillus licheniformis ATCC 14580
MKTKPSQRYIFKHLHIYSENGMIEDGFLLTNGEKIEAYGPMADIPASAQTAEQLTFPENFKVLPGMIDVHIHGANGADVMDGTAEALQTMAEALPKEGTTSFLATTMTQDKATIEHALANVHRYKEAGGRPGTAEVLGVHLEGPFISEKRCGAQPPDDIIAPDLSLFKEWQRISGNNIKLVTLAPELEGSLELISFLKETGVIASAGHSDAGLKEMEAGIKAGLSHVTHLFNGMRGLHHREPGTAGSALLHDELKAEVIADGIHVHPAVIKLAFQQKQKEGIILITDAMRAKCLKNGTYTLGGQEVFVKGDKAVLRDGTLAGSILKMNQAALNMMDFTGCSLEDIVYMTAVNPARQLHIYDRKGSIRSGKDADLIILNEKNEVVMTLCKGVIAFSKREVSP

SEQ ID NO: 101971 - DNA, 1164 bp, Bacillus cereus E33L
  CDS (1)..(1164): transl_table=11
atgaactactatgtcaaagcatctatgtatctactagaagatggtgttcgtgagggtggatatttacatattgtaaatggctactttctaaaacatgttgaagaaatagtagacggagcgttagtaatggattttgaaggaagtattatttctccaggatttgtggatacacatattcacggtgtagcgggacatgatgtaatggatagcacatatgaatcgttaaacaatatttctattatgttattggaaaatggtgttacgagttttttacctacaacgttaactggttattcggaaaatacaatgaaagctttaaaaaatatagctcatgcaaaaaaaagaggagtggaaggggcgaatattattggagcttttcttgagggaccttgttttacggaggtctataaaggtgcacaaaactctaaatattttattgatccaaccattgaaatgttagaggagtggattgttgcatcagaagggacaattaaaaaaattgccatggcaccagagaggaaaggtactattgcgtgtatacatcatgctgtgaaaaagaatattcatgtagcaattgggcatacgaatgcaaactatgagatatgccagaatgcgattcaagcaggagcgacgatttttgtgcatacgtttaatggaatgaaaggattacatcaccgtgaacctggcgttgttggagcggtactctcaactgagcatgtgtatggtgaaatcattgtagatggacatcatgtacatccaagcgtagtgaatattttatataaatgtaaaggatacgacaaaacttgtttagttagtgactgtatgcgagcgggcttattaggggatggcacatataatttaggagaatttgttgtccaagtgcaagacggcattgcccgaacagaggcgggttctttagcaggaagtacacttcgatttattgatggtgtgaagaatatagagaaatggacaaatgcatcgttatgggaatgtgttcatatgggatcgttaattcctgctaaaagtattggagttgataatgaaattggaagtatagcaccagggaaaagagctgattttcttatattaacagaggatttagatcttataggaacagttgtagggggagaaatgaaatataaaaagaataaagagaggatttga

SEQ ID NO: 101972 - protein, 387 aa, Bacillus cereus E33L
MNYYVKASMYLLEDGVREGGYLHIVNGYFLKHVEEIVDGALVMDFEGSIISPGFVDTHIHGVAGHDVMDSTYESLNNISIMLLENGVTSFLPTTLTGYSENTMKALKNIAHAKKRGVEGANIIGAFLEGPCFTEVYKGAQNSKYFIDPTIEMLEEWIVASEGTIKKIAMAPERKGTIACIHHAVKKNIHVAIGHTNANYEICQNAIQAGATIFVHTFNGMKGLHHREPGVVGAVLSTEHVYGEIIVDGHHVHPSVVNILYKCKGYDKTCLVSDCMRAGLLGDGTYNLGEFVVQVQDGIARTEAGSLAGSTLRFIDGVKNIEKWTNASLWECVHMGSLIPAKSIGVDNEIGSIAPGKRADFLILTEDLDLIGTVVGGEMKYKKNKERI

SEQ ID NO: 101973 - DNA, 1143 bp, Bacillus cereus E33L
  CDS (1)..(1143): transl_table=11
atgaaaacgcaagttgtcatcaatgccaaaatttatacaggtcaagaagtagtagaaaacggatttattcgttacgcagaaacaattaaagaaattggtttgatggctcaatatgtatcacaagaaaatgaaactgttttagatggagcagggaagattgtgattccaggtatgattgatgttcatattcatggtggatacgatattgatgcgatggatgcaaatagcgatgggttagtaactctagggaaagaaatgttaaaagaaggagttacaacttacttcccaacaacaatgacacaagctccagaagcaatcgaagcagcactacatgctgcgaaagaagcgaaagaaaaaggagcacatttcgaatatattcacttagaaggaccgtatgtttcaaaaaaacgtgcaggtgcacaaccacttgaacatattgttcctgcgaatattgaacaatttaaacaatggcaggaagcaagcggaaatctaattaaattagtaacatacgcacctgaagaagaaggagcattagagtttgagcagtatcttgctgaaactggtgttgtcggcacaatggggcatacagatgcaattgatgcgcaactaaaaaacagaaacattacacatgcaacgcatttatacaatcaaatgcgtggattacatcaccgtgaaccaggagttgttggtcatgtgttattaaatccagatgtaatggttgaagtaattacagatggtattcacattcaccctgatatggtgaaattagcatataaattaaaaggaccgaaaaaagtaagtgttattactgacgcaatgcgtgcaaaaggtcttgaagatggattatatgagcttggcggacagccagtacatgtaaaagatggtagtgctcgattagaagatggaacgctagccggtagtattctaaaaatggatcaagctttccgaaatgtaattgaatttacaggttgttcaatcgaagatgcagtactgatgacatcagttaaccaagcagaagagtttggattaaataataaaggtgcattagcggtaggaaaagatgcagactttgttgtgatgaatgaagatttacatgtatatgatacggttcgtttaggaattcatatgaaggaagggaagtaa

SEQ ID NO: 101974 - protein, 380 aa, Bacillus cereus E33L
MKTQVVINAKIYTGQEVVENGFIRYAETIKEIGLMAQYVSQENETVLDGAGKIVIPGMIDVHIHGGYDIDAMDANSDGLVTLGKEMLKEGVTTYFPTTMTQAPEAIEAALHAAKEAKEKGAHFEYIHLEGPYVSKKRAGAQPLEHIVPANIEQFKQWQEASGNLIKLVTYAPEEEGALEFEQYLAETGVVGTMGHTDAIDAQLKNRNITHATHLYNQMRGLHHREPGVVGHVLLNPDVMVEVITDGIHIHPDMVKLAYKLKGPKKVSVITDAMRAKGLEDGLYELGGQPVHVKDGSARLEDGTLAGSILKMDQAFRNVIEFTGCSIEDAVLMTSVNQAEEFGLNNKGALAVGKDADFVVMNEDLHVYDTVRLGIHMKEGK

SEQ ID NO: 101975 - DNA, 1143 bp, Mannheimia succiniciproducens MBEL55E
  CDS (1)..(1143): transl_table=11
atgaaatatgcgttaacaaattgtgtgatttatacggcaaaaaacgtgctttacgagcatgccgtgattgttgagaaagataaaattcaagccgtattacctgaaagagaattgataccggaaatccaacggatcaatttaaaaggcagtaatttaaccgccggttttattgatttgcaacttaacggctgcggcggtgtgatgtttaacgaagacatcagtgtcaaaaccctggaaattatgcaggagaccaatttaaaatcaggcaccaccagctatttgccgacctttattacatccccggatgaagatatgaaaagtgcggtcaaaattatgcgagattatttagcgaaacataaaaaccaggcgctcggattgcatttggaaggcccttatttaagcgtggagaaaaaaggggtacaccgcgaggaatatatccgtgaaatcagccctgaaatgaaagcatttttgctggataacgccgatgttatcagtaaaatcactattgcggcggaaaacccggccatgcaatatgccggcgaatttgtagaaaaaggcattattgtttccgtagggcattccaacggcacttatgaacaggcgaaacgggcgtttgctcaaggcgcaagttttgccactcatttacataacgccatgtcaccggtaagttccgggcgtgctatgggcgtagtcggcgcggtgttggattccgacgaagtttacagcggcattattgccgacggtttgcacgtagcgttcggcaatattttgattgctaaacgggcaaaaggcgacaaactttgtttggtgaccgatgctaccgcagcggcaggcgccgatatcgagcaatttacgtttgtggggaaaaccgtttatgtgcgcaatggtaaatgctatgaggcaaacggtacgcttggcggttcggcggttactatgattgaatcaatcagaaatgcggtggaacaagtgggtatcccgttagaagaaaccttacgcatgtgtaattattacccggcaaaagccatgaaggtagacgaccgtttaggctctattgaagcggggaaaatcgctaatttaaccgcatttactcacaattttgatattgtgggtacgtcggtaaacggtgagtggaaatttgcttaa

SEQ ID NO: 101976 - protein, 380 aa, Mannheimia succiniciproducens MBEL55E
MKYALTNCVIYTAKNVLYEHAVIVEKDKIQAVLPERELIPEIQRINLKGSNLTAGFIDLQLNGCGGVMFNEDISVKTLEIMQETNLKSGTTSYLPTFITSPDEDMKSAVKIMRDYLAKHKNQALGLHLEGPYLSVEKKGVHREEYIREISPEMKAFLLDNADVISKITIAAENPAMQYAGEFVEKGIIVSVGHSNGTYEQAKRAFAQGASFATHLHNAMSPVSSGRAMGVVGAVLDSDEVYSGIIADGLHVAFGNILIAKRAKGDKLCLVTDATAAAGADIEQFTFVGKTVYVRNGKCYEANGTLGGSAVTMIESIRNAVEQVGIPLEETLRMCNYYPAKAMKVDDRLGSIEAGKIANLTAFTHNFDIVGTSVNGEWKFA

SEQ ID NO: 101977 - DNA, 1104 bp, Burkholderia mallei ATCC 23344
  CDS (1)..(1104): transl_table=11
atgctgaccggaaacatactgaccgccgaaggctggatccacggcacgctcgaattcgagaacggccggatcaccacgctgtcgggcgacgcggcggacccgtcgaacaacgatgcgccctacatcctgcccggcttcatcgatctgcacgtgcacggcgcgggcggcgcggacgtgatggagggcggcgacgcgatcgagacgatcgcgcgcacgcacgcgcgctacggcacgacgagcctgctcgcgacgacgatgaccgcgccgcgcgacgagctgatgcgcgtcgtcgcggagctgggcgacgtcgcgcgcacgcgcacgccgggcggctcgcgcgtgctcggcgtgcatctcgaaggcccgtacatcaatcccggcaagctcggcgcgcagccggacgcggcggtgtccgcggcgctcgacgaggtgctgaagtatctgtcgatcgcgccgatccgcgtggtcacgctcgcgccggagatcgccgggcacatcgagatcatctcggagatggccgcgcgcggcgtgcgcgtgcagctcggccattcgctcggcacgtacgacgacgcggtcgccgcgctcaagcacggcgcgtgcggcttcacgcacctgttcaacgcgatgtcgccgctgcatcaccgcaatcccggcatcgtcggcgcggcgctcgcgcacgccgaatacgcggagatcatccccgatctgctgcacgtgcacccgggcgcgatccgcgcggcgctgcgcgcgatcccgcggctgtacgtggtgaccgacagcacgtcggccaccggcatgcccgacggcgaataccggctcggcagccagcgcgtgacgaagtgcctgggcggcgtgcgcctcgccgacggcacgctcgccggcagcacgctgacgatggatcaggcgctgcgcaatctcgtgtcgctcggcctgccgatcgccgacgtgtcgagccggatgtcgcgctacgcggccgactatctcgggctcgccgatcgcggccgcatcgcgcgtggcgcgtgggccgatctcgccgtgttcgaccgcgagctgaatctgaccgcaaccttcgtcgaaggagaatcgattgtcgaatatgcttaa

SEQ ID NO: 101978 - protein, 367 aa, Burkholderia mallei ATCC 23344
MLTGNILTAEGWIHGTLEFENGRITTLSGDAADPSNNDAPYILPGFIDLHVHGAGGADVMEGGDAIETIARTHARYGTTSLLATTMTAPRDELMRVVAELGDVARTRTPGGSRVLGVHLEGPYINPGKLGAQPDAAVSAALDEVLKYLSIAPIRVVTLAPEIAGHIEIISEMAARGVRVQLGHSLGTYDDAVAALKHGACGFTHLFNAMSPLHHRNPGIVGAALAHAEYAEIIPDLLHVHPGAIRAALRAIPRLYVVTDSTSATGMPDGEYRLGSQRVTKCLGGVRLADGTLAGSTLTMDQALRNLVSLGLPIADVSSRMSRYAADYLGLADRGRIARGAWADLAVFDRELNLTATFVEGESIVEYA

SEQ ID NO: 101979 - DNA, 1155 bp, Mycoplasma hyopneumoniae 232
  CDS (1)..(1155): transl_table=4
atgatttataaaaatcttagaattgttagtcattctgatgaatttataggttgaattgaacttgataaaaacggaattattgttaatttatgtagaggaaatacagaatcttcaggaattgactgcaaaaaccacgttttattaccggcttttattgattcgcacacccacggcggctatggattttcatttgatgacttttcagatagttgctgagaacaaaattttttagattataaggaaaaactacataaatttgaaggtgtagcagcaatttttggaacaactattacccagcaatgagaaaaaattaaggtaaatagtgaattttttttatttttgcttaataaatatcctaattttttactaaattgatatttagaaggtccgtttatttctgaggaaaaaaagggggcacacaatcaaggtttaataattaaaccgaaaagagaacattttaagtttttggcagaaaaatttaacaaaaaaattacagtagtagttgcccctgaaaaaacttctgcaaaattaattgattctttttataaaacaattaattttgcaattgggcattcgaattcttttgacttcaaaaggaatcataatttaaaaaagtactataaatttacacacttttttaatggatgttcaaattttgaccaccgaaaacaatcacttgtcaaccttatttttgaatcaaaattacctaaaaattttcttgttgagttaatcactgacagccttcatattaaaaattcaaccctcaaatttacaattaaaaatattaaaaaagaaaattgggttgcagtctcagactcgcttgcacaaaaaggacttgataatggattttataaattaggagaactaaaaattgagaagaaaggtgatttattctatctaaaaaattcaaaacaaattgccggaagtgggatgtcatatttaaaaattcttaagaatttaaagttaaatttgaaactatcttgacaggaaatagttttttgttcctcttataatgtggcaaattcattgggaattctagatttttttgggtcaattaagataggacaaaaagcaaattttgtaattttagatgataaatttgaactaaaaatgtcaatcatttttggccaaatttaccgcgaatttgcaaaatag

SEQ ID NO: 101980 - protein, 384 aa, Mycoplasma hyopneumoniae 232
MIYKNLRIVSHSDEFIGWIELDKNGIIVNLCRGNTESSGIDCKNHVLLPAFIDSHTHGGYGFSFDDFSDSCWEQNFLDYKEKLHKFEGVAAIFGTTITQQWEKIKVNSEFFLFLLNKYPNFLLNWYLEGPFISEEKKGAHNQGLIIKPKREHFKFLAEKFNKKITVVVAPEKTSAKLIDSFYKTINFAIGHSNSFDFKRNHNLKKYYKFTHFFNGCSNFDHRKQSLVNLIFESKLPKNFLVELITDSLHIKNSTLKFTIKNIKKENWVAVSDSLAQKGLDNGFYKLGELKIEKKGDLFYLKNSKQIAGSGMSYLKILKNLKLNLKLSWQEIVFCSSYNVANSLGILDFFGSIKIGQKANFVILDDKFELKMSIIFGQIYREFAK

SEQ ID NO: 101981 - DNA, 1143 bp, Photobacterium profundum SS9
  CDS (1)..(1143): transl_table=11
atgttcatgtacgcgcttaccaattgtcgcatttttaccggtagcgatgtgctgaataaccacgccgtcatcattgacggcgtgagcattcacgctgtttgcccagtaacagaattaccaaaaaatattgagctcgttgatttagacggtgctaacctaacacctggttttattgacctacaacttaacggttgtggtggtgtaatgcttaatgatgaaattaatgcagaaacaattcacaccatgcaccgcgctaaccttaaatcaggttgtacgagtttcttaccgacactaatcacatcttctgatgaagatatgaaagctgccattgcagcgacacgtgactatcagaatcaatatgaaaatcattctttaggtcttcaccttgaagggccatatctgaatgtaatgaaaaaaggcattcattctgttgatcatattcgtcgttctgatcatgcaatgatttcaacaatttgtgaaaatgccgatatcgtaactaaagtgactttggcaccagaacaaaatgtgcaagagcatatcgaacaactcgttgaagctggtgttgttgtttcagctggccatacaaatgcaacgtatgtagaagcccgaaaaggctttgctgctggcattagttttgccacgcacctgtttaatgcaatgacaccaatcgcggggcgtgagcctggtatggttggcgcaatctacgacacacctgacgtatatactggtgtaatcgcagacggttttcatgtcgattatgcgaacattcgcatggcgcaccgtatgaaaggtgagaaacttgttttagtcaccgatgcaactgcacccgcaggagcagacatggatcactttattttcgtcggtaagaaagtatattaccgtgatggcaagtgtattgatgagaatggtacacttggaggttcggcattaaccatgattgaagcggttagaaacagtgtcgaacacgcaggtatcgctctggatgaagtgattcgcatggctaccctctatccggcacgtgctattcgtgtcgataataagctgggggctatcaaaaaaggcatggttgctaactttgctatttttgatcgcgattacaacgttcgagcgactgttgttaacggtgaatacgagcagaactaa

SEQ ID NO: 101982 - protein, 380 aa, Photobacterium profundum SS9
MFMYALTNCRIFTGSDVLNNHAVIIDGVSIHAVCPVTELPKNIELVDLDGANLTPGFIDLQLNGCGGVMLNDEINAETIHTMHRANLKSGCTSFLPTLITSSDEDMKAAIAATRDYQNQYENHSLGLHLEGPYLNVMKKGIHSVDHIRRSDHAMISTICENADIVTKVTLAPEQNVQEHIEQLVEAGVVVSAGHTNATYVEARKGFAAGISFATHLFNAMTPIAGREPGMVGAIYDTPDVYTGVIADGFHVDYANIRMAHRMKGEKLVLVTDATAPAGADMDHFIFVGKKVYYRDGKCIDENGTLGGSALTMIEAVRNSVEHAGIALDEVIRMATLYPARAIRVDNKLGAIKKGMVANFAIFDRDYNVRATVVNGEYEQN

SEQ ID NO: 101983 - DNA, 1152 bp, Photobacterium profundum SS9
  CDS (1)..(1152): transl_table=11
atgcgttatgccttacttgcagatcgagtatttacacctgaaggaatcgtgacggatacagcagtagtcattgccaatggcaagatcgaagcagttactgcaactataccgacagactgtgatgtgatccgtcttgaaggtcaatcattgttaccgggctttatcgatattcatattcacggtcgccaaggggcagatgtgatggatgcgactgatgaagcattgcaaaacattgccaatgccttaccgcaaacgggtgttgtcggttgggttggtaccacggtaacagcgccttggagcgatatcttaaacgcattaacaggtgtacgtactttcattgagaagaaacaaacccatggcgcagagctgttgggcagctttttagagggaccgtattttacagaaccacatcgaggttctcatccccctgcttttttgaagtctccaacgattgaagagttagagcaattaaaagaagcagcgtcgggttcattgatccgtgctgcagtagcccctgaggctaaaggtacgatggaagctattagctggctcactgaacatcagattaaagtatcggtcgctcatacagatgcaacgttcgatcaggtaacggaagcccatcatcggggtgctgattgtggtgttcatctttttaatggtatgcgtggattacaccatcgagagcctggttgttgcggggctattttataccacgacatgctggcggaactcattgccgatggtattcatgtgaatcccgtcatgatgcagcttgcttatcgaatgaaagggtatcagggaatagcattgattactgattgtatgcgagcgggtggattaagcgatggtgaatatcagcttggtgcacaaacaatcacggtgactaatggtgaagctcgtagcccatgtggttcgctagcaggaagtacctgcagcttggatcaggcattgcgtaacatggtgtttgaaagccacgtacctgaatgggaagcggtgcaaatggcatcgtttgttcctgctaattatctgggacttgctcatcgccttggcagtattgctaaaggaatggaagccagtcttactgttatgaatgaagcattacaagtgcaaggcacattgattaacggtgaatgggcataccacaccgagtaa

SEQ ID NO: 101984 - protein, 383 aa, Photobacterium profundum SS9
MRYALLADRVFTPEGIVTDTAVVIANGKIEAVTATIPTDCDVIRLEGQSLLPGFIDIHIHGRQGADVMDATDEALQNIANALPQTGVVGWVGTTVTAPWSDILNALTGVRTFIEKKQTHGAELLGSFLEGPYFTEPHRGSHPPAFLKSPTIEELEQLKEAASGSLIRAAVAPEAKGTMEAISWLTEHQIKVSVAHTDATFDQVTEAHHRGADCGVHLFNGMRGLHHREPGCCGAILYHDMLAELIADGIHVNPVMMQLAYRMKGYQGIALITDCMRAGGLSDGEYQLGAQTITVTNGEARSPCGSLAGSTCSLDQALRNMVFESHVPEWEAVQMASFVPANYLGLAHRLGSIAKGMEASLTVMNEALQVQGTLINGEWAYHTE

SEQ ID NO: 101985 - DNA, 1197 bp, Photobacterium profundum SS9
  CDS (1)..(1197): transl_table=11
gtgattgcgtttatttacaatagccagaggcagttactagcggataataacgagaggcttatgtttgcactaacgcatgttaatgtttttgatggtcacacgacccttctagaccaagcgattatcattgttcaagacactataacgtctatcgtttcgatgaaagatgcaaaattacctgcaaaaactttcaatgctaatggcttattagcaactgctggctttattgatatccaattaaatggttgtggcggcgtattatttaatacagacatcagaaaagaaacacttgatgtaatgaacgcaaccaaccttaaaagtggcacgacgcaatatttaccaacccttattactagccaagctgaatcaatgaagcaagctattgatatggttgctgatattaatgagccaagtaaagaaggtgtattgggtttacaccttgaaggtccctttattaataaagctaaaaagggagcgcaccaagagcacttaattcgtgaacttgatgaaataacagcgtactaccttgctgataatgcagataaaattagcgtaataacacttgcaccagaaaacacctcgcagcacgttatcgatattttgacacaggctggcattacagtgtcacttggccacactaactcgacatatgaagaacttgctgaaaaatatggcatcacaatggctacgcatttatataatgcgatgacgccacttggctctcgtgaacctggcgctgtcggttatattttcgataaaaagccacatgctggcatcattgttgatggcattcactcttcatacgcatctgttcgtattgcccaccagctaatgggtgaaaagctatttatggtaacagatgccgttaatccagcaggcacagacttaaccgaatacgacatggctggaacaacggcttacgtaactgatggaaagtgccattatgccgacggtactatcgcaggtgctgcaattaccatgattgaaggtgtaagaaaccttattgatcaggttgggcttacgcgtgatgaagcattgcgtatggctagcctctacccagcaaaagcattaaaacttgaccacgaatatggtcagttaaaagcaggttataaagcgaatatcacattgctaactgatgataatcaggtgcagcatgttattcaaatgggtaaacaacacgactttactgctcgctaa

SEQ ID NO: 101986 - protein, 398 aa, Photobacterium profundum SS9
MIAFIYNSQRQLLADNNERLMFALTHVNVFDGHTTLLDQAIIIVQDTITSIVSMKDAKLPAKTFNANGLLATAGFIDIQLNGCGGVLFNTDIRKETLDVMNATNLKSGTTQYLPTLITSQAESMKQAIDMVADINEPSKEGVLGLHLEGPFINKAKKGAHQEHLIRELDEITAYYLADNADKISVITLAPENTSQHVIDILTQAGITVSLGHTNSTYEELAEKYGITMATHLYNAMTPLGSREPGAVGYIFDKKPHAGIIVDGIHSSYASVRIAHQLMGEKLFMVTDAVNPAGTDLTEYDMAGTTAYVTDGKCHYADGTIAGAAITMIEGVRNLIDQVGLTRDEALRMASLYPAKALKLDHEYGQLKAGYKANITLLTDDNQVQHVIQMGKQHDFTAR

SEQ ID NO: 101987 - DNA, 1194 bp, Photobacterium profundum SS9
  CDS (1)..(1194): transl_table=11
atgggatctaaccaccaacattatcgtgcagcgcgagtgttaaaagacgagcagtggctaaacgatggtgtcgtctctgtcgcagccgatggcactatcgcagccattgaaagctattgcgtgagcaagcacagtcacatcaccaatttaggcaatgtgagcttactacccggcatgattgatagccatgttcacggtgcgaaaggctgcgatgtgatggacgcaagccatgacagtcttaatcacatgtcacgctttttcgcgagccaaggggtcacggggtttgtcgcaacaacagtaaccgcacccgtagcaaaaattcgcgcagcgcttcaacaaatagcaaaaagtaaacacgcgggcgtcgatggtgcctccattttgggatcgtacctcgaaggaccttactttactgaaaagcacaaaggagctcatccaaccgaatggtttcgcgctctatctattgaagagatcgacaattggatctcttacagtgatggcgaactgattaccgtcgcgcttgcgccagaaaaagcaggcgcactaaaggcgattcagcaccttaaacaacagggtatcaaagtgatgcttggccatactgatgcgagttttgatcaagttcaagccgcattcgatgcaggagctgatggcattgtccattgttataacggaatgcgcggattacatcatcgtgatcctggtgtagtgggcgcagggctttgtcatccaaatagcttcgtcgaaatcattgcagacagtcaccatgtacatccaaccgccgtcgatgtggcgcatcgttgctgccaatctcgattaacattgatcactgacgccatgtgcgcaacgcacatgccggatggacaatatcgacttggtgagttcattgtcacggtgcaaggcgccattgcaatgaccgattcaggcagcttggcaggcagtacgttaaccatgccaatagctgttcaaaatattcaacgctggctcaatctatcccttgagcaagcgtggctattggcctcacttacgccagcaaaatctttaggtattcaagatcaactcggcacactcgcagtaggcaaacacgcctctatggtcgcgctgagttcagatttcatcattttaaaaacatgggtgaaagggcgtctagtatttgatgcggtttcaattcccaaccaggaggctttatgtatctaa

SEQ ID NO: 101988 - protein, 397 aa, Photobacterium profundum SS9
MGSNHQHYRAARVLKDEQWLNDGVVSVAADGTIAAIESYCVSKHSHITNLGNVSLLPGMIDSHVHGAKGCDVMDASHDSLNHMSRFFASQGVTGFVATTVTAPVAKIRAALQQIAKSKHAGVDGASILGSYLEGPYFTEKHKGAHPTEWFRALSIEEIDNWISYSDGELITVALAPEKAGALKAIQHLKQQGIKVMLGHTDASFDQVQAAFDAGADGIVHCYNGMRGLHHRDPGVVGAGLCHPNSFVEIIADSHHVHPTAVDVAHRCCQSRLTLITDAMCATHMPDGQYRLGEFIVTVQGAIAMTDSGSLAGSTLTMPIAVQNIQRWLNLSLEQAWLLASLTPAKSLGIQDQLGTLAVGKHASMVALSSDFIILKTWVKGRLVFDAVSIPNQEALCI

SEQ ID NO: 101989 - DNA, 1167 bp, Streptococcus thermophilus LMG 18311
  CDS (1)..(1167): transl_table=11
ttgatgagaggtagtcctatgacttattatatttcagccaaacgtttttattttgatcataaggtcaaagaaggtggctacttggcggtcacagatggtcgttttggtaagtggacagaatatgtaccagagggtgcagaagtgctagattacagtgattatcagattgctcctggccttgtggacactcacattcatggctttgcggggtacgatgttatggataattctgaggaaagtcttctaggcatgagtcaagccttgctttcagcaggtgtgacttctttcttaccgacagcattgacagcgccatttgaagagctaaaagctatctgtcagataacagcagagacggctggtaaggagcctggtgctaaaatccagggactcttctttgaaggaccgtatttcactgagatctataagggagcgcaaaatcctaaatacatgggcaacccaagtatcgaacagttgcaagcctggcaagaagcggctcagggaaagttaatcaaattagcactggctcccgagcgtgaaggagtggctgactttattaaagaagcgactaaacaaggtgtaacgattgctttaggacactccaatgctacttatgaagaagccatggcagcagtggaagctggtgcttcagtctgggttcacgtctacaatggaatgcgtggctttagtcaccgtgagcctggtatggttggtgcagcctttgatactcctgagacgattggtgaactgattgcggatggtcatcacgtggttcctgcagcttgtaaggtactcatcaagcaaaaaatgcctcaaggagttacccttattacagattgtatgtcagcgggaggttgtcctgatggtgactatatgctaggtgagcttcctgttattgtggaaaatggtaccgctcgtcttaagaaaggtggtaacctagctggctctatcctacaactcaaagacggtgtcaaacatgtggttgattggggactcgtgacggttgctcaagccttacaaatggcaactagtgttcctgctaaatcggttggactagaaaatatttgtggcagccttaaagctggtctcccagccgatttcatcgtcttagatgattccttggaattacaagcaacctatattgatgggtgtaaaggttgggagaagtaa

SEQ ID NO: 101990 - protein, 388 aa, Streptococcus thermophilus LMG 18311
MMRGSPMTYYISAKRFYFDHKVKEGGYLAVTDGRFGKWTEYVPEGAEVLDYSDYQIAPGLVDTHIHGFAGYDVMDNSEESLLGMSQALLSAGVTSFLPTALTAPFEELKAICQITAETAGKEPGAKIQGLFFEGPYFTEIYKGAQNPKYMGNPSIEQLQAWQEAAQGKLIKLALAPEREGVADFIKEATKQGVTIALGHSNATYEEAMAAVEAGASVWVHVYNGMRGFSHREPGMVGAAFDTPETIGELIADGHHVVPAACKVLIKQKMPQGVTLITDCMSAGGCPDGDYMLGELPVIVENGTARLKKGGNLAGSILQLKDGVKHVVDWGLVTVAQALQMATSVPAKSVGLENICGSLKAGLPADFIVLDDSLELQATYIDGCKGWEK

SEQ ID NO: 101991 - DNA, 1167 bp, Streptococcus thermophilus CNRZ1066
  CDS (1)..(1167): transl_table=11
ttgatgagaggtagtcctatgacttattatatttcagccaaacgtttttattttgatcataaggtcaaagaaggtggctacttggcggtcacagatggtcgttttggtaagtggacagaatatgtaccagagggtgcagaagtgctagattacagtgattatcagattgctcctggccttgtggacactcacattcatggctttgcggggtacgatgttatggataattctgaggaaagtcttctaggcatgagtcaagccttgctttcagcaggtgtgacttctttcttaccgacagcattgacagcgccatttgaagagctaaaagctatctgtcagacaacagcagagacggctggtaaggagcctggtgctaaaatccagggactcttctttgaaggaccgtatttcactgagatctataagggagcgcaaaatcctaaatacatgggcaacccaagtatcgaacagttgcaagcctggcaagaagcggctcaaggaaagttaatcaaattagccctggctcccgagcgtgaaggagtggctgactttattaaagaagcgactaaacaaggtgtaacgattgctttaggacactccaatgctacttatgaagaagccatggcagcagtggaagctggtgcttcagtctgggttcacgtctacaatggaatgcgtggctttagtcaccgtgagcctggtatggttggtgcagcctttgatactcctgagacgattggtgaactgattgcggatggtcatcacgtggttcctgcagcttgtaaggtactcatcaagcaaaaaacgcctcaaggagttacccttattacagattgtatgtcagcgggaggttgtcctgatggtgactatatgctaggtgagctccctgttattgtgaaaaatggtaccgctcgtcttaagaaaggtggtaacctagctggctctatcctacaactcaaagacggtgtcaaacatgtggttgattggggactcgtgacggttgctcaagccttacaaatggcaactagtattcctgctaaatcggttggactagaaaatatttgtggcagccttaaagctggtctcccagccgatttcatcgtcttagatgattccttggagttacaagcaacctatattgatgggtgtaaaggtggggagaagtaa

SEQ ID NO: 101992 - protein, 388 aa, Streptococcus thermophilus CNRZ1066
MMRGSPMTYYISAKRFYFDHKVKEGGYLAVTDGRFGKWTEYVPEGAEVLDYSDYQIAPGLVDTHIHGFAGYDVMDNSEESLLGMSQALLSAGVTSFLPTALTAPFEELKAICQTTAETAGKEPGAKIQGLFFEGPYFTEIYKGAQNPKYMGNPSIEQLQAWQEAAQGKLIKLALAPEREGVADFIKEATKQGVTIALGHSNATYEEAMAAVEAGASVWVHVYNGMRGFSHREPGMVGAAFDTPETIGELIADGHHVVPAACKVLIKQKTPQGVTLITDCMSAGGCPDGDYMLGELPVIVKNGTARLKKGGNLAGSILQLKDGVKHVVDWGLVTVAQALQMATSIPAKSVGLENICGSLKAGLPADFIVLDDSLELQATYIDGCKGGEK

SEQ ID NO: 101993 - DNA, 1203 bp, Geobacillus kaustophilus HTA426
  CDS (1)..(1203): transl_table=11
atgaagcggtggatattgaaaaatgccgaggtgtatgcagaaacaggaaacattgaacaagggtatgtgctgatcgaaggggaaaaagtggccgcgatcgggccgatgtcgtcatgcccaactgatgcaggggcggaagtgatcgagctttcctcacggttttccatcgtgccgggattcatcgacgtccatattcatggggcggctggggcggatgtcatggatgcgaccccggaggcgctttacaagatggccaacgccttgccggcggaagggacgacgagctttttggcgacgacgatgacagcgccaagcgaacaaatcgaagccgcgcttcgcaacgtcgctcgctatatggcggaggcgaacaggccgggagcggccgaagtgctcggtgttcatctggaaggaccgtttttgtcgccgaagcgcgccggagcgcagcacccgcgccatctcgccgatccggacatctcactgttccagcactggcaaaaggcggcgggcggccatatccgccttgtcacgcttgccccagagcggaacggggggctggaacttgccgcctacttgaaacagacgggtgtgatcgcttcgatcggccattccgatgccgtttacgacgaagtaaaagcggcggtccatgcaggggtgacgcatgcgacccacctgttcaatgggatgcgcggcatccatcaccgtgaaccgggtgtcgccggtgctgtgcttatgtttgaagaagtgatgtgcgagctgatcgccgacgggttgcacgttgcgccgccgatggtccgcttcgcttaccggaataaaggaagcgatgggctcatattaatcaccgatgccatgcgggcgaaatgtctaggtgatgggcggtatgaacttggcggccaagaggtgactgttcggggccaagaggcgcggcttgccgacggcacgctggcgggaagcgtgctcaagcttggcgaggccatccgccgtgtgctcgattatactggctgcacgcttgaagaggtgatccgcatggcgagctggaatccggcgaaacagcttggcttgcttgatcggaaaggcagcttgcggcccggcaaagacgccgatgtcgtcgttttgaatgaacgatatgaagtcatgatgacgttttgccgcggcgcccttgcctatcgcaagccggatgaaaggagtggagagcgatggccatga

SEQ ID NO: 101994 - protein, 400 aa, Geobacillus kaustophilus HTA426
MKRWILKNAEVYAETGNIEQGYVLIEGEKVAAIGPMSSCPTDAGAEVIELSSRFSIVPGFIDVHIHGAAGADVMDATPEALYKMANALPAEGTTSFLATTMTAPSEQIEAALRNVARYMAEANRPGAAEVLGVHLEGPFLSPKRAGAQHPRHLADPDISLFQHWQKAAGGHIRLVTLAPERNGGLELAAYLKQTGVIASIGHSDAVYDEVKAAVHAGVTHATHLFNGMRGIHHREPGVAGAVLMFEEVMCELIADGLHVAPPMVRFAYRNKGSDGLILITDAMRAKCLGDGRYELGGQEVTVRGQEARLADGTLAGSVLKLGEAIRRVLDYTGCTLEEVIRMASWNPAKQLGLLDRKGSLRPGKDADVVVLNERYEVMMTFCRGALAYRKPDERSGERWP

SEQ ID NO: 101995 - DNA, 1155 bp, Salmonella enterica subsp. enterica serovar Paratyphi A str. ATCC
  CDS (1)..(1155): transl_table=11
atgtatgctttaacccagggccggatctttaccggtcacgaaattcttgatgaccatgcgcttgttgtcgctaatggcctgattgaccgcgtttgtccgatggccgaactgccaccgggaatagaacaacgctcattgaatggggccattctctcccccggttttattgatgtgcagttaaacggctgcggcggcgtgcagtttaacgataccgcagaagccgtcagcgttgaaacgctggaaattatgcagaaagccaatgaaaaatcgggctgtactaactttctgccaacgcttatcactaccagcgatgaattgatgaaacagggcattcgcgtcatgcgcgaatacctggaaaaacatccgcaccaggcgctgggtctccacctggaaggcccctggcttaatctggtaaaaaaaggcacccataatcctgatttcgtgcgtaaaccagacgctgcgctggtcgatttcttatgcgataatgccgacgtcatcaccaaagtcactctcgcgccggaaatggtgcctgctgacgtaatcgctaaactggcgaatgcgggcattgtggtttccgcaggtcactccaacgcgacgttaaaagaggcgaaagcgggcttccgcgccgggattacttttgcgactcacctgtttaacgcgatgccgtacattacagggcgtgagccgggccttgctggcgctgttctggacgaagcggatatttattgcggcgttatcgccgatggtctgcatgtcgactacgccaacattcgcaatgccaaacgcctgaaaggcgacaaactttgtctggtgacagacgccaccgcaccggcgggggccaatattgagcagttcattttcgcaggtaaaacaatatactaccgcaatgggctgtgtgtggatgaaaacggtacgttgagcggttcgtccttaaccatgattgaaggcgtacgcaacctggtcgcgcattgcggcatcgcgctggatgaagtgctgcgcatggcaacgctctatccggcacgcgctatcggcgttgataaacatctcggtagcattgcgccgggtaaagtcgccaacctgaccgcgttcacccacgattttaaaattatcaagaccatcgttaatggtgacgaggtcgttgacttgagtaagtga

SEQ ID NO: 101996 - protein, 384 aa, Salmonella enterica subsp. enterica serovar Paratyphi A str. ATCC
MYALTQGRIFTGHEILDDHALVVANGLIDRVCPMAELPPGIEQRSLNGAILSPGFIDVQLNGCGGVQFNDTAEAVSVETLEIMQKANEKSGCTNFLPTLITTSDELMKQGIRVMREYLEKHPHQALGLHLEGPWLNLVKKGTHNPDFVRKPDAALVDFLCDNADVITKVTLAPEMVPADVIAKLANAGIVVSAGHSNATLKEAKAGFRAGITFATHLFNAMPYITGREPGLAGAVLDEADIYCGVIADGLHVDYANIRNAKRLKGDKLCLVTDATAPAGANIEQFIFAGKTIYYRNGLCVDENGTLSGSSLTMIEGVRNLVAHCGIALDEVLRMATLYPARAIGVDKHLGSIAPGKVANLTAFTHDFKIIKTIVNGDEVVDLSK

SEQ ID NO: 101997 - DNA, 1146 bp, Zymomonas mobilis subsp. mobilis ZM4
  CDS (1)..(1146): transl_table=11
atgcagcttgcctttacgcacggacaaatcgttacaccaaatacgatattgaccgatcacagtctgttaatcgaaaatggcgtgataaaagccattaccgatcaaccgctgccttgcgatattccaaccatagacctgcatcatcagatccttttggcaggctttattgatattcaggttaacggcggtggcggctgcctttttaacgatcatcctgatgtaaactctatttcgaaaattgcggcggcacatcgtgcttttggcaccacatctttactacccactttggtcagtgaagagacgacagtgatcgaaaaatccgttcatgccattgaagacgctattcaggctggcattaagggcattgtcggccttcatatcgaagggccttttattgcaatgacgcggcgtggcatccatgcagccagcaaaattcgtccgatcagtgaagaagatatcaacttcttatgcgacagcgcccgaaagaataaagataatttccgaattctcctgaccttggcaccggaaacaatggatgcctcaatcatcaccaagctgacagaggctggagtgattgtttctatcggtcattcggacagtgattacgaaaccgccatgaaagcggtcaaggctggcgtaagcggctttacccatttatttaatgccatgtctcaaaataccagccgtgcgcctgccattgtcggtgccgccttggatagcgataacagctatgcgggcattattgctgatggggaacatgtccatccgtcaaatatccgtcttgcttacaaggcaaagggcgctgaccatttaatgttgataaccgatgctatgcccttaacgggatgggaagaagatcatttcctgttgcagggacagatgatctatcgccgcgatggccggattaccgatgataaaaacgtgctggcaggttctctgctcgatacggcaacggcttttgccaatatgatcaaaatgacggatatttccttggttgaggcctctcgcatggcctctctgactccagcccgttttctgggactgcaagatcgcggcagtatagaaatcgggaaaagagctgatctcgttgttatggatgaagcgctaaaactgcaatccgtctggatatccggcgaaaaatactag

SEQ ID NO: 101998 - protein, 381 aa, Zymomonas mobilis subsp. mobilis ZM4
MQLAFTHGQIVTPNTILTDHSLLIENGVIKAITDQPLPCDIPTIDLHHQILLAGFIDIQVNGGGGCLFNDHPDVNSISKIAAAHRAFGTTSLLPTLVSEETTVIEKSVHAIEDAIQAGIKGIVGLHIEGPFIAMTRRGIHAASKIRPISEEDINFLCDSARKNKDNFRILLTLAPETMDASIITKLTEAGVIVSIGHSDSDYETAMKAVKAGVSGFTHLFNAMSQNTSRAPAIVGAALDSDNSYAGIIADGEHVHPSNIRLAYKAKGADHLMLITDAMPLTGWEEDHFLLQGQMIYRRDGRITDDKNVLAGSLLDTATAFANMIKMTDISLVEASRMASLTPARFLGLQDRGSIEIGKRADLVVMDEALKLQSVWISGEKY

SEQ ID NO: 101999 - DNA, 1146 bp, Silicibacter pomeroyi DSS-3
  CDS (1)..(1146): transl_table=11
atgacgcttgccctgtccggtgcccgcatcctgacgcctgaaggcgcggtcgaggggcatgcgctgctgatcgaggctggtcgtattcaggggatcgcgcccctgggcgagatcccggccaaggcccggcatctgcggttgcaggggggctggctggcacccggttttgtcgatctgcaggtgaatggcggcggcggggtgatgctgaacaacgcgcccagactcgacagcctgcgcaagatgtcggaggcccatgcaaggatcggagcgaccaccatcctgccaacgctgatcaccgatgcgcccgaggtggtggctgcggcgatttcggcggtcgaggcagcgatttcctctggcgtgccgggcattgcgggcctgcatctggaggggccgcatctggcgccctctcgcaagggcgcccatgatccggcgctgatccgcccaatggatgacgaggatctggccacactgctggaagcggcgcgccgcctgccgctgctcaaggtcacgctggccactgaaagtgctacgcccgagcagatccgggcgctgagtggggccggggtgctggtctcgctggggcacacggatgccagtttcgcggattgccgtgctgccgccgaggccggggcggcctgtgtcacccatctgttcaacgcgcaaagccagatgggtaatcgcgagccgggcgtggtcggggcggcgctggcgctggggaccttgtcggcggggatcatcgccgatggcatccatgtgcaccccgtctcgctgcgcaatgcgatccgtgccaagaccgggccgggtcgggtgtttctggtcagcgattcgatggcgaccgccggatccgatatcgccgcctttacgctcaacgggcgcgaaatccggcgcagcggcgaccggctgacattggctgacggcacgctggcgggggcacatctggaactggcgcaggcgctgtgcaatgtggtggagatggccgggctggatgtgggcgaggcggtgagcatggccacgcgctatcccgccgatctgatcgggcggtccgatctgggccggatcgccatcggtgcgcgggccgatctggtgcatctggacgaggacctgtgtctgcgccgggtgtggcgggacggtctggacctcgagtga

SEQ ID NO: 102000 - protein, 381 aa, Silicibacter pomeroyi DSS-3
MTLALSGARILTPEGAVEGHALLIEAGRIQGIAPLGEIPAKARHLRLQGGWLAPGFVDLQVNGGGGVMLNNAPRLDSLRKMSEAHARIGATTILPTLITDAPEVVAAAISAVEAAISSGVPGIAGLHLEGPHLAPSRKGAHDPALIRPMDDEDLATLLEAARRLPLLKVTLATESATPEQIRALSGAGVLVSLGHTDASFADCRAAAEAGAACVTHLFNAQSQMGNREPGVVGAALALGTLSAGIIADGIHVHPVSLRNAIRAKTGPGRVFLVSDSMATAGSDIAAFTLNGREIRRSGDRLTLADGTLAGAHLELAQALCNVVEMAGLDVGEAVSMATRYPADLIGRSDLGRIAIGARADLVHLDEDLCLRRVWRDGLDLE

SEQ ID NO: 102001 - DNA, 1134 bp, Francisella tularensis subsp. tularensis SCHU S4
  CDS (1)..(1134): transl_table=11
atgcaaagctatattctaaaaggtggcaaaatttatagccaaaatgattttgaaactaaggatattgtagttaaagataatgttattagtgatatagttgatggtgctaagccagcagcttttaatttacctattattgagctaagtggtgatgattatgtgatacctggttttatcgatatccatatccatggttcaaaaggtgctgatgttatggatggagatgttgatgccttagctgtaatctctaaatcactatatacacaaggagtaactagctatcttgcgaccacaatgacagcagcaaatgagcaaatactcaaagcaatgcgtgctatcaaagattataattctcaaacccacttggatagtgcaaaaattgttggtgttcatctagaggggccatttatatcaccaggtaagattggtgcacaaaatcccaattacctccaagaagcagatgttactaaaatggcaagttggcataatgcttgtgatagtttaatcaaaaaaatcactattgccccagagattaagaatgctaataaagtaatcgagttttgtaattctaaaaatataattagttcaataggtcatactagctgtacaatggctcaagctctaaatgcgatagagcagggttgtacacatgcgacacatctatttaatgcaatgagtccgattgaacatcgcaatcctggtgcggcaacagcgttattaatgtcaaaaaaagttttagcagagctaatagttgatggtattcatctacatcctgatatggttaagtttacctatgcgataaaaggtagtgataaaatcgcactaatcactgatgcgatgtctgctcaaagtgctggtgaaggtgtatttgaattaggtggtcagaaagtcatagttaaagatggtcaggcaaggttagagaatggtgtgcttgcaggaagtgtcttgacaatgaataaggcactagagaatgttttgaaatttacaaattgtagtctctatgatgctgtgaaaatgacaagtacaaatcaagctaagtcattagggtttaaaaaaggtcaaatcaaaggaggctttgatgctgagtttgtaattctcaataaaaattatcaagttaaacaagttattggttag

SEQ ID NO: 102002 - protein, 377 aa, Francisella tularensis subsp. tularensis SCHU S4
MQSYILKGGKIYSQNDFETKDIVVKDNVISDIVDGAKPAAFNLPIIELSGDDYVIPGFIDIHIHGSKGADVMDGDVDALAVISKSLYTQGVTSYLATTMTAANEQILKAMRAIKDYNSQTHLDSAKIVGVHLEGPFISPGKIGAQNPNYLQEADVTKMASWHNACDSLIKKITIAPEIKNANKVIEFCNSKNIISSIGHTSCTMAQALNAIEQGCTHATHLFNAMSPIEHRNPGAATALLMSKKVLAELIVDGIHLHPDMVKFTYAIKGSDKIALITDAMSAQSAGEGVFELGGQKVIVKDGQARLENGVLAGSVLTMNKALENVLKFTNCSLYDAVKMTSTNQAKSLGFKKGQIKGGFDAEFVILNKNYQVKQVIG

SEQ ID NO: 102003 - DNA, 1218 bp, Synechococcus elongatus PCC 6301
  CDS (1)..(1218): transl_table=11
atgatgaccgctgctcctaccctgctgacgaatattcgcattccgggctgtgcagaggttcagcgtctctggcttgatgctgccggtattgtgcagtcgattgagccgatgtcgcaaaccttcgatcgcctgccgcctccccaactgcgaatgattgacctgcagggcgactggctctctctgggcggcattgacctgcaaatcaatggggcactggggctggcctttcctgaagtgcaagccagcgatcgcaatcgcctcttagccatttgccgccggctctgggaacagggtgttgatgcttttaccccaaccttagtcaccagctcgatcgcacagtttcggcaggccattgaggcaatcgcggacttcgtggcgcagcccttgccaccccgccacgccaaaattttgggactccatctggaagggccttgccttgcagaatctaagcgcggcgctcacccacaggagcatttgcaaccgctgacggtcgaagttctatcggagatctgtggcgatcacttggcgcaaattcggattgtcaccctcgcaccggagttggatcccacaggggaagcgatcgcttggctgcgtcagcagggtgtgattgtcagcttggggcattcccaagccacagcagagcaggcccaagtcgcttttcagcagggcgcaaccatggtaacccacgcctttaatgccatgccgcccttgcatcatcgtcagcccgggctgttgggcgcagcattgactacggacaccgtgtttgcgggattgattgcggatggtcagcacatcgatccaattatgctgaaattgttgctgcgagccggtgagggcgatcgccgattgtttctggtcagcgatgccttagctcccttgggcttacccgacggtcagtatccctgggacgaacgacaaatcacagtcaccgccggcacttgtcgactcgaagatggcaccctcgccggcaccaccctgccgctactggcaggggttcaaaatttggtgcgctggcaggtctgtgaaccggaaaccgcgatcatgctggcgaccctagcacctctgcgggccttgggggtggattggtcggatccgcgtcttctctatttgtcccgtcccgtctgtcagctgctgcgctggcaccagtccgacacgggagaactgacttggcagaggctctgcgaaaacgacgaattaccgactcctacgtcgatctag

SEQ ID NO: 102004 - protein, 405 aa, Synechococcus elongatus PCC 6301
MMTAAPTLLTNIRIPGCAEVQRLWLDAAGIVQSIEPMSQTFDRLPPPQLRMIDLQGDWLSLGGIDLQINGALGLAFPEVQASDRNRLLAICRRLWEQGVDAFTPTLVTSSIAQFRQAIEAIADFVAQPLPPRHAKILGLHLEGPCLAESKRGAHPQEHLQPLTVEVLSEICGDHLAQIRIVTLAPELDPTGEAIAWLRQQGVIVSLGHSQATAEQAQVAFQQGATMVTHAFNAMPPLHHRQPGLLGAALTTDTVFAGLIADGQHIDPIMLKLLLRAGEGDRRLFLVSDALAPLGLPDGQYPWDERQITVTAGTCRLEDGTLAGTTLPLLAGVQNLVRWQVCEPETAIMLATLAPLRALGVDWSDPRLLYLSRPVCQLLRWHQSDTGELTWQRLCENDELPTPTSI

SEQ ID NO: 102005 - DNA, 1188 bp, Bacillus clausii KSM-K16
  CDS (1)..(1188): transl_table=11
atggcaagtatcgttgtaacaggggggcagttgatcacaggggaaccagggtgtcgtaaatacgagaaaggttttcttgcaatcgacaatggcaaaattaccgcggtcggtgttggcgacggcgccgattataagaataaagatacagtccagataacggttccagctgatgccgttgttgtcccaggctttgttgacgtgcacatacatggcggctatggtgccgatgtaatggaccgtacaaaggatgcgttgcaaacaatggcagcaaacttgccagccgaagggacgaccgcttttcttgcgacaaccattacccaaaaacatgaggacattgaagctgcgattgaaaatgtagtcgcttatagacgggcggataaagaagcagagattgtcggcctacatattgaagggccttttattaatgaaacgaaaaaaggcgcacagcctctcgagtacattgtagaaccatccgtaccaatcatgaaaaaatggatcgatttagcaaaaggcatgattaaacaagtaacctacgcaccggaaaaacgaaatggaagtgagttggcagcctatttgcgttcagaaggtgcgaatccgtcaattggccattcagatgctgtctatactgaaatggagcaagctgtcgcagcaggtgcaaaccaagttacgcatatgtacaatggcatgcgtcctttgcatcatcgtgaaccaggtgtagctggtggggcgctcctccttgatgaactcgacattgaattgattgtagacggcattcacatccatccagaaatggtgaagctggcctggaaagcaaagggcacagaccaatgtctacttattactgactcgatgagggcaaaagggttgcctgacggtgcttatgatttagggggacaggacgtttctgttaacggtggaagagcgacgctttctgatggcacgctcgccggttctgttttgcaaatgaacaaggcggtagcaaatatggttgcttatactggctgctcattggaacaagcggtgcaaatggcttcctacaacccagcgaaaaaaattggcattgacgcgaaaaaagggtcattggtgcctgggaaagatggcgattttactgtgctcacgaaagagggcgacgtgttgtacacctactgtttagggaaaaaagcatatggcaaggaggatgacgtatga

SEQ ID NO: 102006 - protein, 395 aa, Bacillus clausii KSM-K16
MASIVVTGGQLITGEPGCRKYEKGFLAIDNGKITAVGVGDGADYKNKDTVQITVPADAVVVPGFVDVHIHGGYGADVMDRTKDALQTMAANLPAEGTTAFLATTITQKHEDIEAAIENVVAYRRADKEAEIVGLHIEGPFINETKKGAQPLEYIVEPSVPIMKKWIDLAKGMIKQVTYAPEKRNGSELAAYLRSEGANPSIGHSDAVYTEMEQAVAAGANQVTHMYNGMRPLHHREPGVAGGALLLDELDIELIVDGIHIHPEMVKLAWKAKGTDQCLLITDSMRAKGLPDGAYDLGGQDVSVNGGRATLSDGTLAGSVLQMNKAVANMVAYTGCSLEQAVQMASYNPAKKIGIDAKKGSLVPGKDGDFTVLTKEGDVLYTYCLGKKAYGKEDDV

SEQ ID NO: 102007 - DNA, 1182 bp, Staphylococcus aureus subsp. aureus COL
  CDS (1)..(1182): transl_table=11
gtgtcagaattaattatatataacggcaaagtttatactgaagatggcaaaatcgataatggttacattcatgtgaaagatggacagattgttgcaattggagaagtggatgataaagcagcaattgataatgatacgacaaataaaattcaagtgattgatgctaaaggtcatcatgtattaccaggttttattgatatacatattcatggtggttatggtcaagatgcaatggatgggtcatacgatggcttaaaatatctatccgaaaatttgttgtctgaagggacgacatcatacttggccactacaatgacgcaatcgactgataaaatagataatgcacttacaaatattgctaaatatgaagcggagcaagatgttcacaatgcagcggaaattgtaggtatacatttagaaggaccatttatatctgaaaataaagttggtgctcaacatccgcaatacgttgtacgcccatttatcgataaaattaaacattttcaagagactgctaacggattaataaagattatgacgtttgcacctgaagttgaaggtgcaaaagaagcgcttgaaacgtataaagatgacattattttttcaattggtcatacagtagcaacatacgaagaagcagttgaagctgttgagcgaggagctaaacatgtcacgcatttatataatgcagcgacgccattccaacatagagaaccaggtgtttttggagcagcatggttgaatgatgctctacataccgaaatgattgttgatggcactcattctcatccggcatcggttgcaattgcttaccgtatgaaaggtaatgaacgtttttatttaattaccgatgcaatgcgtgcaaaaggtatgcctgaaggagaatatgatttgggtggacaaaaagtaactgttcaatcgcaacaagcacgtcttgcaaatggtgcgcttgctggtagtattttaaaaatgaatcatgggttacgtaacttaatatcatttacaggtgatacattagatcatttatggcgagtaacaagtttaaatcaagccattgcattaggtatcgatgatagaaaaggtagtattaaagtaaataaggatgcagatcttgttattctagatgatgatatgaatgtaaaatctacaataaaacaaggcaaggttcacacatttagctaa

SEQ ID NO: 102008 - protein, 393 aa, Staphylococcus aureus subsp. aureus COL
MSELIIYNGKVYTEDGKIDNGYIHVKDGQIVAIGEVDDKAAIDNDTTNKIQVIDAKGHHVLPGFIDIHIHGGYGQDAMDGSYDGLKYLSENLLSEGTTSYLATTMTQSTDKIDNALTNIAKYEAEQDVHNAAEIVGIHLEGPFISENKVGAQHPQYVVRPFIDKIKHFQETANGLIKIMTFAPEVEGAKEALETYKDDIIFSIGHTVATYEEAVEAVERGAKHVTHLYNAATPFQHREPGVFGAAWLNDALHTEMIVDGTHSHPASVAIAYRMKGNERFYLITDAMRAKGMPEGEYDLGGQKVTVQSQQARLANGALAGSILKMNHGLRNLISFTGDTLDHLWRVTSLNQAIALGIDDRKGSIKVNKDADLVILDDDMNVKSTIKQGKVHTFS

SEQ ID NO: 102009 - DNA, 1173 bp, Staphylococcus epidermidis RP62A
  CDS (1)..(1173): transl_table=11
atgtcagaatatgttttaacgaatggcatcgtatatacagaaaatgaaatgattaacaatggatatgttcatattaaagatgggaaaattttagacgttggtaagtgtccttttcatccgtcatcgtcgcataatacaattgacattattgatgtaaaaaaacgacatatactgccaggatttatagatattcacatccatggggggtatggtgaagatgccatggatgcatctgaacaaggcttacaacatttagcagaatcactcctttctgaggggacaacatcttttttagcaacaacaatgacacagtcaacagtcaatattgagcgagcacttcaaactattgctaaatatactcaacaacaagatgttacaaatgctgccgaaattgtgggagtacatcttgaaggtccatttatttcagaacataaagtaggcgcacaacatcctcaattcgtacaacgtcctacggttgataaaataaagtcgtttcaggaagtagcgaatggactaattaagattattacgtacgctcctgaagttgatggagcaacagaaacgttaaagacaatgaaaaatgatatcattttttcaatcggacatacggtggcaacgtttgatcaagcgaatacagctgtgagtcatggtgccaaacacatcactcatttgtataatgcagcgaccggctttcaacatagagaaccaggtgtatttggtgcagcctggttaaatcaagggttgcatactgaaatgattgtggatggtgttcattcacatcctgcatccatcgcacttgcatatagacttaaggggaatcaaagctgttatttaattacagatgcgatgagagctaaaggaatgccagaaggacattatgatttaggtggtcaggatgtgattgtaaagggaagtgaagcacgcctgtcttctggggctttagctggaagtatactcaaaatgaacgaaggacttaaaaatttaatacaatttacaggtgacacgattgagcatttatggagagtaacaagtttaaatcaagcgataacattaggtatagacgacataaaaggtagtattaaaatcgggaaagatgcagatattgttatcatagatgatgcatgtaatgttgaaacgacgattaaaaatggaaaatatcatgctttcaaatga

SEQ ID NO: 102010 - protein, 390 aa, Staphylococcus epidermidis RP62A
MSEYVLTNGIVYTENEMINNGYVHIKDGKILDVGKCPFHPSSSHNTIDIIDVKKRHILPGFIDIHIHGGYGEDAMDASEQGLQHLAESLLSEGTTSFLATTMTQSTVNIERALQTIAKYTQQQDVTNAAEIVGVHLEGPFISEHKVGAQHPQFVQRPTVDKIKSFQEVANGLIKIITYAPEVDGATETLKTMKNDIIFSIGHTVATFDQANTAVSHGAKHITHLYNAATGFQHREPGVFGAAWLNQGLHTEMIVDGVHSHPASIALAYRLKGNQSCYLITDAMRAKGMPEGHYDLGGQDVIVKGSEARLSSGALAGSILKMNEGLKNLIQFTGDTIEHLWRVTSLNQAITLGIDDIKGSIKIGKDADIVIIDDACNVETTIKNGKYHAFK

SEQ ID NO: 102011 - DNA, 1107 bp, Gluconobacter oxydans 621H
  CDS (1)..(1107): transl_table=11
atgtcccatttggatggcaggatcgtcctgcatgaccacgtcgtatccgggcgcgtcagttttgacagccatatccgcgacatcactcccctgtcccaggcggcagaacgctacatcctgcccggtttcattgatggtcatgtccatggtggtggtggcgctgacacgatggatggcgtagctgccatcgaaactctctcccgtttccatctgcggcacggcactacgaccatcctgcccaccacaatcacggccccgtggccagaggtcatggatgcccttcgggccgtggcggatgtctgtgaccggggcgtacaaaatggcccccgcattcatggcgcgcatctggaagggccttttgtcagcccccacaaactgggagcacagccgccgttcaatatcgaaccgacagccgaccgcgtggccgaagcaatcgcgaccggctgcgtccgcgtcgtgacgattgcgccggaactcgaacactccgccactgccatgcaaacctttgcccatgcaggcatcagggtcagcctgggacatactaccacggaccatgccggtgcggagcgcgccatctgtctggtctgtgcggccggcggaacggtgggggcgacccatctgttcaacgccatgtctcctatcgaggggcgtcgtcccggtccggtcacagccctgatgtgcagcgatgtggcgtatggagagatgatcttcgatacgcatcatgttcatcccgccagcttccgtctggcagagcgcatgatgggaaaccggctgctgttcgtaacggacgccatgcgcggcacgggcgaacccgatggccccagccagcttggggggcaggatgtgctgatccgggacggcgtggtgcgtcttccggacggcacactcgccgggagtgttctgactctcgaccaggccctgcgtaatgccgttaatgccggcatgtccctgccaaaagccgcgcgtctggtgagcacgaatgccgcaacctatcttggccttcatgaccgtggcgccattgcgccagatctgctggctgatttcacggttcttgataaaagacttcaggtcatcgaagtctgggtcaacggcgaacgccgggcatga

SEQ ID NO: 102012 - protein, 368 aa, Gluconobacter oxydans 621H
MSHLDGRIVLHDHVVSGRVSFDSHIRDITPLSQAAERYILPGFIDGHVHGGGGADTMDGVAAIETLSRFHLRHGTTTILPTTITAPWPEVMDALRAVADVCDRGVQNGPRIHGAHLEGPFVSPHKLGAQPPFNIEPTADRVAEAIATGCVRVVTIAPELEHSATAMQTFAHAGIRVSLGHTTTDHAGAERAICLVCAAGGTVGATHLFNAMSPIEGRRPGPVTALMCSDVAYGEMIFDTHHVHPASFRLAERMMGNRLLFVTDAMRGTGEPDGPSQLGGQDVLIRDGVVRLPDGTLAGSVLTLDQALRNAVNAGMSLPKAARLVSTNAATYLGLHDRGAIAPDLLADFTVLDKRLQVIEVWVNGERRA

SEQ ID NO: 102013 - DNA, 1155 bp, Lactobacillus acidophilus NCFM
  CDS (1)..(1155): transl_table=11
atgacttattacattcatgcagataaatttttcctagaaaatagaactgaaaatgggggctatcttgaagttcaagatgatggtaaatttggctttttctatcctgaaactaaaaagccagaaggaaaaatcctcgactacaaaggtaagtgggttgcaccaggcttagttgatacgcatattcatggctctcttcgtgaagatgtaatgaagagtgactgggaaggaatcgataaaatttctcaaggtttgcttagtgcaggtgtaacttcatggcttccaactacaattacggctgatagtgatactttaactagaatttgtaagatgtttgcagatcaccaaggtcaagaaactggggcaaaaattcaaggaattcactttgaaggcccattctttactgaagagcatgccggtgctgaaaatcctaaatatatgatggatccggatattaatgtctttaacaaatggcgtgatgtttcgaatggcatgctttgcaagatttctatggcacctgaaagaaaaggttctaaagaatttattcgtgaagctgtaaaagaaggcgtagttattgcattgggtcactcaagtgccacttttgaagaagctgtcgaaggtgttgaagcaggtgcaacgatgtttacgcatacttttaacgggatgccagatccaagtcatcatacgccatcaatttcaaatgctgcaatggccttgaataatgtaactgatgaattaatttgtgacggccaccacgttcaaccatcaatggctaaagcattaattaatgcagttggtccagagcacattgctttgattactgactgtatggaagccgggatgatgccagacggcgactacatgttaggggaacttccagtttatgtaaaagatggtatggctcgccttaaggatggcgataatttagcaggttcaattttgcaattaaaacaagcaattaagaatgttgttgattggaatattgtaactccagaaaaagctgtgctgatggctagttacgttcctgctaagagtgctcatattttgaataagtgcggtactattgcacctgacaaggatgctgatttcttaatcttgaatccagatatgacgcttagtgagacttacatgaatggtgaatcaagatacaaagcttaa

SEQ ID NO: 102014 - protein, 384 aa, Lactobacillus acidophilus NCFM
MTYYIHADKFFLENRTENGGYLEVQDDGKFGFFYPETKKPEGKILDYKGKWVAPGLVDTHIHGSLREDVMKSDWEGIDKISQGLLSAGVTSWLPTTITADSDTLTRICKMFADHQGQETGAKIQGIHFEGPFFTEEHAGAENPKYMMDPDINVFNKWRDVSNGMLCKISMAPERKGSKEFIREAVKEGVVIALGHSSATFEEAVEGVEAGATMFTHTFNGMPDPSHHTPSISNAAMALNNVTDELICDGHHVQPSMAKALINAVGPEHIALITDCMEAGMMPDGDYMLGELPVYVKDGMARLKDGDNLAGSILQLKQAIKNVVDWNIVTPEKAVLMASYVPAKSAHILNKCGTIAPDKDADFLILNPDMTLSETYMNGESRYKA

SEQ ID NO: 102015 - DNA, 1161 bp, Xanthomonas oryzae pv. oryzae KACC10331
  CDS (1)..(1161): transl_table=11
ttgaacatggatgcttcccgcactcaggcattgtgcaatgcgcgtgtactcaccgatgacggcctgcaggacggcctggtcgtggtgctggctggcacgcagatccaggcgattgtgccggccgatgatgcacgcgttgcgcaggccgccacgcgcgtggatctgggtggcgccaccttgttgccaggctttatcgacatccaggtcaacggcggcggtggcgtattgttcaacaacgcacgcgacccgcaggcgctggcgaccatcgccgccgcgcatcgtcgtttcggcaccaccggcatgctgccgaccttgatcagcgataccgcgcaggtgatggccgaagcgatcgaggccacccgcgcagccatcgcgcaaggcgtgcccggcgtgctcggcatccatctggaaggcccgtacctgagccctgcacgcaagggcacgcatgacgaacacaagttccggctgccggacgcgcacgaaattgccgtcgacacatcgctggacaacggcgtcaccttgatcacgctcgcacccgagcgcgtgccgctggacgatatccgtgccttcgttgccggcggcgcgatcgtgttcgctggccacaccgcggcgacttacgagcaggcacgcgacggcatcgctgccggggtgagcggcttcacgcacgtgtacaacgcgatgtcgcaactggctggccgcgaacccaatgcagtcggcgcagcgctggaagaccccaacgtgtggtgcggcgtcatcgtcgatggcgtgcatgtgcacccggccagcctgcgcgtggcgctcgcggccaagccacgcggcaagctgttgctggtcaccgacgccatgcccatggtcggcagcgacagccccggcttcgacctgtacggcgaaaccatcaccgccttggatggcgtggtgcgcaatgccgacggcgcactggccggttcggcattggacatggccaccgccgtgcgcaacagcgtgcgctggctcggtgtggacctggccgaagccgcgcgcatggcctcgacgtatccggcgcaatgtatcggccttggcgaacgtctcggccgcattgcgccaggctaccaggccgacctagtgctggtggatgccgacgtgcaggtgctgggcacctggatcgctgggcagcgcgactaa

SEQ ID NO: 102016 - protein, 386 aa, Xanthomonas oryzae pv. oryzae KACC10331
MNMDASRTQALCNARVLTDDGLQDGLVVVLAGTQIQAIVPADDARVAQAATRVDLGGATLLPGFIDIQVNGGGGVLFNNARDPQALATIAAAHRRFGTTGMLPTLISDTAQVMAEAIEATRAAIAQGVPGVLGIHLEGPYLSPARKGTHDEHKFRLPDAHEIAVDTSLDNGVTLITLAPERVPLDDIRAFVAGGAIVFAGHTAATYEQARDGIAAGVSGFTHVYNAMSQLAGREPNAVGAALEDPNVWCGVIVDGVHVHPASLRVALAAKPRGKLLLVTDAMPMVGSDSPGFDLYGETITALDGVVRNADGALAGSALDMATAVRNSVRWLGVDLAEAARMASTYPAQCIGLGERLGRIAPGYQADLVLVDADVQVLGTWIAGQRD

SEQ ID NO: 102017 - DNA, 1161 bp, Vibrio fischeri ES114
  CDS (1)..(1161): transl_table=11
atgaacagtacaaatgctcaaaataatcagtatatgattaccaatgttgatgtatttaatggtcaaaaaatagaagaaaaacaggctattattatcaataacgattcaatttcatccataatttcaatgaaagaagctgactctttaactctagatcgcattgatggagagggtgcattagcaaccgcaggttttattgatattcaacttaatggttgtggtggtgtgttactcaatactgatatagcgctttcaacattagaaacgatgaataaaaccaacgtaaaatacggaacaactcaatacttaccaaccttaattaccagtactgaactcgaccttcataatacattgtcaatgatgaccaattttgagaatgcagaacaggaaggtgtattaggacttcaccttgaaggacctttcatcagtattgagaaaaaaggcgctcaccaagcacaatacattcgtgaactagatttaaataccgctcagctgcttgcacaacatcgtgaccaaataaaagtcattacacttgctccagaacacatcaaacaagacgttctagattgcttaacagcagctgggattacggtttcaattggacataccaacgccacttatgatcaagtaaacgcccgtactggtttcactatggctacgcatttatataatgcaatgacacctcttggttcaagagaaccaggtgtggttggttatattttcgataaaaaacctcatgcaggtattattgtagatggcattcatgcttcttacccatcagttaaaattgctcacgaacaactaaaagaaaaactctttttggttaccgatgcagtcactcctgcgggaacggatttaacagagtttgatatggcaggaacgcctgcttatgtgaccgatggaaaatgtcactataaagatggcaccattgcaggcgcagccattactatgattgatggggtacgtaacttaattagtcatgtgggtttatcaaaagaagaagccttaagaatggcaagcttatacccagcccaagcgttgaaaatagacaatgaatacggtcaattaaaagaaaactacaaagcaaacattactcttattgacagtaataatgacattacaacaacgattcaaatgggtaaattggtttatcagaaataa

SEQ ID NO: 102018 - protein, 386 aa, Vibrio fischeri ES114
MNSTNAQNNQYMITNVDVFNGQKIEEKQAIIINNDSISSIISMKEADSLTLDRIDGEGALATAGFIDIQLNGCGGVLLNTDIALSTLETMNKTNVKYGTTQYLPTLITSTELDLHNTLSMMTNFENAEQEGVLGLHLEGPFISIEKKGAHQAQYIRELDLNTAQLLAQHRDQIKVITLAPEHIKQDVLDCLTAAGITVSIGHTNATYDQVNARTGFTMATHLYNAMTPLGSREPGVVGYIFDKKPHAGIIVDGIHASYPSVKIAHEQLKEKLFLVTDAVTPAGTDLTEFDMAGTPAYVTDGKCHYKDGTIAGAAITMIDGVRNLISHVGLSKEEALRMASLYPAQALKIDNEYGQLKENYKANITLIDSNNDITTTIQMGKLVYQK

SEQ ID NO: 102019 - DNA, 1137 bp, Vibrio fischeri ES114
  CDS (1)..(1137): transl_table=11
atgtatgcgctaactaactgtaaagtttatacaggtaacgatgttcttactgatcattcagtaatcattaatggaacagagattgaagctgtttgcccaacatcagaactaccagctggtattgagctaaaagacttagatggagcgattctaagcccaggctttatcgatcttcagcttaatggttgtggcggcgtaatgcttaatgatgaaattacagcagaaaccatgcaaattatgcatgaagcaaacctaaaatctggctgtactagcttcttaccaacattgattacttcttctgatgaagatatgcgtgcggcaatcgaagcagctcgtgaataccacagcaaatatcaaaaccaatctttaggtttgcacctagaaggtccatacctaaacgtaatgaaaaaaggcattcacagcgttgatcatatccgtacgtcagattcagacatgatccaacttatgtgcgataacgcagacctaatcgcaaaagtaacgctagcgccagagcaaaatgatcctgagcatatcgagcgccttcataaagcaggtatcgtggtatctattggccacacaaacgcaacttatgctgaagctcgtcaaggatttgagtcaggtatcactttcgcaactcacttgtttaatgcaatgacgcctatggttggtcgtgaacctggtgttgtgggtgcaatttatgatactccagacgtttatgctggcatcattgctgatggtttccatgttgactatgcaaacatccgtattgcacacaaaataaagaaagaaaaactagtattagtgaccgatgccacagctcctgcaggtgctgacatggaatactttatttttgtgggtaagaaagtatattacaaggatggcaaatgtgttgatgaaaatggcacattaggtggctcagctctgactatgattgaagcagttcagaatacagttgagcacgttggaatcgctttagacgaagcactacgcatggcgactttatatccagctcaagctatgggcttagataataaacttggccgcattaaaaagaacatggttgctaaccttgctatttttgatcgtgacttcaatgtaaaagcgactgttgtgaacggacaatacgagcaaagttaa

SEQ ID NO: 102020 - protein, 378 aa, Vibrio fischeri ES114
MYALTNCKVYTGNDVLTDHSVIINGTEIEAVCPTSELPAGIELKDLDGAILSPGFIDLQLNGCGGVMLNDEITAETMQIMHEANLKSGCTSFLPTLITSSDEDMRAAIEAAREYHSKYQNQSLGLHLEGPYLNVMKKGIHSVDHIRTSDSDMIQLMCDNADLIAKVTLAPEQNDPEHIERLHKAGIVVSIGHTNATYAEARQGFESGITFATHLFNAMTPMVGREPGVVGAIYDTPDVYAGIIADGFHVDYANIRIAHKIKKEKLVLVTDATAPAGADMEYFIFVGKKVYYKDGKCVDENGTLGGSALTMIEAVQNTVEHVGIALDEALRMATLYPAQAMGLDNKLGRIKKNMVANLAIFDRDFNVKATVVNGQYEQS

SEQ ID NO: 102021 - DNA, 1143 bp, Vibrio fischeri ES114
  CDS (1)..(1143): transl_table=11
atgcgctacgctttatatccacaacgtgtgtttgttgctgatggcattaaagaacatcattacgtcatagtgaatgatgggaaaatagaagcaataacagcatgtgaaccaacagattgcgagattttgccattagaaggaaaaaccttgttaccggggtttatcgacattcatatccatgggcgagcaggcgctgatgttatggacgcgacgccagaagcattgcaaaccatttctgatgctttgcttcaaacaggggttgttgcttgggttggaacaacggtaacggcaccttgggatagcattgttagctcaatcgatactgtaaaaacgtggttagataaacctcaacagtgtggtgctgagttattaggtagctttctagaaggtccatattttacagaagtgcatcgaggctcgcatccaaccgcttatttaaaatcaccaagcattcaagagttagaagaactttatgacgtagcggcgcattcactattacgagtagcgatagcacctgaagctgatggtgcaatggaagctattcaatggctgcaaagtcaaaacatcaaaacctctgtcgctcatactgattcaacgttcgagcaagttacccaagcacatcaattaggtgccgattgtggtgtccatttgtttaatggtatgcgtggtttacaccatagagaacccggctgtacaggggctgttttatatcatgacatgcttgctgaattaattgctgatagtgtgcatgttcatcctgtaatgatgcagctcgcttatcgcatgaaagggtatcagcaaatcgcacttattacggactgtatgcgagctggtggtttagaggatggtgagtaccaacttggtgcgcaaactatcactgtagctaaaggggaagcgagaacaaaatgtggttcgcttgctggaagcacatgcagtttagatagtgcgttaagaaatatgattcagctaagtgaagtaccagaatgggaggcggtgcaaatggcaacattggttcctgccaaatatttaggcattgatgatcgcttaggaagcattgcaccagaaatggaagcaagctttgtggtggtaaatcaagatttcgctgttcagaacaccatgattaaaggtgagtgggtttattaa

SEQ ID NO: 102022 - protein, 380 aa, Vibrio fischeri ES114
MRYALYPQRVFVADGIKEHHYVIVNDGKIEAITACEPTDCEILPLEGKTLLPGFIDIHIHGRAGADVMDATPEALQTISDALLQTGVVAWVGTTVTAPWDSIVSSIDTVKTWLDKPQQCGAELLGSFLEGPYFTEVHRGSHPTAYLKSPSIQELEELYDVAAHSLLRVAIAPEADGAMEAIQWLQSQNIKTSVAHTDSTFEQVTQAHQLGADCGVHLFNGMRGLHHREPGCTGAVLYHDMLAELIADSVHVHPVMMQLAYRMKGYQQIALITDCMRAGGLEDGEYQLGAQTITVAKGEARTKCGSLAGSTCSLDSALRNMIQLSEVPEWEAVQMATLVPAKYLGIDDRLGSIAPEMEASFVVVNQDFAVQNTMIKGEWVY

SEQ ID NO: 102023 - DNA, 1152 bp, Bacteroides fragilis NCTC 9343
  CDS (1)..(1152): transl_table=11
atgttgactcaaattatcaatggacgcatatttactccgcaaggttggttgaacgaaggttctgtgttgatgagagatggaaaaattctggaagtaactaattgcgacctggcgctgatcggtgccaatctggtggatgccagaggaatgtatattgttcccggctttgtttgtatgcatgcccatggtgggggaggacacgattttacagaatgtaccgaagaggctttccgtacggcgatagctgcacacatgaagcacggtgccaccagctttttcccgacactttcttcttctccgttctccgaaatacgcaaagctgtagatatatgcgaaaaactgatggccgaacccgatagcccgatactcggcttacatgtggaaggcccttacctgaaccgtaagatggcgggagaacagtttgcaaaccaagtgaaagaagtcgatgtggcagaatacacctctttgcttgaaagcaccgattgcatcaagcgttgggatgcctctcccgaactgcccggagcacttgactttgcacgttatctgaagtcgaagggaattgtaggagctgtttcgcatacggaagccgaatatgatggcataaaggaagcatacgaggcgggatttacacatgctgcgcacttctacaatgcaatgccgggctttcataagcgtcgcgaatataaatacgagggaacggttgagagcgtctacctgaccgatggcatgactatcgagctgattgctgacggcattcatttgccttccactattttgaaactggcttataagctgaagggtgtggagcatacttgtctggtgaccgacgcgctttcatatgcggctgctgaaggtaaggcgatcgacgatccccgtattattatagaagacggtgtgtgcaagcttgccgaccgttcggccttggcaggtagtattgctaccatggatcagttggtacgtacgatggtgaaggctgatattcccctggcagatgccatacgtatggcttctgagactcctgcccgtattatgggagtttatgaccgtaaaggatctctccagaaggataaagatgcggatattctgattctggatcgtgatctgaacgtcaaggcggtatgggctatggggcagttggtgaaagagtcgtaa

SEQ ID NO: 102024 - protein, 383 aa, Bacteroides fragilis NCTC 9343
MLTQIINGRIFTPQGWLNEGSVLMRDGKILEVTNCDLALIGANLVDARGMYIVPGFVCMHAHGGGGHDFTECTEEAFRTAIAAHMKHGATSFFPTLSSSPFSEIRKAVDICEKLMAEPDSPILGLHVEGPYLNRKMAGEQFANQVKEVDVAEYTSLLESTDCIKRWDASPELPGALDFARYLKSKGIVGAVSHTEAEYDGIKEAYEAGFTHAAHFYNAMPGFHKRREYKYEGTVESVYLTDGMTIELIADGIHLPSTILKLAYKLKGVEHTCLVTDALSYAAAEGKAIDDPRIIIEDGVCKLADRSALAGSIATMDQLVRTMVKADIPLADAIRMASETPARIMGVYDRKGSLQKDKDADILILDRDLNVKAVWAMGQLVKES

SEQ ID NO: 102025 - DNA, 1167 bp, Bacteroides fragilis NCTC 9343
  CDS (1)..(1167): transl_table=11
atgttaacccaattaattaatgcacgtatactcaccccccaaggatggatgaaagacggttccgtgcttatcagagacaataagattttagaagtcacaaactgcgatctggccgttatcggagctgaacttattgacgtcaaaggtatgtatgtagtccccggtggagtagaaatccacgtgcatggtggtggaggccgcgactttatggaatgtacggaagatgctttccgggcagcggtccatactcacatgaaacatggcacaacaagtatcttccccacactgtcatcatctacagtccccatgattcaacaagctgcagaaacctgtaccaagttgatggaagagaaaaacagccctatcctgggactgcacctcgaaggtcattacctgaacatgaaaatggcaggaggacaaattccggaaaacattaaaaatcctgatccgaatgaatacattccgatcgtagaacagtatcattgcatcaagcgttgggatgctgctccggaacttccgggagccatgcaattcggtaaatatattgctgccaaaggcatactgccttccgtagcacatacacaagccgaatttgaagatatccgtacagcttatgaagccggatacactcatgcaacccacttctataatgcaatgcccggcttccacaaacgcagagagtacaagtacgaaggtacagtcgaaagcatttatctgttggatgacatgacagtagaagtagtagccgacggtattcacgtcccccctacgatcctgagacttgtatataaaataaaaggtgtggaaagaacctgtctgatcaccgatgcccttgcatgtgccgatagtgacagcaaagaggctttcgacccgcgcgtaattatcgaagacggagtctgcaaactggccgaccattctgctttggcgggaagtgtcgccaccatggaccgcctgatccgcaccgttgtgcagaaagcagagatcccactggaagatgcagttcgcatggcttccgaaactccggcacgcatcatgggggtatatgatcgcaaaggttccttgcaaaaaggtaaggatgccgatattctggtactggacgaagacctcaacgtaagagccgtatgggccatgggtaagttggtacctgaaacaaatactctgttttaa

SEQ ID NO: 102026 - protein, 388 aa, Bacteroides fragilis NCTC 9343
MLTQLINARILTPQGWMKDGSVLIRDNKILEVTNCDLAVIGAELIDVKGMYVVPGGVEIHVHGGGGRDFMECTEDAFRAAVHTHMKHGTTSIFPTLSSSTVPMIQQAAETCTKLMEEKNSPILGLHLEGHYLNMKMAGGQIPENIKNPDPNEYIPIVEQYHCIKRWDAAPELPGAMQFGKYIAAKGILPSVAHTQAEFEDIRTAYEAGYTHATHFYNAMPGFHKRREYKYEGTVESIYLLDDMTVEVVADGIHVPPTILRLVYKIKGVERTCLITDALACADSDSKEAFDPRVIIEDGVCKLADHSALAGSVATMDRLIRTVVQKAEIPLEDAVRMASETPARIMGVYDRKGSLQKGKDADILVLDEDLNVRAVWAMGKLVPETNTLF

SEQ ID NO: 102027 - DNA, 1155 bp, Salmonella enterica subsp. enterica serovar Choleraesuis str
  CDS (1)..(1155): transl_table=11
atgtatgctttaacccagggccggatctttaccggtcacgaaattcttgatgaccatgcgcttgttgtcgctaatggcctgattgaccgcgtttgtccgatggccgaactgccaccgggaatagaacaacgctcattgaatggggtcattctctcccccggttttattgatgtgcagttaaacggctgcggcggcgtgcagtttaacgataccgcagaagccgtcagcgttgaaacgctggaaattatgcagaaagccaatgaaaaatcgggctgtactaactttctgccaacgcttatcactaccagcgatgaattgatgaaacagggcattcgcgtcatgcgcgaatacctggaaaaacatccgcaccaggcgctgggtctccacctggaaggcccctggcttaatctggtaaaaaaaggcacccataatcctgatttcgtgcgtaaaccagacgctgcgctggtcgatttcttatgcgataatgccgacgtcatcaccaaagtcactctcgcgccggaaatggtgcctgctgacgtaatcgctaaactggcgaatgcgggcattgtggtttccgcaggtcactccaacgcgacgttaaaagaggcgaaagcgggcttccgcgccgggattacttttgcgactcacctgtttaacgcgatgccgtacattacagggcgtgagccgggccttgctggcgctgttctggacgaagcggatatttattgcggcgttatcgccgatggtctgcatgtcgactacgccaacattcgcaatgccaaacgccttaaaggcgacaaactttgtctggtgacagacgccaccgcaccggcgggggccaatattgagcagttcattttcgcaggtaaaacaatatactaccgcaatggactgtgtgtggatgaaaacggtacgttgagcggttcgtctttaaccatgattgaaggcgtacgcaacctggtcgcgcattgcggcatcgcgctggatgaagtgctgcgcatggcaacgctctatccggcacgcgctatcggcgttgataaacatctcggtagcattgcaccgggtaaagtcgccaacctgaccgcgttcacccacgattttaaaattatcaagaccatcgttaatggtgacgaggtcgttgacttgagtaagtga

SEQ ID NO: 102028 - protein, 384 aa, Salmonella enterica subsp. enterica serovar Choleraesuis str
MYALTQGRIFTGHEILDDHALVVANGLIDRVCPMAELPPGIEQRSLNGVILSPGFIDVQLNGCGGVQFNDTAEAVSVETLEIMQKANEKSGCTNFLPTLITTSDELMKQGIRVMREYLEKHPHQALGLHLEGPWLNLVKKGTHNPDFVRKPDAALVDFLCDNADVITKVTLAPEMVPADVIAKLANAGIVVSAGHSNATLKEAKAGFRAGITFATHLFNAMPYITGREPGLAGAVLDEADIYCGVIADGLHVDYANIRNAKRLKGDKLCLVTDATAPAGANIEQFIFAGKTIYYRNGLCVDENGTLSGSSLTMIEGVRNLVAHCGIALDEVLRMATLYPARAIGVDKHLGSIAPGKVANLTAFTHDFKIIKTIVNGDEVVDLSK

SEQ ID NO: 102029 - DNA, 1167 bp, Brucella abortus biovar 1 str. 9-941
  CDS (1)..(1167): transl_table=11
atgatgaagaaatcagcaattgcaggcgcgcgcatcttcgacggtgagcgctttcatgaccagagcgcgctggtattcagcgatggccagatcgaggccatcgtaccggaagcatcgcttgccgagggccacgaaatcgaaaggctgaagggcggcgttcttgcccccggtttcatcgatgcgcaggtgaatggcggcggcgggcgtatgctcaatgacgagccgacgcccgaaaccatgttcgtgattgccggcgggcacaggaaatacggcacgaccagcctgttgccgacgctcatcaccgatacgatgcccgtgcgtgaccgcgccattgaggcggcgattgaagcggtgaaggctgacaggggggttgctggcctgcatctggaaggcccgcatctggcgccagcgcgcaaaggcgcgcatctggcggaactgatgcgcccggtcaatgatgccgatattgcgctctatatccatacagccaggcagattggcaccttgctggtgacgctcgcggccgaacaggtgacgcctgaacaggtgcgccgcttgagcgatggaggcgtgatcgtcagcattggccacagcgacacgaccgctgaagaagccttccggcgcttcgatgccggtgcgcgcagcgtgacgcatctttataatgccatgagccagattggtcatcgcgcgccgggtcttgccggtgcggcgctcgatcatcccgatatctggtgcggtatcgttgcggatgggcatcatgtcgatccgatggcgctgcggctggcgctgcgtgccaagcgcggcgatgcgcatctgttcctcgtgacggacgccatggcgcttgtcggatcggatgcggaaagcttcgagataaacgggcgcagcgttcgccgtgtgccgggcggcatctgctccaagctggtcctgccggatggcaccattgccggttccgatctcgacatggcttcggcggtgcggtttgccgtggcagaactggaactgacgcttgccgaggcgctgcgcatggcaagcctctatccggcgcgctatctgcgccttaatgatcgcggccggttccgtccgggaatgcgcatggatgccgtgcatctggatgacgggctgttcgccaaatccacatggctttccggcgaaaagcagattgcaggctga

SEQ ID NO: 102030 - protein, 388 aa, Brucella abortus biovar 1 str. 9-941
MMKKSAIAGARIFDGERFHDQSALVFSDGQIEAIVPEASLAEGHEIERLKGGVLAPGFIDAQVNGGGGRMLNDEPTPETMFVIAGGHRKYGTTSLLPTLITDTMPVRDRAIEAAIEAVKADRGVAGLHLEGPHLAPARKGAHLAELMRPVNDADIALYIHTARQIGTLLVTLAAEQVTPEQVRRLSDGGVIVSIGHSDTTAEEAFRRFDAGARSVTHLYNAMSQIGHRAPGLAGAALDHPDIWCGIVADGHHVDPMALRLALRAKRGDAHLFLVTDAMALVGSDAESFEINGRSVRRVPGGICSKLVLPDGTIAGSDLDMASAVRFAVAELELTLAEALRMASLYPARYLRLNDRGRFRPGMRMDAVHLDDGLFAKSTWLSGEKQIAG

SEQ ID NO: 102031 - DNA, 1167 bp, Corynebacterium glutamicum ATCC 13032
  CDS (1)..(1167): transl_table=11
atggcagaagtggtgcattatcaagaaaatgcaggtcaagcagttaaaaaaattgaaggaagaattgttaccccccacggggtgattgatggctttctccaactcgaaaacggcatcatcacggaactctctggagaaccagcacctaaaaacgcaggattccaccccgaactccccacgattgttcccagttttattgatcttcataatcacggtggaaacggtggcgcgtttcctacgggaacgcaggaccaggcgaggaatgccgcgcagtatcaccgcgaacatggcacgaccgtgatgttggcaagcatggtttcggcgccggctgacgcactggcagcgcaggtggaaaaccttattcccttgtgtgaagagggcctgctgtgcggcattcacctcgagggtcctttcatcaacgcatgccgttgtggtgctcaaaacccggattttatttttcccggcaacccaacagatcttgcccaggtgatccatgcgggaaaaggttggatcaaatcgatcacagtagcgccggaaactgacaatcttactgagcttctcgatctctgcgcagcgcaccacatcattgcttccttcgggcacactgatgcagattttgataccactaccagcgcaattgccttggctaaagagaaaaatgtgacggtcacggctacgcatttgttcaatgcgatgcctccgctgcatcatagggatcccggcagcgtgggcgctttgcttgctgcggcacgtgccggggacgcatatgttgagttgatcgccgacggcgtgcatttggccgatggaacggtcgatctagctcgttccaacaacgcctttttcatcacggacgccatggaagccgccggaatgccagacggtgagtacattttgggcgttttgaacgtcaccgtcaccgatggcgtcgcccgtctgcgcgatggcggcgccatcgccgggggtaccagcacactagcgagtcagttcgtgcaccacgtgcgcaggggtatgacgcttatcgacgcgaccctccacacctcaaccgtcgccgccaaaattctcggacttagcgatcacgaaatcgttaaatccaaccctgtaaattttgtggtctttgactcaaacggccagttacaacaggtccatttagaccatcaagtaatttaa

SEQ ID NO: 102032 - protein, 388 aa, Corynebacterium glutamicum ATCC 13032
MAEVVHYQENAGQAVKKIEGRIVTPHGVIDGFLQLENGIITELSGEPAPKNAGFHPELPTIVPSFIDLHNHGGNGGAFPTGTQDQARNAAQYHREHGTTVMLASMVSAPADALAAQVENLIPLCEEGLLCGIHLEGPFINACRCGAQNPDFIFPGNPTDLAQVIHAGKGWIKSITVAPETDNLTELLDLCAAHHIIASFGHTDADFDTTTSAIALAKEKNVTVTATHLFNAMPPLHHRDPGSVGALLAAARAGDAYVELIADGVHLADGTVDLARSNNAFFITDAMEAAGMPDGEYILGVLNVTVTDGVARLRDGGAIAGGTSTLASQFVHHVRRGMTLIDATLHTSTVAAKILGLSDHEIVKSNPVNFVVFDSNGQLQQVHLDHQVI

SEQ ID NO: 102033 - DNA, 1155 bp, Xanthomonas campestris pv. campestris str. 8004
  CDS (1)..(1155): transl_table=11
atggatgcttccccgattcaagcgctttgcaatgcacgcgtgctcaccgatgacggcctgcaggacggcctggccgtgctgctggacggcgcgcagatccaggccgttgtcgcggccgacgatgcgcgcgtggcgcaggccggcacgcgcgtggatctgggcggggcgaccctgctgcccggcttcatcgacatccaggtcaatggcggcggcggggtgttgttcaacaacgcctgcacgccgcaggcgctggcgacgatcgccgcagcgcatcgccgctacggcaccaccggcatgttgcccacgctgatcagcgacaccgccgaggtgatggccgaggccatcgccgccacgcgccaggcgatcgcacagggcgtgccgggcgtgcttgggattcatctggaaggcccgtacctgagcccggcgcgcaaaggcacccacgacgcacagaagttccgcgtgcccgacgcgcacgagatcgcggtggacacctcgctggacaacggcgtcaccctgatcacgctcgcgcccgagcgcgtgccgctggacgacatccgcgcctttgtcgccggtggtgcagttgtgtttgcaggccataccgccgcgacctacgaacaggcgcgcgacggcattgccgccggcgtcagcggcttcacccatctgtacaacgcgatgtcgccactggccgggcgcgagcccaatgccgtgggcgccgcactggaagatcctgcggtgtggtgcggcgtcatcgtggacggcgtgcatgtgcatccggccagcctgcgcgtggcgctggccgccaagccgcgcggcaagctgctgctggtcaccgacgccatgccgatggtcggcgccgacagccccagcttcgacctgtacggcgaaaccatcaccgccatcgacggcgtggtacgcaatgccgccggtgcgcttgccggctccgcgctggacatggccaccgcggtgcgcaacagcgtgcaatggctgggcgtggacctggccgaagccgcgcgcatggcgtccacctatccggcgcagtgcatcggcctgggcgagcgcctgggccgcatcgcaccgggttaccaggccgacctggtgctggtggatgcagacgtgcacgtgctggacacctgggtggcggggcagcgcgactga

SEQ ID NO: 102034 - protein, 384 aa, Xanthomonas campestris pv. campestris str. 8004
MDASPIQALCNARVLTDDGLQDGLAVLLDGAQIQAVVAADDARVAQAGTRVDLGGATLLPGFIDIQVNGGGGVLFNNACTPQALATIAAAHRRYGTTGMLPTLISDTAEVMAEAIAATRQAIAQGVPGVLGIHLEGPYLSPARKGTHDAQKFRVPDAHEIAVDTSLDNGVTLITLAPERVPLDDIRAFVAGGAVVFAGHTAATYEQARDGIAAGVSGFTHLYNAMSPLAGREPNAVGAALEDPAVWCGVIVDGVHVHPASLRVALAAKPRGKLLLVTDAMPMVGADSPSFDLYGETITAIDGVVRNAAGALAGSALDMATAVRNSVQWLGVDLAEAARMASTYPAQCIGLGERLGRIAPGYQADLVLVDADVHVLDTWVAGQRD

SEQ ID NO: 102035 - DNA, 1146 bp, Haemophilus influenzae 86-028NP
  CDS (1)..(1146): transl_table=11
atgaaatacgcattaaccaacagtgtgatctacactaaatacgaaattctacgagattatgcggtagtaattgatagcgaaactattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaagggccttatctcagcattgagaaaaaaggcgtacaccgccccgaatatattcgtgaaattacgcctgaaatgaaagattttctctgtgaaaatggcgatgtgattacaaaaataaccattgccgcagaaaacccaaccattaactatacgcctgattttgtgaaagcgggcattattgtctctgtaggtcattctaatgccacttatgaagtggctaaagccgcattccacaaaggcgcaacatttgcaacccacttacataatgcaatgtcgccaattagttctggacgtgaaatgggcgtagtgggcgcagtattagattctgatgtttacactggcattatcgtggatggtgtgcatatcaattatggcaatgttcgcattgataaaaaaatcaaaggcgacaaactttgtattgtgactgactctattgcagcggcaggcgcaccgccagaactagaaaattttacctttgtgggaaaaacaatttatatcaaagatgggcgttgctatgatgctaatggcacgattgcaggggcatcaatcacaatgatggaatccattaaaaatgcggtagaatatgttgaaattcctcttgctgaagccattagaatgagtaacctttatcctgcacgagcaattggtatagatgatcgtttaggttcggtagaaaaaggtaagatagcaaacttagcagtgtttacgccaaattaccaagtaatcggcacagtagtaaacggaaagtggaaagagaattaa

SEQ ID NO: 102036 - protein, 381 aa, Haemophilus influenzae 86-028NP
MKYALTNSVIYTKYEILRDYAVVIDSETIEAVIPQAELETGIKTIDLQGNNLTAGFIDLQLNGCGGVMFNDQTSVETLEIMQETNLKSGCTSFLPTFITAPDENIKSAVKIMREYLNKHKNQALGLHIEGPYLSIEKKGVHRPEYIREITPEMKDFLCENGDVITKITIAAENPTINYTPDFVKAGIIVSVGHSNATYEVAKAAFHKGATFATHLHNAMSPISSGREMGVVGAVLDSDVYTGIIVDGVHINYGNVRIDKKIKGDKLCIVTDSIAAAGAPPELENFTFVGKTIYIKDGRCYDANGTIAGASITMMESIKNAVEYVEIPLAEAIRMSNLYPARAIGIDDRLGSVEKGKIANLAVFTPNYQVIGTVVNGKWKEN

SEQ ID NO: 102037 - DNA, 1158 bp, Staphylococcus haemolyticus JCSC1435
  CDS (1)..(1158): transl_table=11
atgtcaacaaactatgtcattacaaatggtaaaatttatacggaaaagcaagttattgaaaatggatatcttgtagtagaagatggcaaaataagtgatattcaacaaggaacgtatactggagaattagaacaaatcgacgtgaaaggtcaaaatgtattaccaggtttcatagatattcacattcatggtggctatggtgaggacgcaatggatgcttcttatgacgggttaaaacatttggctgaacaattattatcagagggaacaacaacattcttagcaacgacgatgacgcaatcggacgctaatattgaaaaggcattgaaaaacattgtggcatatcaagctgatcaacaacgaggagaagcggctgaagtaggtggtgttcatttagaaggaccatttatttcagagcataaagttggcgcgcaaaatcctaaatatgtgcaacgtccatctgcgtctaagattcaacatttccaagaagttgcgaatcagcaaatcaaaattattacctttgcgcctgaagttgaaggcgcacatgatacacttaatcaattgcatgaagatattatcttctcaatggggcatactgtggcaacgtttgatgaagcgaatgaagcggtggaccatggtgcaaaacatgtaacacatctatataatgcagctacaccatttgaacatcgcgatccaggtgtctttggtgcggcgtggacgaatgaacaattaaatacggaaattatagttgatggtattcattcacatcctgcttctgtacatattgcttataagcaaaaaggaaatgaacacatgtatctcatcactgatgcgatgcgtgcgaaaggaatggaagacggtgaatatgatttaggcggacagaatgtcatcgttaaaggaaaagaggctcgcctagcaagtggcgctttagcaggtagcatcttgaaaatgaatgacggtttgtataatttaattgaatatacacatgattcattagagaatttatggcgtgtaacgagtttgaatcaagccatcgcattaaaaattgatgaccataaaggtagtttagccattggtaaagatgctgatatcgtagtagtagatgatacgattcgtgttgataaaacaatcaaatcaggggttgtacatcaatattaa

SEQ ID NO: 102038 - protein, 385 aa, Staphylococcus haemolyticus JCSC1435
MSTNYVITNGKIYTEKQVIENGYLVVEDGKISDIQQGTYTGELEQIDVKGQNVLPGFIDIHIHGGYGEDAMDASYDGLKHLAEQLLSEGTTTFLATTMTQSDANIEKALKNIVAYQADQQRGEAAEVGGVHLEGPFISEHKVGAQNPKYVQRPSASKIQHFQEVANQQIKIITFAPEVEGAHDTLNQLHEDIIFSMGHTVATFDEANEAVDHGAKHVTHLYNAATPFEHRDPGVFGAAWTNEQLNTEIIVDGIHSHPASVHIAYKQKGNEHMYLITDAMRAKGMEDGEYDLGGQNVIVKGKEARLASGALAGSILKMNDGLYNLIEYTHDSLENLWRVTSLNQAIALKIDDHKGSLAIGKDADIVVVDDTIRVDKTIKSGVVHQY

SEQ ID NO: 102039 - DNA, 1107 bp, Pseudomonas fluorescens Pf-5
  CDS (1)..(1107): transl_table=11
atgtccgaagacaatatcctcacgccccaaggctgggtccgcggccgtctgctgcatcaggacggcaaggtgatcgccatcgaaggcagcccctgcaatccggcggacaacgacctgccctacctgctgcccggctttatcgacctgcatgtgcacggcggcggcggcaaggacatcatgcaaggccgcgatgccttccagaccatcacccgcacccatgtgcgcttcggcaccacctcgttgctggccaccaccatgacggcccccagcgaggaaatccgccaggtcctggagcaactgggcagctatgccgaacagcgtccccagggctgcgcccgagtgctcggcgtgcacctggaaggcccctacatcaaccccggcaaacttggcgcccagcccaacttcgcccacaccgcactgctggcggaagtggagcagtacctggcgctggcgccgatccgcgtgatcaccatcgccccggaagtcgccggccacgacggcctgatccgcgaactcagcgcccgcggcgtgcgcatgcagatcggccacaccctgggcagctacgaggaaggcgtggcggccctcgccgctggcgccaccagtttcacccacctgtacaacgccatgagcccgctgcatcaccgtgagccggggatcgtcggcgcggccctggcccacgcccagtacgccgagctgatcccggacctgctgcacgtgcaccccggtgccatgcgcgtggccctgcgctcgatcccatgcctgtactgcgttaccgactccaccgcagctgccggcatgcccgacggtgaatacaagctgggcagccacaccgtgaccaagtgcctgggtggtgtgcgcctggccgacggcacgctggccggcagcaccctgaccatggaccaggccctgcgcaatctggtgaagatcggcctgcccctggccgaagcctcgcagcgcctgtcgcaatgtcccgccgactacctcggcatcccccaacgcggccgcctgcaacctggcagctgggccgacagcgtgcgcctggaccgggcactcacactgaccgccgtcatggtcgaaggagaagacattgacttcaaaaatgcttga

SEQ ID NO: 102040 - protein, 368 aa, Pseudomonas fluorescens Pf-5
MSEDNILTPQGWVRGRLLHQDGKVIAIEGSPCNPADNDLPYLLPGFIDLHVHGGGGKDIMQGRDAFQTITRTHVRFGTTSLLATTMTAPSEEIRQVLEQLGSYAEQRPQGCARVLGVHLEGPYINPGKLGAQPNFAHTALLAEVEQYLALAPIRVITIAPEVAGHDGLIRELSARGVRMQIGHTLGSYEEGVAALAAGATSFTHLYNAMSPLHHREPGIVGAALAHAQYAELIPDLLHVHPGAMRVALRSIPCLYCVTDSTAAAGMPDGEYKLGSHTVTKCLGGVRLADGTLAGSTLTMDQALRNLVKIGLPLAEASQRLSQCPADYLGIPQRGRLQPGSWADSVRLDRALTLTAVMVEGEDIDFKNA

SEQ ID NO: 102041 - DNA, 1131 bp, Colwellia psychrerythraea 34H
  CDS (1)..(1131): transl_table=11
atgacacaaaaacgctttcatgctcaacgattctttgatgggcaagcttttctcgatgatcaagtattgaccatagtcgatggtaaaattactgctattgaccaagatattactaatattgatgttagtgttacaggtttagttgttccaggttatatcgacttgcaagttaacggtggtggcggtgcattattcaatgattcaccgtcagttgataacttaaaaacaatcatgactgctcatgctaggtttggtaccacagcgatgatgccgaccttaattaccgataaaattgaagtaatgcagcaagctgcaaaggccattgctcaagcaatatcagaaggtgttcccggtatcattggcatccattttgagggaccgcacttatctattgataaaaaaggtacccattgtgccgattatattcgacctatttctgatgatgaatggcaggttctctctcgccaagacattggccaaattatggtaacgcttgcaccggaaactgtaagtgctgaagacgtaacccgaatggttgagttaggaattaaagtttgcttaggtcacactaatgctgattttaaaacgactcaacaggctattgatgctggggcaagtggttttactcatttatttaatgctatgtccccattgcaaggtcgtgaaccgggtgttgttggcgctgcgcttttaaataatcatactagctgcggtttaattgttgatggtttccatgtggattacgccagttgtagattagcaattcaagctaaacctcaaggtaaaatattcttagtaactgatgcaatgccgcccgtaggcacagatcaaacccaattcgctttatacgatcgtacagtttatgtcgataacggtaaacttacgtcaaccacaggtgaactcgctggctcttctttagatatggccagtgccgtgaaaaatacgcatcacaagttgggcattgagttaggcgaagcaattcggatggccagtttgtacccagcacaatatttatatcaaaaccaaacggttatgcgtggtgaactcataccaggaaaacaagctgatatggtggtattgaatgatgatttgtctgtacaagaaacctggattgcaggtgcaaaagtttag

SEQ ID NO: 102042 - protein, 376 aa, Colwellia psychrerythraea 34H
MTQKRFHAQRFFDGQAFLDDQVLTIVDGKITAIDQDITNIDVSVTGLVVPGYIDLQVNGGGGALFNDSPSVDNLKTIMTAHARFGTTAMMPTLITDKIEVMQQAAKAIAQAISEGVPGIIGIHFEGPHLSIDKKGTHCADYIRPISDDEWQVLSRQDIGQIMVTLAPETVSAEDVTRMVELGIKVCLGHTNADFKTTQQAIDAGASGFTHLFNAMSPLQGREPGVVGAALLNNHTSCGLIVDGFHVDYASCRLAIQAKPQGKIFLVTDAMPPVGTDQTQFALYDRTVYVDNGKLTSTTGELAGSSLDMASAVKNTHHKLGIELGEAIRMASLYPAQYLYQNQTVMRGELIPGKQADMVVLNDDLSVQETWIAGAKV

SEQ ID NO: 102043 - DNA, 1161 bp, Candidatus Blochmannia pennsylvanicus str. BPEN
  CDS (1)..(1161): transl_table=11
atgtatgctttaattaatagtacgatatacactggtaaggaaattattgataatcatgcgcttatcgtttctgaaaatgttattaaagctatttgtttgagtagcgagttgcctaaaaacatagatgtacatgatttatcaggatctttattgacacctggatttatagatttacaaattaacgggtgcggcggcgtacaattcaacgatcatataaatgcaatatcaatatgtacacttgaaaaaatgcaggaaactaaccaattttcagggtgtactagttttcttccaacgttgattactagtaataatgttctgatgcaacgagctattgagatcatgcgtatttttttatctaaaaataaaaatcaggctttaggattacatttggaagggccattcttaaactctacaaaaagaggtatacataacccgatattgattcgttgtccgacaaaagagatgataaattatctgtgtgaaaatagtgatgttatcagaaaaataactcttgctcccgaacaattagatatgacatttattcaaaaattaaaaaaatcgggtatttgtgttgcaattggacattctaacgctacttatgaacaagcacgatttagtttctcatacggtgttagttttggaacccatttatttaatgctatgccaccgttaattgctcgtgaacctggtgttatcggagctatttttgatgtgccagaaatatattgcagtgttatagcagatggattgcatgttcattgggctaatattagatatgctaaaaaaattaaaggagatcgtttaattttagtaactgatgccactagtcctgcgggatctaataaaattagatcccgatttcttttttctaataaaaccatatatcatcgtaataacatatgtgaggatagtaaaggcacacttagtggatcgactttaaccatgattcaagcaataaaaaacagtgttaaatatgctggaataccattagatgaagctgtgcgtatggctaccttatatccagccaaagctatcggaatggaccattgtttaggtagcttagaaataaataagattgctaatttaactgtttttaacacagactatcaaataaaaaaaaccatagttaacggaaaaatagtgaatacatcattgccataa

SEQ ID NO: 102044 - protein, 386 aa, Candidatus Blochmannia pennsylvanicus str. BPEN
MYALINSTIYTGKEIIDNHALIVSENVIKAICLSSELPKNIDVHDLSGSLLTPGFIDLQINGCGGVQFNDHINAISICTLEKMQETNQFSGCTSFLPTLITSNNVLMQRAIEIMRIFLSKNKNQALGLHLEGPFLNSTKRGIHNPILIRCPTKEMINYLCENSDVIRKITLAPEQLDMTFIQKLKKSGICVAIGHSNATYEQARFSFSYGVSFGTHLFNAMPPLIAREPGVIGAIFDVPEIYCSVIADGLHVHWANIRYAKKIKGDRLILVTDATSPAGSNKIRSRFLFSNKTIYHRNNICEDSKGTLSGSTLTMIQAIKNSVKYAGIPLDEAVRMATLYPAKAIGMDHCLGSLEINKIANLTVFNTDYQIKKTIVNGKIVNTSLP

SEQ ID NO: 102045 - DNA, 1083 bp, Mycoplasma synoviae 53
  CDS (1)..(1083): transl_table=4
ttaagtgaaagcggaataataaaaagcgttaataaaggtaaatgcaatattaaagatgcgcttgattatagcggccatatattaatgccaaattttattgattcacatacccatggaggatatgatttttcttttaacgatttaaaagaaaaaaatattcaagataaattaaataaatacctagcagaaatcaaaaaagaaggtgttggccatgtttttgccactactgtaactgctagctatagcgatattaaaaaaatagctagctatttcacagaaaaatatccaaaagaatttctagcttgatatttagaagggccttatatttcaaaagaaaaaaatggcgctcatgatgaaaacttaattaaaaatttatcaactaaagaagtacagttttttagcgaggtatcaaaatttattcctgtgtatttagcactagcgtcagaatacagccaaaataaaaaaatgctgaatcagtatcacgatcagataaactttgcgctagggcattctaatgataataattttgatagcaaatatttaaaagataataaatataaaagagttattcattttttaaatgcaatgtcaggctttcaccaaagaaataaaagtttagttaatagcgttttagaagatactaatagaaattatttaattgaaataatttctgatttaactcatgttagaagtcaaacgataaattttttatatcaaagctttgatgatagcaatatagctttggtatcagattcacttcctaataaaggttctaaaaatggaatttataaacttaataatttagaagtagaaaaaaaagactatcttttttatcttagagatagctctactctagcaggaagcggcatgccttataatttaattcttaaaaatttttataaggcaacaaaatgctcttttagcgagctagttaaattttcttcatacaacgtagctaaaagccttaaaagcaaaaccttaggtagaataaaaattaatacaaaagcaaattttgtattaattgataaagattttaatgttaagcttcactactttgatggtgaaaaagctaagctagattaa

SEQ ID NO: 102046 - protein, 360 aa, Mycoplasma synoviae 53
MSESGIIKSVNKGKCNIKDALDYSGHILMPNFIDSHTHGGYDFSFNDLKEKNIQDKLNKYLAEIKKEGVGHVFATTVTASYSDIKKIASYFTEKYPKEFLAWYLEGPYISKEKNGAHDENLIKNLSTKEVQFFSEVSKFIPVYLALASEYSQNKKMLNQYHDQINFALGHSNDNNFDSKYLKDNKYKRVIHFLNAMSGFHQRNKSLVNSVLEDTNRNYLIEIISDLTHVRSQTINFLYQSFDDSNIALVSDSLPNKGSKNGIYKLNNLEVEKKDYLFYLRDSSTLAGSGMPYNLILKNFYKATKCSFSELVKFSSYNVAKSLKSKTLGRIKINTKANFVLIDKDFNVKLHYFDGEKAKLD

SEQ ID NO: 102047 - DNA, 1161 bp, Mycoplasma hyopneumoniae J
  CDS (1)..(1161): transl_table=4
ttaaaaatgatttataaaaatcttagaattgttagtcattctgatgaatttataggttgaattgaacttgataaaaacggaattattgttgatttaagtagaggaaatacagaatcttcaggaattgactgcaaaaaccacgttttattaccggcttttattgattcgcacacccacggcggctatggattttcatttgatgacttttcagatagttgctgggaacaaaattttttagattataaggaaaaactacataaatttgaaggtgtagcagcaatttttggaacaactattacccagcaatgggaaaaaattaaggaaaatagtgaattttttttatttttgcttaataaatatcctaattttttactaaattgatatttagaaggtccgtttatttctgagaaaaaaaaaggggcacacaatcaaaatttaataatcaaaccaaaaagagaacattttaagtttttggcagaaaagtttaacaaaaaaattacagtggtagttgcccctgaaaaaacttcagcaaaattaattgattctttttataaaacaattaattttgcgattgggcattcgaattcttttgatttcaaaaagaatcataatttaaaaaagtactataaatttacgcacttttttaatggatgttcaaattttgaccaccgaaaacaatcacttgtcaaccttatttttgaatcaaaattacctaaaaattttcttgttgagttaatcactgacaaccttcatattaaaaattcaaccctcaaatttacaattaaaaatattaaaaaagaaaattgggttgcagtctcagactcgcttgcccaaaaaggacttgataatggattttataaattaggagaactaaaaattgagaagaaaggtgatttattctatctaaaaaattcaaaacaaattgccggaagtgggatgtcatatttaaaaattcttaagaatttaaagttaaatttgaaactatcttgacaggaaatagttttttgttcctcttataatgtggcaaattcattgggaattctagatttttttgggtcaattaagataggacaaaaagcaaattttgtaattttagatgataaatttgaactaaaaatgtcaatcatttttggccaaatttaccgcgaatttgcaaaatag

SEQ ID NO: 102048 - protein, 386 aa, Mycoplasma hyopneumoniae J
MKMIYKNLRIVSHSDEFIGWIELDKNGIIVDLSRGNTESSGIDCKNHVLLPAFIDSHTHGGYGFSFDDFSDSCWEQNFLDYKEKLHKFEGVAAIFGTTITQQWEKIKENSEFFLFLLNKYPNFLLNWYLEGPFISEKKKGAHNQNLIIKPKREHFKFLAEKFNKKITVVVAPEKTSAKLIDSFYKTINFAIGHSNSFDFKKNHNLKKYYKFTHFFNGCSNFDHRKQSLVNLIFESKLPKNFLVELITDNLHIKNSTLKFTIKNIKKENWVAVSDSLAQKGLDNGFYKLGELKIEKKGDLFYLKNSKQIAGSGMSYLKILKNLKLNLKLSWQEIVFCSSYNVANSLGILDFFGSIKIGQKANFVILDDKFELKMSIIFGQIYREFAK

SEQ ID NO: 102049 - DNA, 1149 bp, Streptococcus pyogenes MGAS6180
  CDS (1)..(1149): transl_table=11
atgacatgctatcttaaagcagattgtttttattacccaacagaggtgaaaccggctggctacctaggtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatctactttgaaggtccttattttaccgaagaatataagggtgctcaaaacccaagttatatgaaaaccccacgcttggaggaatttgatgcttggcaaaaagctgctaaagggctcatcaaaaaaattgcccttgctcctgagcgtgagggtgtcaaagaatttgtgtctgcagtgacaaaacaaggcgtaacagtggccttagggcattcaaatggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagccatgattacggactgtatgcgagcaggtggttcaccagatggtgattacctcttgggggaattctctgtggttgtggcaaatggcactgctcgtcttaaagagagtggaaacttggcaggatctattttgaaattaaaagacggccttagaaatgtagtggcctggggaatcgcaactccggcagaagccattcatatggcaacttatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcctaa

SEQ ID NO: 102050 - protein, 382 aa, Streptococcus pyogenes MGAS6180
MTCYLKADCFYYPTEVKPAGYLGLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKTPRLEEFDAWQKAAKGLIKKIALAPEREGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 102051 - DNA, 1149 bp, Streptococcus pyogenes MGAS5005
  CDS (1)..(1149): transl_table=11
atgacatgctatcttaaagcagattgtttttattacccaacagaggtgagaccggctggctacctaagtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatctactttgaaggtccttattttaccgaagaatataagggtgctcaaaacccaagttatatgaaaaccccacgcttggaggaatttgatgcttggcaaaaagctgctaaagggctcatcaaaaaaattgcccttgctcctgaacgtgatggtgtcaaagaatttgtgtctgcagtgacaaaacaaggcgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagccatgattacggactgtatgcgagcaggtggttcaccagatggtgattacctcttgggggaattctctgtggttgtggcaaatggcactgctcgtcttaaagagagtggaaacttggcaggatctattttgaaattaaaagatggccttagaaatgtagtggcctggggaatcgcaactccggcagaagccattcatatggcaacttatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcctaa

SEQ ID NO: 102052 - protein, 382 aa, Streptococcus pyogenes MGAS5005
MTCYLKADCFYYPTEVRPAGYLSLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKTPRLEEFDAWQKAAKGLIKKIALAPERDGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 102053 - DNA, 1161 bp, Mycoplasma hyopneumoniae 7448
  CDS (1)..(1161): transl_table=4
ttaaaaatgatttataaaaatcttagaattgttagtcattctgatgaatttataggttgaattgaacttgataaaaacggaattattgttaatttaagtagaggaaatacagaatcttcaggaattgattgcaaaaaccacgttttattaccggcttttattgattcgcacacccacggcggctatggattttcatttgatgacttttcagatagttgctgggaacaaaattttttagattataaggaaaaactacataaatttgaaggtgtagcagcaatttttggaacaactattacccagcaatgagaaaaaattaaggaaaatagtgaattttttttatttttgcttaataaatatcctaattttttactaaattgatatttagaaggtccgtttatttctgaggaaaaaaagggggcacacaatcaaagtttaataattaaaccgaaaagagaacattttaagtttttagcagaaaaatttaacaaaaaaattacagtagtagttgcccctgaaaaaacttcagcaaaattaattgattctttttataaaacaattaattttgcgattgggcattcgaattcttttgatttcaaaaagaatcataatttaaaaaagtactataaatttacgcacttttttaatggatgttcaaattttgaccaccgaaaacaatcacttgtcaaccttatttttgaatcaaaattacctaaaaattttcttgttgagttaatcactgacagccttcatattaaaaattcaaccctcaaatttacaattaaaaatattaaaaaagaaaattgggttgcagtctcagactcgcttgcacaaaaaggacttgataatggattttataaattaggagaactaaaaattgagaagaaaggtgatttattctatctaaaaaattcaaaacaaattgccggaagtgggatgtcatatttaaaaattcttaagaatttaaagttaaatttgaaattatcttgacaggaaatagttttttgttcctcttataatgtggcaaattcattgggaattctagatttttttgggtcaattaagataggacaaaaagcaaattttgtaattttagatgataaatttgaactaaaaatgtcaatcatttttggccaaatttaccgcgaattagcaaaataa

SEQ ID NO: 102054 - protein, 386 aa, Mycoplasma hyopneumoniae 7448
MKMIYKNLRIVSHSDEFIGWIELDKNGIIVNLSRGNTESSGIDCKNHVLLPAFIDSHTHGGYGFSFDDFSDSCWEQNFLDYKEKLHKFEGVAAIFGTTITQQWEKIKENSEFFLFLLNKYPNFLLNWYLEGPFISEEKKGAHNQSLIIKPKREHFKFLAEKFNKKITVVVAPEKTSAKLIDSFYKTINFAIGHSNSFDFKKNHNLKKYYKFTHFFNGCSNFDHRKQSLVNLIFESKLPKNFLVELITDSLHIKNSTLKFTIKNIKKENWVAVSDSLAQKGLDNGFYKLGELKIEKKGDLFYLKNSKQIAGSGMSYLKILKNLKLNLKLSWQEIVFCSSYNVANSLGILDFFGSIKIGQKANFVILDDKFELKMSIIFGQIYRELAK

SEQ ID NO: 102055 - DNA, 1158 bp, Thermobifida fusca YX
  CDS (1)..(1158): transl_table=11
gtgcgcacattgactaacgcacggatcgtcacctcgcaggggtggaccgcagggtggctgcgcgtcgacggtccacgtattgccgaggtcggcgcgggaatcgccccctatcccgcagcagaatccgtggacttgggcggccgcctcctcgtccccggctgggtggacatccacgtccacggcggcgggggcgcttcctttgacgacggcgaccccgagcgcgccctggccgccgtcgacctgcaccgtcggcacgggacgaccagcctggtcgcgggactggtgaccgcttcccccgcagctctgctgcgccaggtggccgcgctggccgaactgtgcgaggcgggtgagctcgccggcatccacttggaaggcccctacctggccacacagcggtgcggggcgcacgatccggccctgctgcgctccccagacctcgccgagttccagcggatcctccgcgcaggccgcggccacgtccggatgatcacactcgcccccgagctgcccggcgcgctcgaactggtgcgtgcagctgtttccgaaggcgtcgtggccgcggtcgggcacaccgacgccgactatgccacggtgtgcgccgcgttcgacgcgggggcgacggtggccacccacctgttcaaccagatgcggcccctccaccaccgggatcccgggcccgtggccgcggcgctcaccgacgaccgggtgaccgtggaggtcatcaacgacggggtccacctccatcccgcggtggtgcgcatggcctgggctgcggccggagccgaccgcaccgctttcgtcaccgatgccatggcagcggccgggctgggcgacggggactacaccttgggcgggcgccgtgtccgggtcgcagacggcacagcccgcctggcggacacgggggcgatcgcgggcagcacgatcactttggccgatgctgtccgtcgggcagtgcgtgacctgggcattccgctggccgcggcggtacgcgcagccagcacggttcccgctgccgccctgcgcctcgctgacgtgggggctctcctgccgggacgctacgccgacctcgtcgtgctggagccggatgggacgctccacgccgtctaccaccggggccgccccgtcaccggagttccggccagccggggccagcgctga

SEQ ID NO: 102056 - protein, 385 aa, Thermobifida fusca YX
MRTLTNARIVTSQGWTAGWLRVDGPRIAEVGAGIAPYPAAESVDLGGRLLVPGWVDIHVHGGGGASFDDGDPERALAAVDLHRRHGTTSLVAGLVTASPAALLRQVAALAELCEAGELAGIHLEGPYLATQRCGAHDPALLRSPDLAEFQRILRAGRGHVRMITLAPELPGALELVRAAVSEGVVAAVGHTDADYATVCAAFDAGATVATHLFNQMRPLHHRDPGPVAAALTDDRVTVEVINDGVHLHPAVVRMAWAAAGADRTAFVTDAMAAAGLGDGDYTLGGRRVRVADGTARLADTGAIAGSTITLADAVRRAVRDLGIPLAAAVRAASTVPAAALRLADVGALLPGRYADLVVLEPDGTLHAVYHRGRPVTGVPASRGQR

SEQ ID NO: 102057 - DNA, 1161 bp, Prochlorococcus marinus str. NATL2A
  CDS (1)..(1161): transl_table=11
atgagaaaaattacaaacattaaagtacctcaaccagagaaaagcgaagatgaaaagaatttattttcactagttttagatgaacatggaattattctttctattgataaaacttgcaagagggaatcaagttatgatgaagattggcatggagattggctaagtcctagggcgattgatcttcaaatgaatggaggtttagggatctcatttacagatttaaattttaataaaatacctaaattattaacattgcttgatcaactttggctagatggagttgaaggaatttgtccaacttttgttagttgttctctagatcaatttcaattaggaatggaggtcttaaaggaaacgaaaaaatatacttcaacaaatcgatgtcgactacttggcgcccatatggaaggaccttttttatgtgagacatattctggagcacatgacacaggaagtatttgtagacctagtatttctgccttaaatgagagaataaagggatttgaggacgacatagcactaatgacattggctccagaattaaaaggttctttggatgtaatttctcgtctaagagaattaaatatcgttgtctcactgggacattcttcagctgattttgattcagccataaaagcttttaataatggtgtgagcatgattacgcatacttttaatgcaatgaaaggtttacatcatcgagctattggacctataggagcggctgcaagaagagacgatattttcctaggattgataggtgatggtgttcatgttcattcagatatgattaggcttttaaagatacttgcaccaaagcaaattgttttagttagcgatgcaatatcagcttatggtttaggagatggatcgtttaattgggataaacgcttgataacagtagaaaatggtttatgcagacttccaaatgaaacaattgcaggatccactttgcctttacttgacgcatgcaaaaaaatagcaaattggattaatgatccctctgctgctatttggatggcaacacttgctccacgtatggtattaagtcagaacaaaatgactgcaaaatctttttttattggaaaaaatattaagtctttacttagatggaaaatgaattcttgtaatcatcagttgtcttggcagttggctgcgtaa

SEQ ID NO: 102058 - protein, 386 aa, Prochlorococcus marinus str. NATL2A
MRKITNIKVPQPEKSEDEKNLFSLVLDEHGIILSIDKTCKRESSYDEDWHGDWLSPRAIDLQMNGGLGISFTDLNFNKIPKLLTLLDQLWLDGVEGICPTFVSCSLDQFQLGMEVLKETKKYTSTNRCRLLGAHMEGPFLCETYSGAHDTGSICRPSISALNERIKGFEDDIALMTLAPELKGSLDVISRLRELNIVVSLGHSSADFDSAIKAFNNGVSMITHTFNAMKGLHHRAIGPIGAAARRDDIFLGLIGDGVHVHSDMIRLLKILAPKQIVLVSDAISAYGLGDGSFNWDKRLITVENGLCRLPNETIAGSTLPLLDACKKIANWINDPSAAIWMATLAPRMVLSQNKMTAKSFFIGKNIKSLLRWKMNSCNHQLSWQLAA

SEQ ID NO: 102059 - DNA, 1167 bp, Staphylococcus saprophyticus subsp. saprophyticus ATCC 15305
  CDS (1)..(1167): transl_table=11
atgagcgaatatgttattgaaaatggacggatttatactgagacagagacaatagagcgaggctacctcgttattaacaatgagaaaataactgaaattaaatcgggagactatcacggaaatttaacaacaattgatgcgcaaggacaacatattatacctggatttatagatattcatatgcatggtggatatggggaagatgctatggatgcttcttatgatgggttgaaacgtttatctgaatcactattgtcagaaggaactacgagttatctagcgacgacaatgacgcaatctgatgaaaacatcacgaaagcattagaaaatatagtgaattaccaaaaagcgcaagatcaatacaatgcagcaactattgtcggtgtacatttagaaggaccgtttatatctgaacataaagtaggcgcacaaaatccagcttatgttcaaagacctactgtcgcaaaagttgaacaatttcaaaccacagctaataatcaaataaaagtaattacctttgcaccagaagttgaaggtgcgcatgaaacactagaggcattacataaagagattcaattttcaattggacatacagtcgctacttttgatgaggtaaatgatgctgttacacatggtgccaaacatgttacacatctttataatgctggaacatcatttgaacaccgagagccaggggtctttggtgctgcttggttgaatgatcaattaagtacggaattgattgttgatggtgttcactcacatcctgcagccgttaaaattgcctataaacaaaaaggaaatgcgcgattctttttaatcacagatgctatgagagctaaaggcatgcctgatggagaatatgatttaggtgggcaaaatgtaattgttaaagggtccgaggcgcgtttagcttctggcgcattagcgggaagtatattgaaaatgaataccggcttgaaaaacttaatcaactttacaggtgatacattagatcatttatggcgtgtaacgagtctaaaccaagcgatagctttaaatattgatacacaaacaggcagtttggaagttgggaaagatgcagatattgtcatagtcaatgacgatatcgacgtgctagcaacgattaaatctggtaagattcacaagtttaaatcagtactttaa

SEQ ID NO: 102060 - protein, 388 aa, Staphylococcus saprophyticus subsp. saprophyticus ATCC 15305
MSEYVIENGRIYTETETIERGYLVINNEKITEIKSGDYHGNLTTIDAQGQHIIPGFIDIHMHGGYGEDAMDASYDGLKRLSESLLSEGTTSYLATTMTQSDENITKALENIVNYQKAQDQYNAATIVGVHLEGPFISEHKVGAQNPAYVQRPTVAKVEQFQTTANNQIKVITFAPEVEGAHETLEALHKEIQFSIGHTVATFDEVNDAVTHGAKHVTHLYNAGTSFEHREPGVFGAAWLNDQLSTELIVDGVHSHPAAVKIAYKQKGNARFFLITDAMRAKGMPDGEYDLGGQNVIVKGSEARLASGALAGSILKMNTGLKNLINFTGDTLDHLWRVTSLNQAIALNIDTQTGSLEVGKDADIVIVNDDIDVLATIKSGKIHKFKSVL

SEQ ID NO: 102061 - DNA, 1149 bp, Haemophilus somnus 129PT
  CDS (1)..(1149)
atgaaatatgcctttataaattgtgtgatctatacggcaaaagaagtgctgtacggacatgcagtagtggttgaaaacgataaaatttcagccattgtttccgaaaaacagctatgtaatgaaattcaacgtattgatttaaaaggtaataatttaaccgctggttttattgatttgcagttaaatggctgtgggggcgtaatgtttaatgaagatattagtgttcgcacattagagattatgcaagaaacgaacttacgctccggtacgacaagctatcttccgacttttatcacttcacctgatgaagggatgaaaagtgcggtgcaagtcatgcgagattatttggaaaaatatcaaaatcaagcattgggtttgcatttagaaggaccttatctaagtgttgagcgtaaaggtgtgcatcgtgatgaatatattcgagaaattacgcccgagatgaaatctttcttatgtgataatgcggatgtcattaccaaaattactttagcagcagaaaatccaaccgcaaaacatattcctgagtttgtaaaaaatgggatcttggtttctttaggacacagcaatgcaagctatgaagttgcaaaaaaggctattcaactaggagcaggttttgcaacacatttacataatgctatgtcgccaattagttctggacgtgcaatgggtgtcgttggtgcagtattagatagtgatatttatagcggtattattgccgatggtttacatgtgagttttgaaaatatcaaactggataaaaagttgaaaggcgataaactttgtattgtgactgatgcgacagccgccgccggagccaatattgaatcttttcaatttgttggaaaaacaatctatgtgcgagatggaaaatgctatgacgctaatggtacattaggcggtgcggcggtcactatgatagagtcggtagaaaatatggtgaaatatgttgaagttcctctagatgaaactttacgtatgtgtaatttatatccggctcgtgcaatcggcgttgatgatagattaggttcgattgaagtgggcaagattgcaaacttaactgtctttgataatcaatttaacgtgattggtaccgcagtgaatggtaagtggaaaacttattgtaatttatag

SEQ ID NO: 102062 - protein, 382 aa, Haemophilus somnus 129PT
MKYAFINCVIYTAKEVLYGHAVVVENDKISAIVSEKQLCNEIQRIDLKGNNLTAGFIDLQLNGCGGVMFNEDISVRTLEIMQETNLRSGTTSYLPTFITSPDEGMKSAVQVMRDYLEKYQNQALGLHLEGPYLSVERKGVHRDEYIREITPEMKSFLCDNADVITKITLAAENPTAKHIPEFVKNGILVSLGHSNASYEVAKKAIQLGAGFATHLHNAMSPISSGRAMGVVGAVLDSDIYSGIIADGLHVSFENIKLDKKLKGDKLCIVTDATAAAGANIESFQFVGKTIYVRDGKCYDANGTLGGAAVTMIESVENMVKYVEVPLDETLRMCNLYPARAIGVDDRLGSIEVGKIANLTVFDNQFNVIGTAVNGKWKTYCNL

SEQ ID NO: 102063 - DNA, 1134 bp, Listeria monocytogenes str. 4b H7858
  CDS (1)..(1134): transl_table=11
atggccgttatcaaaaatgtgaaaatttacaaagaaaatgaattaattgatgcagcagttattacagaaggaaatttgataaaagaagtttgctcaactactcctgaaaagtattcagatgagccaacttttgatggaaatggacagttgctaattcccggaatgatcgacgttcatattcatggggcaaataattatgatatgatggatggctcaacagaaagcatccaagctgtttcgatggcttgtgcggaaaccggatgtactagtttcttagtcacctcggttagttcttcttttgaagacttgatccaaatgattaagcaaactaaaaaagtcattggaaaagagaaaggtgccaaaattgcaggaattcatttagaaggcccctaccttaatatagaaaaaaaaggaatgcaaaatccagcctatttaagacaccccgatttaaaagaaatgaaaaagatcttcgatgaagcagatggtctgataaaaatggtcacaattgctccagaattgcctaggggtatcgaactcattgacttcttgaaaaaaagaggagttgtggtcgccattgcacattccaatgcaacttatgaagaggcgcaaaatgctttcgaacaaggagcaacccacatcacacattgcttcaatgctatgccagccattcatcaccgggcaccaggacttgttacagcagccttggaaaatgattcggtaagcgttcaaaccattgtagacggtgtccatctccatcccggaatcgtgcgccttattcacaaaattaaaggaccagataaaatggttctcacaaccgatgcccttcaagcaatgggagttggcgacggggagtatatttttggcggtcaccaagtaacggttaaggaaggcatagctcgtttaaaagacgggacattagcttcaagtaccgtgacgatgaataaatccttaaagttaagtaatgaatttgggattcacttacaagacgctattcaaatggcagcaagtacgccggcagacattttaggaatgaacaattttggtcgaatcgaaaaaggctatgtcgctgatttagttttacttgataaaaattttgaagttctaactacatggattgatggtgaaatatattaa

SEQ ID NO: 102064 - protein, 377 aa, Listeria monocytogenes str. 4b H7858
MAVIKNVKIYKENELIDAAVITEGNLIKEVCSTTPEKYSDEPTFDGNGQLLIPGMIDVHIHGANNYDMMDGSTESIQAVSMACAETGCTSFLVTSVSSSFEDLIQMIKQTKKVIGKEKGAKIAGIHLEGPYLNIEKKGMQNPAYLRHPDLKEMKKIFDEADGLIKMVTIAPELPRGIELIDFLKKRGVVVAIAHSNATYEEAQNAFEQGATHITHCFNAMPAIHHRAPGLVTAALENDSVSVQTIVDGVHLHPGIVRLIHKIKGPDKMVLTTDALQAMGVGDGEYIFGGHQVTVKEGIARLKDGTLASSTVTMNKSLKLSNEFGIHLQDAIQMAASTPADILGMNNFGRIEKGYVADLVLLDKNFEVLTTWIDGEIY

SEQ ID NO: 102065 - DNA, 1143 bp, Novosphingobium aromaticivorans DSM 12444
  CDS (1)..(1143)
atgactgtcctcgccttccgcaacgggcgcattctcctgcccggcggcattgccgaaagtgcccggatcgagatcggcaacgaccgtatcgatgcggtcctctcgggcgacgaggctggcacaggcctcggcccatccgtcgacctcggcggtggttggctcgtcccgggcttcgtcgacacccaggtcaacggcggcggcggcgtgctgttcaacgacagcccggacgtcgcctcgcttgcccgcatcagcgcggcccatgcccgcttcggcacgaccgcgctcctgcccaccctgatcagcgccccgcgcgataccatcgcacgcgcgctcgatgcggtggacgaggcaatcgcgtccggcgttccgggcgtgatcggcatccatgtcgaagggccgttcctcaacgaggcgcggcgcggcatccacgatgcggggcagttccgcccgctcgaggacgaactgatcgcgctgctcacccgcccgcgcaagggcaaggtcatggtaacgctcgcgcctgagtgcaacgcacccgatgcggtgcgcgcgctggtcgaggcgggcgtgatcgtcagcatcggccacagcaacgccagctacgaggatgtgcgccttgccatcgccaatggcgtgcgcggcgtcacccacctgttcaacgcgatgtcgccgttccaccaccgccaccccggcgtcgtcggcgccgtgctcgaggaccgcagcctgtggtgcggtctcatcgtcgacggtgcccacgcccatccggcggcgatccgcgtggccctggccgcgcgtccggcggaccgtttcatgctggtcaccgatgcgatgccgaccgtgggaagcgagcgcaagcggttcgtcctgaatggcgaggagatcaccgtgcgcgacggcgtctgcgtgaatgccgaaggaacgctagccgggtcggacctcgacatggccaccgcaatccgcaactcggtcgaactcggcatggcgccgcacgtcgctttcgcgatggcaacgcacaaccccgccgaatttcttgggcttgaatccagccgcggcgcgatcgcacgcgggcaccatgccgatctcgtctggctcgatgcggatttccgcacccaggccacctggatcggcgggcagcgggtacgctga

SEQ ID NO: 102066 - protein, 380 aa, Novosphingobium aromaticivorans DSM 12444
MTVLAFRNGRILLPGGIAESARIEIGNDRIDAVLSGDEAGTGLGPSVDLGGGWLVPGFVDTQVNGGGGVLFNDSPDVASLARISAAHARFGTTALLPTLISAPRDTIARALDAVDEAIASGVPGVIGIHVEGPFLNEARRGIHDAGQFRPLEDELIALLTRPRKGKVMVTLAPECNAPDAVRALVEAGVIVSIGHSNASYEDVRLAIANGVRGVTHLFNAMSPFHHRHPGVVGAVLEDRSLWCGLIVDGAHAHPAAIRVALAARPADRFMLVTDAMPTVGSERKRFVLNGEEITVRDGVCVNAEGTLAGSDLDMATAIRNSVELGMAPHVAFAMATHNPAEFLGLESSRGAIARGHHADLVWLDADFRTQATWIGGQRVR

SEQ ID NO: 102067 - DNA, 1185 bp, Microbulbifer degradans 2-40
  CDS (1)..(1185)
atgatcaccgcgcttatcaatgcaaatttactgcacgcctacagagatagcggcacctatgcgggcgccgatgttgacggccaagtttgtgccgatgaagcgtacgcagtaattgttgccggtgattatattcgcgaattggtacctgtaaaccagctgcccaacgatgttgaccgcaccatagatttggggggcaattaccttgcccccggtttttttgatacccaagtcaatggtggtggcggtgtgttatttaatgatgcccccacagtagaaactttaattgctatgagcgaagcgcataaacaatttggcaccagtgcaatgctgccaacccttattagcgacgatttagatgtaatgcgcgccgctattgccgcagttaacgacgccatagagcaaggcgtgccaggtattgtaggtatccacctagaagggccttttttaaaccctgctcgcaaaggggtacacaatgccaataaatttaaagtgattgatgacgaagcattcgatattttaacgtcgcttaaaaaaggtaaaaccctcgtaactctcgcgccagagcaaaccgatacaccaacgataaaacgtttggtagatgctggtgtagtggttgcggctggtcacactgcggcgacttacgagcaaacttgccaagcgttagacgcagggctaacaagctttacccatttatttaatgccatgacgccaatgtcgagccgagagccgggggttgtgggtgccgcgttacaaagcgcaataagttggtgtggcattattgtcgatggctttcatgtgcaccctgcaaccttgggtgtagccattgctgctaagccaaagggaaaagttattttggtaactgatgctatgcctacggttggcgccgcagaaaaagtatttactttaaacggcgaagttattcgcgcagaaaatggccgctgcgccaccgccgacgatacattggcaggctcagatttagatatgttggccgcggttaaaaataccgtgcatatgataggtattcctttagaagaagccgtgaaaatggcaagccaataccccgccgatatgatggggttaggcgaatgcatgggccgaatagccccaggctaccgcgctgaatttacagcttttgatgaagattttaatttggtctcaatcgattctttagttactagaaattag

SEQ ID NO: 102068 - protein, 394 aa, Microbulbifer degradans 2-40
MITALINANLLHAYRDSGTYAGADVDGQVCADEAYAVIVAGDYIRELVPVNQLPNDVDRTIDLGGNYLAPGFFDTQVNGGGGVLFNDAPTVETLIAMSEAHKQFGTSAMLPTLISDDLDVMRAAIAAVNDAIEQGVPGIVGIHLEGPFLNPARKGVHNANKFKVIDDEAFDILTSLKKGKTLVTLAPEQTDTPTIKRLVDAGVVVAAGHTAATYEQTCQALDAGLTSFTHLFNAMTPMSSREPGVVGAALQSAISWCGIIVDGFHVHPATLGVAIAAKPKGKVILVTDAMPTVGAAEKVFTLNGEVIRAENGRCATADDTLAGSDLDMLAAVKNTVHMIGIPLEEAVKMASQYPADMMGLGECMGRIAPGYRAEFTAFDEDFNLVSIDSLVTRN

SEQ ID NO: 102069 - DNA, 1182 bp, Clostridium thermocellum ATCC 27405
  CDS (1)..(1182): transl_table=11
atggaaaaaatgaagcttgtaaaaaacggacttgttttagacagtcaaaaaggttttgaagtaaatgatatattgattgccggtgggaaaattgcaaagattggtaagaatattgaagtttcggaaacggactatgaagtcctgaatgctgaaggcttttatgttgttccgggatttattgatgtacacatgcatggagcggcaggtgtcgatattataaaggcagacccgggccggttaaatgagctgtctttgtttcttgcatccaaaggagttacgtcttttcttgctacagttatgactgattccagggagaatatctgccgtgccgttgagaatatccgtcttgccgtggaaagaggattggatggtgccaaaatagccggcattaacctggaggggccgtttataaacccaaaatacaggggagctcacccgccggaatatatactggagcctgatgtgaaattaatcgatgaacttgttgaaaaatcaggaaataatataaagcttgttacggctgcgcctgaattggacaaaattgaggaaattatccgaaagttcaaagaagacataatttttagtgcgggacattccggtgttgattttgccggggcgaaagaagcctttaaaaatggttttaaacatgtcactcacctttttaatgcaatgacaggtattcatcacagggagccggggcttgcaggagcggcgttggacagcgacgatgtcactgtggaaataattcccgacctgatacatgtgcatggagcggtaattcaaatggttgtcaagtgtaaaacaccggacagggtggttcttgtaaccgattctattttggcggccggactcggagagggaaaacttgagtttgcagaaagcatgattacagttaaagacggtgcggccgtttttgaaaacggtgtgttggccggaagtaccattacgatggcagacggtatcggaaatatggtgaaaaaattgggattcagccttgaggatacaataaaaatggcttcaacaaatcctgccaaacttataaacatttttgacaggaagggaagcctgtcagaaggaaaagatgcagatattgtaatattggacagaagtctgaatatccatgaaacaataatacagggaattacggtttactctacatttccataccctcagagtaggtga

SEQ ID NO: 102070 - protein, 393 aa, Clostridium thermocellum ATCC 27405
MEKMKLVKNGLVLDSQKGFEVNDILIAGGKIAKIGKNIEVSETDYEVLNAEGFYVVPGFIDVHMHGAAGVDIIKADPGRLNELSLFLASKGVTSFLATVMTDSRENICRAVENIRLAVERGLDGAKIAGINLEGPFINPKYRGAHPPEYILEPDVKLIDELVEKSGNNIKLVTAAPELDKIEEIIRKFKEDIIFSAGHSGVDFAGAKEAFKNGFKHVTHLFNAMTGIHHREPGLAGAALDSDDVTVEIIPDLIHVHGAVIQMVVKCKTPDRVVLVTDSILAAGLGEGKLEFAESMITVKDGAAVFENGVLAGSTITMADGIGNMVKKLGFSLEDTIKMASTNPAKLINIFDRKGSLSEGKDADIVILDRSLNIHETIIQGITVYSTFPYPQSR

SEQ ID NO: 102071 - DNA, 1161 bp, Jannaschia sp. CCS1
  CDS (1)..(1161): transl_table=11
atgagtggcggcttgcgcgccctgaccggggctgagatctttgacggcacgacgcgtcatgcccgccacgcattggtatgggatggcggggttgtgcgtggcatcgtgcccgaggcagaggtgcccgaggcggcagatgtgacgtgtctgacgggtggcctcctgtgccccgggttcgttgaccttcaggtgaatggcggtgggggcgtcctgttcaatgacgaccaaagcgttgccgccttgcgtatgatcgccgccgcccatgcaggccttggggcgacgtccattctgccgacgctgatcaccgatacgccggaccggaccgacaatgcgatctctgccgtggccgatgcgattgatcagggcgtggacggcattatcggtctgcatctggaagggccgcatctgtcggtgccccgcaaaggggcccatgatgcgacgctgatccgggcgatggacgacgcggatttggcccgccttctggacgcagccattcggttgccgctcctgaaaatcaccgtcgcgcccgagacggtcacgccggatcagatcgcagcgcttcacgatgcgggtgttctggtgtcgctaggccacagcgacgcggggttcgccacatgtcaggctgcggcaagcgcgggcgcgcgatgtgtgacccatctgttcaatgcgatgagccagcttggcaaccgcgaacccggccttgtgggcgcggccctgacactggggtcgctgtcggcggggctgattgccgatggcgttcatgtgcacgaggcctcggttcgggcggcgatggctgcaaaggcaggtccggggcagatgttcctggtcagcgatgccatggcggtcgcgggatctgacatcgacagtttcacactgaatgaccgccggatcctgcgccgcgacggtcgtctgacattggagaatggcaccttggcgggggccgaccttgacctgctgacagcggtacgaaatatggtgctgtggggcgcggcatcggaagaggtcgccctggcgatggccacttcgatccccgctgacctatgcgccgccgcgtgcaacgttggccggctggaagagggggccaaggccgacatcctgcacctgatgcccggccagacgacctgtgccgcgatctggcaatcggggcggcagatcgtctag

SEQ ID NO: 102072 - protein, 386 aa, Jannaschia sp. CCS1
MSGGLRALTGAEIFDGTTRHARHALVWDGGVVRGIVPEAEVPEAADVTCLTGGLLCPGFVDLQVNGGGGVLFNDDQSVAALRMIAAAHAGLGATSILPTLITDTPDRTDNAISAVADAIDQGVDGIIGLHLEGPHLSVPRKGAHDATLIRAMDDADLARLLDAAIRLPLLKITVAPETVTPDQIAALHDAGVLVSLGHSDAGFATCQAAASAGARCVTHLFNAMSQLGNREPGLVGAALTLGSLSAGLIADGVHVHEASVRAAMAAKAGPGQMFLVSDAMAVAGSDIDSFTLNDRRILRRDGRLTLENGTLAGADLDLLTAVRNMVLWGAASEEVALAMATSIPADLCAAACNVGRLEEGAKADILHLMPGQTTCAAIWQSGRQIV

SEQ ID NO: 102073 - DNA, 1137 bp, Shewanella baltica OS155
  CDS (1)..(1137): transl_table=11
atgaaaattaccttgatcgccgagcgtatttttgatggtgaatatttccatcaagatgtgcctgtaactgttgaagacgggcacattctggcgtttgatacggttgttggcgcgaaggaaatccgccaagtcggaacgctggtgccaggttttatcgatgtacaagtgaacggtggcggcggggcgttattcaatgccgatccgagtgttaattgcattgaaactatcggccgtgcccatgcgcgttttggcacgacaggttttttacctacgcttattaccgacgatgtcagcgtgatggcaaatgcagccgatgcagtggccgaggctttagttaagggtagcgctggcgttttaggggtgcattttgaaggaccacatttatctgtgcctaaaaaaggcgtgcatccgcaggggtttattcgcgaaatcaccgatgccgaactcgcggtattttgtcgtcaagatctggggattaaagttgtcacgcttgcgcctgagaatgtgtcgccagaggtgatccgtacgctcgttgcttcgggcgttaaggtgtgtttgggccattctaatgccgactacgatactgtgattacagcattagcggcaggcgcgacgggctttacccatctttataatgcgatgtcaccactcggttcccgtgagccgggcatggttggtgcggcgattgagagtgaaaccgcttggtgtggtttgattgtcgatggtcaccatgtgcaccctgcggcggcaaaggttgcactacgggcaaaaccgaggggcaagatgatgttagtcaccgatgctatgccgccagttggtatggaggatgagactagcttcgagctctttggtactcgagtgttaagagtcggcgacagattaaatgccgtgacaggtgagctggcgggctgtgtgctcgatatggcaactgcggtcaataatactgtgaacttgttgggtttacctttggcggaagccttgagaatggcggcgttatatcccgcacagttcctcgggattgaccataaggctggccgtttagcactgggacacagggctgactttgtcttgctcgatgtgcagaacaaagtgcaggcaaactacattgcgggacaagcagtttatacacacccttaa

SEQ ID NO: 102074 - protein, 378 aa, Shewanella baltica OS155
MKITLIAERIFDGEYFHQDVPVTVEDGHILAFDTVVGAKEIRQVGTLVPGFIDVQVNGGGGALFNADPSVNCIETIGRAHARFGTTGFLPTLITDDVSVMANAADAVAEALVKGSAGVLGVHFEGPHLSVPKKGVHPQGFIREITDAELAVFCRQDLGIKVVTLAPENVSPEVIRTLVASGVKVCLGHSNADYDTVITALAAGATGFTHLYNAMSPLGSREPGMVGAAIESETAWCGLIVDGHHVHPAAAKVALRAKPRGKMMLVTDAMPPVGMEDETSFELFGTRVLRVGDRLNAVTGELAGCVLDMATAVNNTVNLLGLPLAEALRMAALYPAQFLGIDHKAGRLALGHRADFVLLDVQNKVQANYIAGQAVYTHP

SEQ ID NO: 102075 - DNA, 1134 bp, Shewanella amazonensis SB2B
  CDS (1)..(1134): transl_table=11
atgaaaacgacccttatcgccgagcgcctgtttgatggcgagcagtttcaccacaatgtgcctttgactgtggaagacggccaggtgttggccctcgatactgtcgccggctgcgccgaggtaagattgcagggcaccctggtgcccggttttatcgatgtgcaggttaatggtggtggcggtgtgctttttaacgacaccccaaccgtggctgccattgaggccattggggcggcgcatgcccgctttggcaccacaggttatttgccgacgctcatcaccgataaggtagagaccatggcccgggccgccgatgcggccgcagaggctatcgccaaaggatccaccggggtgctcggggttcactttgaggggccgcatttgtcggtacccaaaaaaggcgtgcatcccgagtcgcacattcgccgtatcggcgatcgcgaactggagatttttgcccgtcaggatttggggctaaaggtagtgaccctggcgcctgagaatgtgtctcctgaggtgatctgcgctctggtcgatgtgggagtcaaggtctgcttgggccactccaatgctgattacgcgaccactgtcgcggcgctggaagccggtgccaccggttttacccacctttataacgccatgtcggcgctcacttcccgagagccaggcgttgtcggcgctgccatcgacagtgatgaagcctggtgcggtttgattgttgacggtcaccacgtgcattcggcggcggcccgtattgctatcaaggccaagccccgcggcaaggtgatgttggtgaccgatgccatgcctccggttggcatggatgataacgccagctttgaactctttggtattcaagtggtacgtcagggggacaagcttaatgccctgaccggagagcttgccggctgcgtgttggacatggctggtgcagtgcaaaatacagtcgacatgctgggactgcctcaggccgaagccattcgcatggcatcactttatcctgccgccttccttggtatcgacaacagggtgggaaccctgagtgtcggtaagcaagccgatatggtactgctcgatgataacggccgttgccgcggaacctggattggcggtaggcaggtgtttggcctgtga

SEQ ID NO: 102076 - protein, 377 aa, Shewanella amazonensis SB2B
MKTTLIAERLFDGEQFHHNVPLTVEDGQVLALDTVAGCAEVRLQGTLVPGFIDVQVNGGGGVLFNDTPTVAAIEAIGAAHARFGTTGYLPTLITDKVETMARAADAAAEAIAKGSTGVLGVHFEGPHLSVPKKGVHPESHIRRIGDRELEIFARQDLGLKVVTLAPENVSPEVICALVDVGVKVCLGHSNADYATTVAALEAGATGFTHLYNAMSALTSREPGVVGAAIDSDEAWCGLIVDGHHVHSAAARIAIKAKPRGKVMLVTDAMPPVGMDDNASFELFGIQVVRQGDKLNALTGELAGCVLDMAGAVQNTVDMLGLPQAEAIRMASLYPAAFLGIDNRVGTLSVGKQADMVLLDDNGRCRGTWIGGRQVFGL

SEQ ID NO: 102077 - DNA, 1161 bp, Rubrobacter xylanophilus DSM 9941
  CDS (1)..(1161): transl_table=11
gtgagccttgtggcgctcaagggaagggtggtcaccgactacgaggtctgggaagagggctgcgtcctgctcggggacggggccgtgcgcgacgtgagccgcgactggcgggcggcggaggaggccgacgaggtgcacgagctcggggagtccctcatcctgcccggcttcgtggacctgcaggtcaacggcgccttcggggtggacctcgccggcgagccggagaggctcggggagctctcggggaggctgctctcgaccggcaccaccgcctacctgccgaccgtcatcacctcccccccggaggcctacgagcgggcgctgccccacctcgccggcggcatagcggcggaacccgggggcgcccggcccctcggggtgcacctcgaggggccgttcataagccccgggcggcggggggcacaccccgcggagcacgtccgcccgccggacccggggctgctcgggcggctgctcgagctcgcgccggtgcgcatgatcaccgtcgcccccgagcttccgggcgcggacgggctgatggccgccgcccgcgaccggggtgcggtcgtctcgctcgggcactccgacgcccccttcgaggtcgcctacgtggccctcgaccgctacgccgcgggggtcacccacctcttcaacgccatgagccccctccaccaccgcgaccccgggctccccggggccgccttcgcccaccccagggccgtgtgcggcctcatcgccgacggccgccacgtccaccccgagatggtggccctcgccttccggatgctcgggcccgaccgcctctgcctcgtcaccgacgccatctccgccgccgggatggaggccggcgagttcaccctggcctcccgccgggtgcggctggagggcggtgtcccgcggctggacgacgggaccatagccgggagcgtcctcaccatggagcgggccttccagaacatcctcgccttcaccggctgcacgctccccgaggccgcccggatggccgccgccaccccggcccggctcgtcggggaggggcggcgcaaggggcggctgagcccgggctacgacgccgacgtcaccgtgctggcccccgacctctccgtggaggccgtctgggtcggcggccggcagctgtactccgctggaaaggtggtgtga

SEQ ID NO: 102078 - protein, 386 aa, Rubrobacter xylanophilus DSM 9941
MSLVALKGRVVTDYEVWEEGCVLLGDGAVRDVSRDWRAAEEADEVHELGESLILPGFVDLQVNGAFGVDLAGEPERLGELSGRLLSTGTTAYLPTVITSPPEAYERALPHLAGGIAAEPGGARPLGVHLEGPFISPGRRGAHPAEHVRPPDPGLLGRLLELAPVRMITVAPELPGADGLMAAARDRGAVVSLGHSDAPFEVAYVALDRYAAGVTHLFNAMSPLHHRDPGLPGAAFAHPRAVCGLIADGRHVHPEMVALAFRMLGPDRLCLVTDAISAAGMEAGEFTLASRRVRLEGGVPRLDDGTIAGSVLTMERAFQNILAFTGCTLPEAARMAAATPARLVGEGRRKGRLSPGYDADVTVLAPDLSVEAVWVGGRQLYSAGKVV

SEQ ID NO: 102079 - DNA, 1182 bp, Mesorhizobium sp. BNC1
  CDS (1)..(1182): transl_table=11
atggacataaccatcctcgccggggcgcgcctgtttgatggtgagcgcttcatcgaccggcacgctctcgtcgtggtggctggtcgcgttagggatatcgtgcctgaagcggaactcgccggcagacaggacgtgacgcggctcgacggcggaattctggcgccaggcttcatcgacgtgcaggtgaatggcggcggcgggcgtcttctcaacaatgatccgacgcctgaaaccttcttcgttatagcgcgggcgcatcggcaatacggcacgacggcactgctgcccactcttgtcaccgatacgcgtgaggtaacgcgcagggctgtcgaggccgcaaccgaagccgccaaggcagacgagggcgtgctcggtatccatctagagggtccacatctggcgccagcccggcgcggcgcgcatctggccgatctcatgcggccgatggacgatgaagatctcgatctcttgtgccgcgcggcgggcgccatgccggtgcttcacgttacccttgccgcagagcaggtgacgccgtggcaggtggagcggcttgccaaggccggcattatcgtgagcctcggccatacggattgcacgagcgaggatgcgctgcgcctgttcaatgcgggcgcgcggggaattacgcatctatataacgcgatgagcgcgctgtcgcaccgcgcgccggggctggtgggtgctgcccttgatgccggtgacgtctggggcggcatcattgccgatgggcatcatgtcgacccggcggcacttcgtcttgcactgcgtgccaaacgcgggccggccaagcttttccacgtaaccgacgcgatggcgctcgtcggaagcgaggccgagagtttcgagttgaacggccgtacggtgcggcgtgagccgggcgaggtctgctcgaagctggtgctcgaagacggaacattggcgggatccgaccttgatatggcgacgggcgtgcgttttggcgtgcagatgctggagctctcggtggaagagtcgctcaggatggcctgcgcctatcccgccacctatctcgggatcggcagtgagcgcggatatttgaagctgggccgccgggctgattgcatccacctttcggaggatctgcgcgtgcagcaggtatggatggcgggcaaggcgcgcttcggcagaatggcggcatgggcctag

SEQ ID NO: 102080 - protein, 393 aa, Mesorhizobium sp. BNC1
MDITILAGARLFDGERFIDRHALVVVAGRVRDIVPEAELAGRQDVTRLDGGILAPGFIDVQVNGGGGRLLNNDPTPETFFVIARAHRQYGTTALLPTLVTDTREVTRRAVEAATEAAKADEGVLGIHLEGPHLAPARRGAHLADLMRPMDDEDLDLLCRAAGAMPVLHVTLAAEQVTPWQVERLAKAGIIVSLGHTDCTSEDALRLFNAGARGITHLYNAMSALSHRAPGLVGAALDAGDVWGGIIADGHHVDPAALRLALRAKRGPAKLFHVTDAMALVGSEAESFELNGRTVRREPGEVCSKLVLEDGTLAGSDLDMATGVRFGVQMLELSVEESLRMACAYPATYLGIGSERGYLKLGRRADCIHLSEDLRVQQVWMAGKARFGRMAAWA

SEQ ID NO: 102081 - DNA, 1143 bp, Silicibacter sp. TM1040
  CDS (1)..(1143): transl_table=11
atgatgcatccccttacgacctacctcggcgggccgatctttgatggcaagcacgtgctgcaaggctttggcgcgcagtttcgcgagggcgcgcttgtggcgcttgccccggtggcggagctgcaagagcagggggaggtgattgacctaggtggggaccttctgtcgcccggctatgtcgacctgcaagtcaacggcggcgggggggtgatgctgggcgatgcgcccaatgtcgagaccattcgcaagatctgcgcggcgcatcgcagcctgggtgccaccacgatcctgccgacgctgatcaccgacaccgccgaaaagacccgtgcgacacttgaggccgggattgccgcgcatgaggccggcgtgcgtgggtttggcgggttgcatctggaaggtccacatctgtcggttgctcgcaagggcgcccatgacgccaacctgatccgcgcaatggatgacagcgaccttgctgcgatctgcacggcggctgcacgcttgcccaagctcaaggtcacggtggcggcagaaagcgtcaccccggagcaggtgatgcggatggtcgaagcgggtgtgctggtatcgcttggtcacacggatgcgccctttgatacctgcgtggactatgtgcgggccggtgcgcgctgtgccacccatctgttcaacgccatgagccagcttggcaaccgggcgccggggctggtgggagcggtgcttgataccgcagagctttcggcgggtgtgattgcggatgggatccatgtacatcctgcaagcctgcgcgccgcctggcaggcaaagcggcgcggccccgggcacctgttcctcgtctcggacgcgatggcagttgccgggaccgaggatcgcgaattcctgctcgaaggccgccggatcacgcgcagtgacggacggctgtgcctgtcggatgggactttggctggtgcggatcttgatctgaccacggccctgcgggttctggtcagccaatgcgatgtgccgctcgccgaggggctagaggcggcaacatctgtgcccgccgccctgatcggcaagtcggtggatctgacgcagccgggacagaagcaggtggatatgatccgcatcaagccggagctcagcgccgccgcgccggtactgccctga

SEQ ID NO: 102082 - protein, 380 aa, Silicibacter sp. TM1040
MMHPLTTYLGGPIFDGKHVLQGFGAQFREGALVALAPVAELQEQGEVIDLGGDLLSPGYVDLQVNGGGGVMLGDAPNVETIRKICAAHRSLGATTILPTLITDTAEKTRATLEAGIAAHEAGVRGFGGLHLEGPHLSVARKGAHDANLIRAMDDSDLAAICTAAARLPKLKVTVAAESVTPEQVMRMVEAGVLVSLGHTDAPFDTCVDYVRAGARCATHLFNAMSQLGNRAPGLVGAVLDTAELSAGVIADGIHVHPASLRAAWQAKRRGPGHLFLVSDAMAVAGTEDREFLLEGRRITRSDGRLCLSDGTLAGADLDLTTALRVLVSQCDVPLAEGLEAATSVPAALIGKSVDLTQPGQKQVDMIRIKPELSAAAPVLP

SEQ ID NO: 102083 - DNA, 1122 bp, Paracoccus denitrificans PD1222
  CDS (1)..(1122): transl_table=11
atggccgaggttctgaccggcgcgcggatctttgacggcgcgcgtttcctcgacggccatgcgctggtgatcgaggcgggcgagatcgccgcgatcctgcccgaggccgaggccccggccaaggggcggcgggcggtgccgggcatcctggccccggcctttctggacttgcaggtgaatggcggcggagggctgatgctggacggcacgaccgatctggacggtctgcgccgcatctgcgccgcgcatcgcgcgcttggcacggcgggcgtgctgccgacgctgatcaccgacacgccaaaagccaccgcccatgtcatcgcactggggatcgcggcggccgaggcgcaggtgccgggctttctgggcctgcaccttgaggggccgcatctggacccgcgtcgcaagggcgcacatgacccggcgctgatccggccgatgaccgacgaggatctggcccggctttgcgacgccgcccgccggctgccggcgctgatggtaacgctggcgcctgaagcggcgagcccgcagcagatcgccgcccttgccggggcgggcgccgtggtcagcctgggccacagcgattgcagccatgacgaggcgcaggccgcctttgccgccggcgcccgctgcgccacgcatcttttcaatgccatgagccagatcggcaaccgcgcgccggggctggccggggcggtgctggccggcaagccgagcgccgggctgatcgccgacggcatccatgtgcatccggcggtgatgcggctggcgctgggcgcgcggcccgagggcatcttcctggtcaccgattgcatggcctttgccggcaccgacctgaccgagatggaactgggcggccgcaaggttctgcgccgcgacgggcggttgacgctggccgacggcaccttggccggggccgacctgaccctgccgcaggccatcgccgtgctggtccgtcaggtcggcatcgcgcccgaacgcgcgctgcgcatggcctcggccatccccgcggcattgctgggcttgcaggaccgatatggcacgctggcccccggccgtcccgccgacctggtgctgctggacgaggacttcgccctgcgcgggcatcggctttcgccctga

SEQ ID NO: 102084 - protein, 373 aa, Paracoccus denitrificans PD1222
MAEVLTGARIFDGARFLDGHALVIEAGEIAAILPEAEAPAKGRRAVPGILAPAFLDLQVNGGGGLMLDGTTDLDGLRRICAAHRALGTAGVLPTLITDTPKATAHVIALGIAAAEAQVPGFLGLHLEGPHLDPRRKGAHDPALIRPMTDEDLARLCDAARRLPALMVTLAPEAASPQQIAALAGAGAVVSLGHSDCSHDEAQAAFAAGARCATHLFNAMSQIGNRAPGLAGAVLAGKPSAGLIADGIHVHPAVMRLALGARPEGIFLVTDCMAFAGTDLTEMELGGRKVLRRDGRLTLADGTLAGADLTLPQAIAVLVRQVGIAPERALRMASAIPAALLGLQDRYGTLAPGRPADLVLLDEDFALRGHRLSP

SEQ ID NO: 102085 - DNA, 1164 bp, Shewanella denitrificans OS-217
  CDS (1)..(1164): transl_table=11
atgaaacaaacgctaattgttgagcgattatttgatggtgagcagttccactcgaacagggtgattactatcgaggcggggaagataactcatgttcaacgggctgaagattgccaaactatagactcaagtgagcttgagtacctatcgggtactttagtgccagggtttgtggatattcaagtgaatggcggcggcggggcattgtttaatgcagagcccaatcttgagtgtattcaaactattggctgcgcccatgctcgatttggcaccagtggttttttacctacactaatcacagatgacgtctcggtaatggcaaaggctgcagatgcggtagcgttggctatttcacagaaaacggcgggggtgttaggcattcattttgaagggcctcatttgagtgtacctaaaaaaggggttcatccgcagcaatttattcgacatatatccgatgaagaactcaccatttttagacgtcaagacttagggattaaagtggtgaccttagcgcctgaaaatgtatcaagccaagtgattaaatctttggtgaatgcgggcgttagggtgtgtctcggtcattccaatgccgattatgaaaccgtaataaaagccattgaggcgggggcaacggggtttacacatttattcaatgccatgtcaggattaggttcacgcactccgggtatggttggtgcagcgctagagagccaagagacttggtgtgggctaattgtcgatggccatcatgtgcatccagcaacggccaaaatcgcgatcaaggctaagccacgggggaaagtgttgctggtcactgatgctatgccacccgtggggatggctgatgatgcgagctttgagttatttggtactaaggtgatacgtcaaggtgataggttaaatgctactacgggtgagcttgccggttgtgtgctcgatatggttggtgcggtaaataatagtgttgctatgttaggcctacctcatagcgaggccctacgtatggcggccttatatccagcgcaatacttggggctaggcgaacacttaggcttagttaaagcgggttatcaagctgatttagtgcttttaaatgaggctaaccaagtcagtcgaacctatatcgctggcaagctagtatttactcaggaacaaaagcgttaa

SEQ ID NO: 102086 - protein, 387 aa, Shewanella denitrificans OS-217
MKQTLIVERLFDGEQFHSNRVITIEAGKITHVQRAEDCQTIDSSELEYLSGTLVPGFVDIQVNGGGGALFNAEPNLECIQTIGCAHARFGTSGFLPTLITDDVSVMAKAADAVALAISQKTAGVLGIHFEGPHLSVPKKGVHPQQFIRHISDEELTIFRRQDLGIKVVTLAPENVSSQVIKSLVNAGVRVCLGHSNADYETVIKAIEAGATGFTHLFNAMSGLGSRTPGMVGAALESQETWCGLIVDGHHVHPATAKIAIKAKPRGKVLLVTDAMPPVGMADDASFELFGTKVIRQGDRLNATTGELAGCVLDMVGAVNNSVAMLGLPHSEALRMAALYPAQYLGLGEHLGLVKAGYQADLVLLNEANQVSRTYIAGKLVFTQEQKR

SEQ ID NO: 102087 - DNA, 1158 bp, Xylella fastidiosa Dixon
  CDS (1)..(1158): transl_table=11
atgggtgcttcttctggagtcgccggattcatcaatggccgtgtcctgaccgatacagggttccgtcatgatctggcggtgctattgcgtggtggatgcattcaagcactgctgccgcatgatgatccgcgggtgacggagggggcgcagtgggtggacttgcggggaggtctgttgctgcctgggtttatcgatattcaggtgaatggcggcggcggcgtgctgttcaataatgcgcgtgatgtggatggcttggccacaattgcgcgtgcgcaccgtcgctacgggacgacgggactgttacccacattgattagtgacactgtggaggtgatggctgaggccattgctgccacgcgtgccgcgattgctcagggggtacagggaatcctcgggattcacttggaaggcccttacctcaatcccctgcgtaaagggatccatgaccacactcagttccgtgtgccgcagttgcatgagctgatgcggtgcacggcattggataacggggtgactctggtgacgttggcgcctgagcaggtgccggttgagatgatccgtgtttttgtcgagcgtggtgcgatcgtctttgccgggcatacggcagcgacgtatgagcaagtgcgggctggcatcgcagcgggtgtcacagggtttacgcatctgtacaacgcgatgtcgcagttagtcgggcgcgagccgaatgtggtgggtgctgcgctggaagatccgaatacatggtgcgggatcatcgttgatggcgtacacgtacatccggcgagtctgcgtgtggccttagccgccaagccgcgcggtaaggtgctgctggtgaccgatgcgatgccaccagttggcagtgacagtgttcactacgatctctatggtgaaacgattacggtgatggatggtgtggtccgtaatgcggctggtgcgttggcgggtgccgcgctggatatggcaacggcggtgcgcaatacggtgcattggttgggtgttgatttggctgaggctgtgcgcatggcctcgacctatccggcgcagtgcatcgggttaggggatcgtctggggaggattgcgcctggttatcaagccgacctggtgtgggttgacgacgacgtgcaggtacagggcacgtggattgctggtgtgggcgcttga

SEQ ID NO: 102088 - protein, 385 aa, Xylella fastidiosa Dixon
MGASSGVAGFINGRVLTDTGFRHDLAVLLRGGCIQALLPHDDPRVTEGAQWVDLRGGLLLPGFIDIQVNGGGGVLFNNARDVDGLATIARAHRRYGTTGLLPTLISDTVEVMAEAIAATRAAIAQGVQGILGIHLEGPYLNPLRKGIHDHTQFRVPQLHELMRCTALDNGVTLVTLAPEQVPVEMIRVFVERGAIVFAGHTAATYEQVRAGIAAGVTGFTHLYNAMSQLVGREPNVVGAALEDPNTWCGIIVDGVHVHPASLRVALAAKPRGKVLLVTDAMPPVGSDSVHYDLYGETITVMDGVVRNAAGALAGAALDMATAVRNTVHWLGVDLAEAVRMASTYPAQCIGLGDRLGRIAPGYQADLVWVDDDVQVQGTWIAGVGA

SEQ ID NO: 102089 - DNA, 1158 bp, Xylella fastidiosa Ann-1
  CDS (1)..(1158): transl_table=11
atgggtgcttgttctggagtcgccggattcatcaatggccgtgtcctgaccgataccgggttccgtcatgatctggcggtgctattgcgtggtggatgcattcaagcactgctgccgcatgatgatccgcgggtgacggagggggcgcagtgggtggacttgcggggaggtctgttgctgcctgggtttatcgatattcaggtgaatggcggcggcggcgtgctgttcaataatgcgcgtgatgtggatggcttggccataattgcgcgtgcgcaccgtcgctacgggacgacgggactgttacccacattgattagtgacactgtggaggtgatggctgaggccattgctgccacgcgtgccgcgattgctcagggggtaccgggaatcctggggattcacttggaaggcccttacctcaatcccctgcgtaaagggacccatgaccatactcaattccgtgtgccgcagttgcatgagctgatgcggtgcacggcattggataacggggtgactctggtgacgttggcgcctgagcaggtgccggttgagatgatccgtgtttttgtcgagcgtggtgcgatcgtctttgccgggcataccgcagcgacgtatgagcaagtgcgcgctggcatcgcagcgggtgtcacagggtttacgcatctgtacaacgcgatgtcgcagttagtcgggcgcgaaccgaatgtggtgggtgctgcgctggaagatccgaatacatggtgtgggatcatcgttgatggcgtacacgtacatccggcgagtctgcgtgtggccttagccgccaagccgcgcggtaaggtgctgctggtgaccgatgcgatgccaccagttggcagtgacagtgttcactatgatctctatggtgaaacgattacggtgatggatggtgtggtccgtaatgcggctggtgcgttggcgggtgccgcgctggatatggcaacggcggtgcgcaatacggtgcattggttgggtgttgatttggctgaggctgtgcgcatggcctcgacctatccggcgcagtgcattgggttaggggatcgtctggggaggattgcgcctggttatcaagccgacctggtgtgggttgacgacgacgtgcaggtacagggcacgtggattgctggtgtgggcgcttga

SEQ ID NO: 102090 - protein, 385 aa, Xylella fastidiosa Ann-1
MGACSGVAGFINGRVLTDTGFRHDLAVLLRGGCIQALLPHDDPRVTEGAQWVDLRGGLLLPGFIDIQVNGGGGVLFNNARDVDGLAIIARAHRRYGTTGLLPTLISDTVEVMAEAIAATRAAIAQGVPGILGIHLEGPYLNPLRKGTHDHTQFRVPQLHELMRCTALDNGVTLVTLAPEQVPVEMIRVFVERGAIVFAGHTAATYEQVRAGIAAGVTGFTHLYNAMSQLVGREPNVVGAALEDPNTWCGIIVDGVHVHPASLRVALAAKPRGKVLLVTDAMPPVGSDSVHYDLYGETITVMDGVVRNAAGALAGAALDMATAVRNTVHWLGVDLAEAVRMASTYPAQCIGLGDRLGRIAPGYQADLVWVDDDVQVQGTWIAGVGA

SEQ ID NO: 102091 - DNA, 957 bp, Vibrio cholerae
  CDS (1)..(957): transl_table=11
atggagcatcaacattttgatggtgcattgatcgctccaggattcattgacttacaagttaatggcggtggcgatgtcatgttcaataatgacatgactcttgcgggtattgattcgatctgccgagcacacagaactcacggcaccgcctatctgcttccaaccttaatcagtgcaacaccggaacacatcaaccgtgcacttgatgccattcaatctgcaatcgaaaatcaagtctcgggtgtgttgggtattcacttagaggggccttggttaaacccagaaaagaaaggcgctcataacccagatctgttctattccccgacacccgaacaactatcacagtttcactggccaaccaaaggcaaagttcttgtaacggtcgcggctgaaaacctctccatcgactcactaaagtggttaaaggatcatcatgttactctctcgtgtggtcacagtaatgccactacagcccaattaaccactgagaagttagctctcattgatggatttacccacttatttaatgccatgtcgccttttgagagtcgtgaacccggagttgtcggtacagcattgaataccgatcatgcttggtgttcagtaataactgatggaattcatgtccatccacaaagctttttactcgctaagcgaatcaaacctaaagacaaacttcttattgttaccgattccatggctagccttggcagtgtgactaaccagtttgaattggatggggaaaccattcgcgtcatcgataataaactggttaatagccgaggcaaccttgcgggagcacacatcgggatggatgaatcggttgccaatgttattcgttggggaatcgcggaagatgaagcactaagaatggcctcgtcttatccggctcaagcaatccattgtgatgatttagggcaactaaagcccaattatcgagccgccgccactgtatag

SEQ ID NO: 102092 - protein, 318 aa, Vibrio cholerae
MEHQHFDGALIAPGFIDLQVNGGGDVMFNNDMTLAGIDSICRAHRTHGTAYLLPTLISATPEHINRALDAIQSAIENQVSGVLGIHLEGPWLNPEKKGAHNPDLFYSPTPEQLSQFHWPTKGKVLVTVAAENLSIDSLKWLKDHHVTLSCGHSNATTAQLTTEKLALIDGFTHLFNAMSPFESREPGVVGTALNTDHAWCSVITDGIHVHPQSFLLAKRIKPKDKLLIVTDSMASLGSVTNQFELDGETIRVIDNKLVNSRGNLAGAHIGMDESVANVIRWGIAEDEALRMASSYPAQAIHCDDLGQLKPNYRAAATV

SEQ ID NO: 102093 - DNA, 1230 bp, Mus musculus
  CDS (1)..(1230)
atgcgtagcgggcagtgcgcagcgggggccccggtgctccagttcaccaactgccgcatcctgcgtggcggcacgctcctcagggaggatctgtgggtgcgcgggggccgaatcctggacccagaaaagctgttttttgaggagaggcgtgtggctgatgagcagcgggactgcggaggccgcatcctggcgcctggctttatcgatgtgcagatcaacggtggatttggtgttgacttctccaaggctacggaggacgtgggttcgggggtcgccctagtggcccggaggctcctgtcccacggtgtcacctccttctgtcccaccctggtcacctccccaccagaggtttatcacaaggtccttcctcagatccctgtgaagagtggaggtccccatggggcaggggtcctcggggtgcacttggagggcccattcatcagccgggaaaagcggggtgcacaccccgaggcctacctccgctcctttgaagccaatgcttttcatgatgtgttggccacatatgggcccctggacaacgtctgcattgtgacacttgcccctgaactagaccggagccatgaagtgatccaggcactgacagcccaaggcatccgtgtgtctctagggcactcagtggccgacctgcgggctgcagaagtggcagtgcagagtggggccaccttcatcactcacctcttcaatgccatgttgcctttccaccaccgtgacccaggcatagtagggcttctgaccagtgaccagctgcccccaggccactgcatcttctatgggatgattgctgatggcatacacaccaaccctgcagctctgcgcattgctcaccgggcccatccccaggggctggtgctggtcactgatgctgtccctgccctgggcttgggcaatggccgccatacactgggacagcaggaggtggaggtagatgggctaatagcgtacattgcaggcaccaagacactgggtggcagcatagcccccatggatgtgtgcgtccggcatttcctgcaggctacaggctgtagtgtggagtcggccatggaagctgcctccctccaccctgcccagatgctggggctggagaagaccaaggggagcctggactttggtgctgatgcagactttgtggtgctcgacgacactctccatgtccaggccacttacatctctggtgaattggtgtggcaggcagaggaagctgggccgtga

SEQ ID NO: 102094 - protein, 409 aa, Mus musculus
MRSGQCAAGAPVLQFTNCRILRGGTLLREDLWVRGGRILDPEKLFFEERRVADEQRDCGGRILAPGFIDVQINGGFGVDFSKATEDVGSGVALVARRLLSHGVTSFCPTLVTSPPEVYHKVLPQIPVKSGGPHGAGVLGVHLEGPFISREKRGAHPEAYLRSFEANAFHDVLATYGPLDNVCIVTLAPELDRSHEVIQALTAQGIRVSLGHSVADLRAAEVAVQSGATFITHLFNAMLPFHHRDPGIVGLLTSDQLPPGHCIFYGMIADGIHTNPAALRIAHRAHPQGLVLVTDAVPALGLGNGRHTLGQQEVEVDGLIAYIAGTKTLGGSIAPMDVCVRHFLQATGCSVESAMEAASLHPAQMLGLEKTKGSLDFGADADFVVLDDTLHVQATYISGELVWQAEEAGP

SEQ ID NO: 102095 - DNA, 1215 bp, Synechococcus sp
  CDS (1)..(1215): transl_table=11
atgaccgctgctcctaccctgctgacgaatattcgcattccgggctgtgcagaggttcagcgtctctggcttgatgctgccggtattgtgcagtcgattgagccgatgtcgcaaaccttcgatcgcctgccgcctccccaactgcgaatgattgacctgcagggcgactggctctctctgggcggcattgacctgcaaatcaatggggcactggggctggcctttcctgaagtgcaagccagcgatcgcaatcgcctcttagccatttgccgccggctctgggaacagggtgttgatgcttttaccccaaccttagtcaccagctcgatcgcacagtttcggcaggccattgaggcaatcgcggacttcgtggcgcagcccttgccaccccgccacgccaaaattttgggactccatctggaagggccttgccttgcagaatctaagcgcggcgctcacccacaggagcatttgcaaccgctgacggtcgaagttctatcggagatctgtggcgatcacttggcgcaaattcggattgtcaccctcgcaccggagttggatcccacaggggaagcgatcgcttggctgcgtcagcagggtgtgattgtcagcttggggcattcccaagccacagcagagcaggcccaagtcgcttttcagcagggcgcaaccatggtaacccacgcctttaatgccatgccgcccttgcatcatcgtcagcccgggctgttgggcgcagcattgactacggacaccgtgtttgcgggattgattgcggatggtcagcacatcgatccaattatgctgaaattgttgctgcgagccggtgagggcgatcgccgattgtttctggtcagcgatgccttagctcccttgggcttacccgacggtcagtatccctgggacgaacgacaaatcacagtcaccgccggcacttgtcgactcgaagatggcaccctcgccggcaccaccctgccgctactggcaggggttcaaaatttggtgcgctggcaggtctgtgaaccggaaaccgcgatcatgctggcgaccctagcacctctgcgggccttgggggtggattggtcggatccgcgtcttctctatttgtcccgtcccgtctgtcagctgctgcgctggcaccagtccgacacgggagaactgacttggcagaggctctgcgaaaacgacgaattaccgactcctacgtcgatctag

SEQ ID NO: 102096 - protein, 404 aa, Synechococcus sp
MTAAPTLLTNIRIPGCAEVQRLWLDAAGIVQSIEPMSQTFDRLPPPQLRMIDLQGDWLSLGGIDLQINGALGLAFPEVQASDRNRLLAICRRLWEQGVDAFTPTLVTSSIAQFRQAIEAIADFVAQPLPPRHAKILGLHLEGPCLAESKRGAHPQEHLQPLTVEVLSEICGDHLAQIRIVTLAPELDPTGEAIAWLRQQGVIVSLGHSQATAEQAQVAFQQGATMVTHAFNAMPPLHHRQPGLLGAALTTDTVFAGLIADGQHIDPIMLKLLLRAGEGDRRLFLVSDALAPLGLPDGQYPWDERQITVTAGTCRLEDGTLAGTTLPLLAGVQNLVRWQVCEPETAIMLATLAPLRALGVDWSDPRLLYLSRPVCQLLRWHQSDTGELTWQRLCENDELPTPTSI

SEQ ID NO: 102097 - DNA, 1242 bp, Candida albicans
  CDS (1)..(1242): transl_table=12
atgtcatttactagattcacaaactgtcatttgattgataacggtgagttgtatgagtttactgacttgtacgtcaacaacgccaccaaaagaatttgtcatccgccagcaaaccctgagttggttagtgaggttatagatttgaagcagcaaatattagcacctgggtttattgatattcagaataacggtatttatgggttgaacttttccaatcttggcgaggagtctaccgcagaggatgttgctgagtttaagcggttctatagagatgctatggccaagtatttgagtactggggttactgctacgtgtcctactgtcacatcaagcttcccagaagtgtatgccaaagtgttgccaatgtacaagaggagtgttttggcaagtcagacagattcgcttggagctcatgttgaggggccatttatcaatgtgcaaaagaaagggtgccacccagtcgaaacgtttgttgatgccaaagagggtgaatcaaaattgttagaagtttacggggacttgtttgataatgtgtgtattgtcactgctgctcctgaaattgctggtgttttagacttgatacctgttgttaaatccaagaactgtgtgttttccattggccatacgatgtcggattatgacacagccgtgaaagctgttgagaaaggtgctacgatgatcacacacttgtacaatgccatgccacagccacatcaccgtaatgctggtgttgtgggtttgattaattcgcctattgttgataccccatatttcgggttgatctgtgatggtgtacatgttgacccgtcgatggccaaccttgcatataggtcgaaccccagcaaatgtgttttggtgactgatgctatgcacttgataggtttgcctgatggccactacaaatgggactcgcaggttattgtaaagactggcgatcggttgtatttggagaataccgacacgttagctggagctgccactacgttgccgcaatgtgtgcgtaacctagtcaagtggtcgcaaatcagcttgccccaagcggtgatgactgttactaataatgctgccaagtcgattggcgttgaccacgagcgtgggtttttgaatgttgggtgtttagctgattttgttgttttagacaagagtgggtttgttcggaaagtctacaagttgggacgtgaagtccagtcgtcagatatacctttagatagagctactgataaattaactgctgttttatag

SEQ ID NO: 102098 - protein, 413 aa, Candida albicans
MSFTRFTNCHLIDNGELYEFTDLYVNNATKRICHPPANPELVSEVIDLKQQILAPGFIDIQNNGIYGLNFSNLGEESTAEDVAEFKRFYRDAMAKYLSTGVTATCPTVTSSFPEVYAKVLPMYKRSVLASQTDSLGAHVEGPFINVQKKGCHPVETFVDAKEGESKLLEVYGDLFDNVCIVTAAPEIAGVLDLIPVVKSKNCVFSIGHTMSDYDTAVKAVEKGATMITHLYNAMPQPHHRNAGVVGLINSPIVDTPYFGLICDGVHVDPSMANLAYRSNPSKCVLVTDAMHLIGLPDGHYKWDSQVIVKTGDRLYLENTDTLAGAATTLPQCVRNLVKWSQISLPQAVMTVTNNAAKSIGVDHERGFLNVGCLADFVVLDKSGFVRKVYKLGREVQSSDIPLDRATDKLTAVL

SEQ ID NO: 102099 - DNA, 1155 bp, Escherichia coli
  CDS (1)..(1155): transl_table=11
atgtccggtcgaggaaggaatatgacacacgttctgcgcgccagaaggctgctgactgaagagggatggctcgatgaccatcagttgcgtattgctgacggtgtcatcgcagcaatcgaaccgattccagcgggcgtgactgaacgcgatgcggaactgctctgccctgcttacatcgacacccatgtacacggtggtgcgggcgttgatgtaatggatgacgcgccggatgtactcgacaagctggcaatgcacaaggcacgcgaaggtgtcggcagttggttaccgaccaccgtaaccacgccgcttaataccattcatgcggcgctgaaacgtattgctcaacgttgccaacgcggcggacctggtgcgcaagtgctggggagttatctcgaaggaccgtacttcacgccgcagaataaaggcgcgcatccgccggagttgttccgcgagcttgaaattgccgagctggatcagttgattgccgtttctcagcacaccttacgtgtggtagcgctggcaccggaaaaagaaggggcattgcaggccatccgccatcttaaacagcaaaacgtaaaggtgatgctggggcatagggcggcgacctggcaacaaacccgcgccgcatttgatgcttgtgccgaccgccttgtgcattgctataaccggatgacaggtttacatcaccgcgaaccgggaattgtttgcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagctgggatgccggatggtcgctatacgttatgtggtgaagaagtgcagatgcacggtggcgttgtccgtaccgcgtctggtgggctggcgggcagtacgctgtctgttgatgcggcagtgcgcaatatggtcgagttgacgggcgtaacgcctgcggaggccatccatatggcgtcgctgcatccggcgcgaatgctgggtgttgatggtgttctgggatcgcttaaaccgggcaaacgcgccagcgtcgttgcgctggatagcgggctacatgtgcaacaaatctggattcagggtcaattagcttcgttttga

SEQ ID NO: 102100 - protein, 384 aa, Escherichia coli
MSGRGRNMTHVLRARRLLTEEGWLDDHQLRIADGVIAAIEPIPAGVTERDAELLCPAYIDTHVHGGAGVDVMDDAPDVLDKLAMHKAREGVGSWLPTTVTTPLNTIHAALKRIAQRCQRGGPGAQVLGSYLEGPYFTPQNKGAHPPELFRELEIAELDQLIAVSQHTLRVVALAPEKEGALQAIRHLKQQNVKVMLGHRAATWQQTRAAFDACADRLVHCYNRMTGLHHREPGIVCAGLTDKRAWLELIADGHHVHPAAMSLCCCCAKERIVLITDAMQAAGMPDGRYTLCGEEVQMHGGVVRTASGGLAGSTLSVDAAVRNMVELTGVTPAEAIHMASLHPARMLGVDGVLGSLKPGKRASVVALDSGLHVQQIWIQGQLASF

SEQ ID NO: 102101 - DNA, 1215 bp, Homo sapiens
  CDS (1)..(1215)
atgcgcggcgacagggccggcgggggccccgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccgggagatcctgtcgcacgggtcacctccttctgccccaccctggtcacttcccaccggagtttatcacaaggttgttcctcagatccctgtgaagagtggtggtccccatgggcaaggggtcctcgggctgcacctggagggccccttcatcagccgggagaagcggggcacgcaccccgaggcccacctccgctccttcgaggccgatgccttccaggacttgctggccacctacgggcccctggacaatgtccgcatcgtgacgctggccccagagttgggcgtagcacgagtactccgggcgctgacggcgtggatctgcgtgtccctagggcactcagtggctgacctgcgggcggcagaggatgctgtgtggagcggcaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtga

SEQ ID NO: 102102 - protein, 404 aa, Homo sapiens
MRGDRAGGGPVLQFTNCRILRGGKLLREDLWVRGGRILDPEKLFFEERRVADERRDCGGRILAPGFIDVQINGGFGVDFSQATEDVGSGVALVAREILSHGSPPSAPPWSLPTGVYHKVVPQIPVKSGGPHGQGVLGLHLEGPFISREKRGTHPEAHLRSFEADAFQDLLATYGPLDNVRIVTLAPELGVARVLRALTAWICVSLGHSVADLRAAEDAVWSGTFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 102103 - DNA, 1164 bp, Bacillus sphaericus
  CDS (1)..(1164): transl_table=11
atgtttttcttgagtttaataattcggaacatcacagtggtcaatgcgagtggtcgagatgaacagatggatgtgtggatgaaggacggcaaaattgctcagattgcccagcatattcacgcgcagggcgttgatcaattagagggttcaggaaagtttttattgccaggatttattgacatgcatattcacgggtctgcccaaatggatacgatggatgcatctgatgaagggttacatattcatggcccgatcactattaaagagggtaccaccagctttttagccactacgatgacgcaaagctttgactggttcgaccgggcccagcgtcaatgtggcaataatttcagcccaaagtcagatgaagcggaagtacttggtctgcatattgagggacctttcgtatcgaagcagcgtgcaggagctcagccacttgattatattgtccagccagatatggaagtcattaaaaaatggcaagcattaagtggtcaaaaaattaaacaaattacgctggcaccggaggaacctaatggaatggcagctgtccaaagcctttctgaaagtggcgttattgtatcaattggtcattccgacgctacatttgagcaaatgcaggaagctgttcaattaggtgcatcacaggggactcatttatacaatcaaatgcgtccattccatcatcgtgatccaggtgtggttggtggtgttttgctagtagatgccataaaggctgaactaattgttgattttattcatatgcatgaaggagctgtggaaatggcttatcgcttgaagggggcagacggcattattttaataacggatgcgatgcgagcgaagggtatgccctacggtgaatatgatttaggtggtcaattggtgcatgtgacagaatcaggcgcacatttatcgaacggttcactggcaggcagtattttaacaatggatcaagcagtacgaaatatgcgtcagattaccaactgtacattggaggagcttgtgaaaatgtccagctataatgctgcccagcaattaaaattaacgaacaaagggcagcttacagaagggtatgatgcggatgcagtgattgtagatgaacacttgctgctccatcaaacgattaaagctggccggatcagggtgcagacaaacaattag

SEQ ID NO: 102104 - protein, 387 aa, Bacillus sphaericus
MFFLSLIIRNITVVNASGRDEQMDVWMKDGKIAQIAQHIHAQGVDQLEGSGKFLLPGFIDMHIHGSAQMDTMDASDEGLHIHGPITIKEGTTSFLATTMTQSFDWFDRAQRQCGNNFSPKSDEAEVLGLHIEGPFVSKQRAGAQPLDYIVQPDMEVIKKWQALSGQKIKQITLAPEEPNGMAAVQSLSESGVIVSIGHSDATFEQMQEAVQLGASQGTHLYNQMRPFHHRDPGVVGGVLLVDAIKAELIVDFIHMHEGAVEMAYRLKGADGIILITDAMRAKGMPYGEYDLGGQLVHVTESGAHLSNGSLAGSILTMDQAVRNMRQITNCTLEELVKMSSYNAAQQLKLTNKGQLTEGYDADAVIVDEHLLLHQTIKAGRIRVQTNN

SEQ ID NO: 102105 - DNA, 1191 bp, Bacillus subtilis
  CDS (1)..(1191): transl_table=11
atggcagagagtcttcttatcaaagacattgcgatcgtgacagaaaatgaagtaatcaaaaacggctatgtcggaatcaatgacggaaaaatcagcacagtttcaacagaacggcccaaggagccatattcaaaagagattcaagcacctgcggattccgttttgcttcccggcatgattgacattcatatccacggcggctatggcgcagatacaatggatgctagcttttccacgctcgacatcatgtcgtcaagactgcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcctaaaagagccggagcgcagccaaaggagtggattaggccttcggatgttgagcttttcaaaaagtggcagcaggaggcgggcggactgatcaaaattgttacacttgcgccggaggaggatcagcattttgaactgatccgccatttgaaagacgaatcgattatcgcatccatggggcacacggatgccgattccgcattgctgtcggatgccgcaaaagcaggggcgagccatatgactcatctgtacaacgcgatgagcccgtttcatcaccgagagcccggagtgatcggaacggcgctggcccatgatgggtttgtgacagagcttatcgccgatggcattcactcccatcctttagctgcaaagcttgcttttttggcgaaaggcagcagcaagctcattttaattaccgattccatgagggcaaaaggactgaaagacggcgtatatgagttcggcggccaaagtgtgacggtaagaggacgaacagcacttctttcagacggaacccttgccggttcgatcctcaaaatgaacgaaggcgcacggcatatgcgtgagtttacaaattgctcttggacggatatagctaatataacttctgaaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatga

SEQ ID NO: 102106 - protein, 396 aa, Bacillus subtilis
MAESLLIKDIAIVTENEVIKNGYVGINDGKISTVSTERPKEPYSKEIQAPADSVLLPGMIDIHIHGGYGADTMDASFSTLDIMSSRLPEEGTTSFLATTITQEHGNISQALVNAREWKAAEESSLLGAELLGIHLEGPFVSPKRAGAQPKEWIRPSDVELFKKWQQEAGGLIKIVTLAPEEDQHFELIRHLKDESIIASMGHTDADSALLSDAAKAGASHMTHLYNAMSPFHHREPGVIGTALAHDGFVTELIADGIHSHPLAAKLAFLAKGSSKLILITDSMRAKGLKDGVYEFGGQSVTVRGRTALLSDGTLAGSILKMNEGARHMREFTNCSWTDIANITSENAAKQLGIFDRKGSVTVGKDADLVIVSSDCEVILTICRGNIAFISKEADQI

SEQ ID NO: 102107 - DNA, 1257 bp, Caenorhabditis elegans
  CDS (1)..(1257)
atgctaccgagaaaattaaaaatcgattcaactgagctcgctgaaatcacaaatgaactagtgcagttcttaaactgcttggttctaagatcgggtggactcaaaaaagaacatatttgggttagaaatggaagaattttggatgaaaggactgtatttttcgaagaaaaaacgatggcagacgttcagattgattgcgagggccttattctttcaccaggatttatcgatcttcaattgaacggtggattcggaatcgacttttcaacttataactctgatgacaaagaatatcaagaaggactggcattggttgcgaaacaacttcttgctcatggcgtaactagtttctcgccaaccgttatcacaagttctccagaaacttatcataagattcttccacttcttaaaccttccaatgcatcatcagaaggagcaggaaaccttggcgctcacctcgaaggaccattcatctcagctgataaaagaggatgtcatccagaacagctcgttatcacttcactttccccaaaccctgtcgaaattatcgaacacgtgtatggaagcactgaaaatatcgccatagtaacaatggcgccagaattggaaggagctcaagaagctattgaatatttcgtttccactggtaccaccgtatccgttggacattcatctgccaagcttggacccggagaaatggctgtactatctggtgcgaaaatgattacgcatttgttcaatgctatgcaatcgtaccatcatcgcgaccctggtctcatcggacttctgacttcatcaaaattgactcctgatcatccattatattatggaatcatttccgatggaatacacactcatgactcagcacttcgaattgcttaccatactaactctgctggtcttgttcttgtaaccgacgctattgctgcacttgggatgtctgatggagttcacaaactcggaactcagaccattcatgtgaaaggtcttgaagcgaaacttgatgggacaaatacgacggctggaagtgttgcgagtatgccatactgtattcggcatctcatgaaagctacagggtgtcccatcgaatttgctcttcaaagtgccacgcataaacctgcgaccctgctcggtgttagtgatgagaaaggaacattggatgtgggaagactcgccgattttgtattgatcgataaaaacgtcactgttaaagcgactttctgttctggaaaacgagtatttttggcccaagactaa

SEQ ID NO: 102108 - protein, 418 aa, Caenorhabditis elegans
MLPRKLKIDSTELAEITNELVQFLNCLVLRSGGLKKEHIWVRNGRILDERTVFFEEKTMADVQIDCEGLILSPGFIDLQLNGGFGIDFSTYNSDDKEYQEGLALVAKQLLAHGVTSFSPTVITSSPETYHKILPLLKPSNASSEGAGNLGAHLEGPFISADKRGCHPEQLVITSLSPNPVEIIEHVYGSTENIAIVTMAPELEGAQEAIEYFVSTGTTVSVGHSSAKLGPGEMAVLSGAKMITHLFNAMQSYHHRDPGLIGLLTSSKLTPDHPLYYGIISDGIHTHDSALRIAYHTNSAGLVLVTDAIAALGMSDGVHKLGTQTIHVKGLEAKLDGTNTTAGSVASMPYCIRHLMKATGCPIEFALQSATHKPATLLGVSDEKGTLDVGRLADFVLIDKNVTVKATFCSGKRVFLAQD

SEQ ID NO: 102109 - DNA, 1146 bp, Haemophilus influenzae
  CDS (1)..(1146): transl_table=11
atgaaatacgcattaattaattgtgtaatttacacaaaatatgatgttttacgtgattttgctgtaattattaacggtgaaattattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaaggaccttatctcagcattgagaaaaaaggcgtacaccgtcccgaatatattcgtgaaattacgcctgaaatgaaagattttctctgcgaaaatggtgatgtgattacaaaaatgaccattgccgcagaaaacccaaccattaactatacgcctgattttgtgaaagcgggcattattgtctctgtaggccattctaatgccacttatgaagtggctaaagccgcattccacaaaggcgcaacttttgcgactcacttgcataatgcgatgtcgccaattagttctggacgtgaaatgggcgtagtgggtgcagtattagattctgatgtttacactggcattatcgtcgatggtgtgcatatcaattacggcaatgttcgcattgataaaaaaatcaaaggcgacaaactttgtattgtgactgactctattgcagctgcaggcgcaccgccagaactagaaagttttacctttgtgggaaaaacaatttatatcaaagaagggcgttgctatgatgcgaatgacacaattgcaggggcatcaatcacaatgatggaatccattaaaaatgcggtagaatatgtcgaaattcctcttgcggaagccattagaatgagtaacctttatcctgcacgagcaattggtatagatgatcgtttaggttcggtagaaaaaggtaagatagcaaacttagccgtgtttacgccaaattaccaagtaatcggcacagtagtaaacggaaagtggaaagagaattaa

SEQ ID NO: 102110 - protein, 381 aa, Haemophilus influenzae
MKYALINCVIYTKYDVLRDFAVIINGEIIEAVIPQAELETGIKTIDLQGNNLTAGFIDLQLNGCGGVMFNDQTSVETLEIMQETNLKSGCTSFLPTFITAPDENIKSAVKIMREYLNKHKNQALGLHIEGPYLSIEKKGVHRPEYIREITPEMKDFLCENGDVITKMTIAAENPTINYTPDFVKAGIIVSVGHSNATYEVAKAAFHKGATFATHLHNAMSPISSGREMGVVGAVLDSDVYTGIIVDGVHINYGNVRIDKKIKGDKLCIVTDSIAAAGAPPELESFTFVGKTIYIKEGRCYDANDTIAGASITMMESIKNAVEYVEIPLAEAIRMSNLYPARAIGIDDRLGSVEKGKIANLAVFTPNYQVIGTVVNGKWKEN

SEQ ID NO: 102111 - DNA, 1137 bp, Vibrio cholerae
  CDS (1)..(1137): transl_table=11
atgtatgcgctaacgaactgcaaaatctacacaggcaatgatgtgcttgtgaaacatgcggtaatcatcaacggtgacaaaattgaagccgtttgccctatcgaatctcttccatctgagatgaatgtggtcgacctaaacggtgcaaacctcagccctggttttatcgatttacagctgaatggctgtggtggtgtgatgttcaatgatgaaatcacagcggaaaccatcgataccatgcacaaagctaaccttaaatcgggctgtaccagcttccttccaacgctgatcacttcttccgatgagaacatgcgccaagcaattgccgccgctcgcgaatatcaggctaaatacccaaatcaatcgcttggtcttcatttagaagggccttatctgaatgtcatgaaaaaagggatccacagcgttgacttcatccgcccctctgacgatacgatgattgatacgatttgtgccaatagtgatgtgatcgccaaagtcactctcgcgccagaaaataataagcctgaacatattgagaagctggttaaagcgggaattgttgtttccattggacacacaaacgcgacctatagcgaagcacgtaaaagctttgaatccggcattacctttgcgacccacctctttaacgcaatgaccccgatggtaggtcgtgaaccaggagtggtcggggcgatttatgatacacctgaggtgtatgcgggcatcatcgccgatggcttccatgttgattacgcaaacatccgaattgcccacaaaattaagggtgaaaagctcgtattagtgaccgatgccacagctcctgcaggcgctgaaatggattactttatttttgtcggtaagaaagtatattaccgagatggcaaatgtgttgatgaaaatggcacgcttggcggttcagccctaacaatgattgaagcagttcaaaatacggttgagcatgtcggtatcgctttagatgaagctctgcgaatggctactctgtatccagcgaaagcaatcggtgttgatgagaaactcggtcgtatcaagaaaggtatgatcgccaacctgactgtttttgatcgtgacttcaacgtaaaagcgacggtagttaacggacaatacgagcagaattga

SEQ ID NO: 102112 - protein, 378 aa, Vibrio cholerae
MYALTNCKIYTGNDVLVKHAVIINGDKIEAVCPIESLPSEMNVVDLNGANLSPGFIDLQLNGCGGVMFNDEITAETIDTMHKANLKSGCTSFLPTLITSSDENMRQAIAAAREYQAKYPNQSLGLHLEGPYLNVMKKGIHSVDFIRPSDDTMIDTICANSDVIAKVTLAPENNKPEHIEKLVKAGIVVSIGHTNATYSEARKSFESGITFATHLFNAMTPMVGREPGVVGAIYDTPEVYAGIIADGFHVDYANIRIAHKIKGEKLVLVTDATAPAGAEMDYFIFVGKKVYYRDGKCVDENGTLGGSALTMIEAVQNTVEHVGIALDEALRMATLYPAKAIGVDEKLGRIKKGMIANLTVFDRDFNVKATVVNGQYEQN

SEQ ID NO: 102113 - DNA, 1200 bp, Vibrio furnissii
  CDS (1)..(1200): transl_table=11
atggaatctaaatcgcacgcacactgttttcgcgctcagcgagtgctgcatggcaagcaatggcagcaagacgctgtggtgacggtcgatgaaaatggaacgatcagcgccatcgaatcgtatgacggtcagcgtcatgccgatgcgattcctcttggccctgtggatttgatgccggggctgatcgatagccatgtgcacggcagtcaagggtgcgatgttatggatgcaacgcatgacagcctcaacaccatgtcacgctatttcgccactttaggagtgaccgcgtttgtcgcaacaaccgtgacggcgcctgtggccaaaattcgggcggcactggcacaagtggccaaaagtaagcacgacggcgtcgatggggcggagattcttggcgcgtatttggaagggccctatttcaccgaaaaaaacaaaggcgcacacccgacccaatggtttcgtgagttggccgtagaagagctggaagattggatctcttacagcgacaaccaactgctcaaagtggccttagcgccggaaaaaactggcgcgctggacgccattcgttatctcgatgcgcatggcattcacgtcatgttgggccacagcgacgccgactacgagcaagtgaaggcggcgttggcggcgggcgcaaaagggattgtgcattgctacaacggaatgcgcggtctgcatcatcgcgatccgggcgtggtgggcgcggggctgctacatccgcactgttttgtggaaatgattgccgatggtcaccatgtgcatcctgccgcgattgatgttgctcatcgctgctgtggctcgcgcatgacattgatcaccgatgccatgcgcgcgactggcatgccagatgggcaatacaccttgggcgaataccaagttgacatgaagcaaggggtggtcatgacctcctcgggaggattggctggcagcacattaacattgcttcgtggcgtcaagaacattcaccgttggctcaatgtgccgattgagcaagcgtggctgatggcgtcgtacacgcccgccgaatcgttaggcattcaacatcagctggggagcttggaagtggggaaatacgcttctatggtcgctgtcagttctgatttctcaattgaaaaaacgtgggtgaaagggcgtctggtctttgatgccgcgacctcaccccgtcaggaggctctatgtatctaa

SEQ ID NO: 102114 - protein, 399 aa, Vibrio furnissii
MESKSHAHCFRAQRVLHGKQWQQDAVVTVDENGTISAIESYDGQRHADAIPLGPVDLMPGLIDSHVHGSQGCDVMDATHDSLNTMSRYFATLGVTAFVATTVTAPVAKIRAALAQVAKSKHDGVDGAEILGAYLEGPYFTEKNKGAHPTQWFRELAVEELEDWISYSDNQLLKVALAPEKTGALDAIRYLDAHGIHVMLGHSDADYEQVKAALAAGAKGIVHCYNGMRGLHHRDPGVVGAGLLHPHCFVEMIADGHHVHPAAIDVAHRCCGSRMTLITDAMRATGMPDGQYTLGEYQVDMKQGVVMTSSGGLAGSTLTLLRGVKNIHRWLNVPIEQAWLMASYTPAESLGIQHQLGSLEVGKYASMVAVSSDFSIEKTWVKGRLVFDAATSPRQEALCI

SEQ ID NO: 102115 - DNA, 23 bp, Artificial sequence
  primer
atgtatgcattaacccagggccg

SEQ ID NO: 102116 - DNA, 24 bp, Artificial sequence
  primer
ttattgagttacgacctcgttacc

SEQ ID NO: 102117 - protein, 475 aa, Artificial sequence
  Variant (2)..(9): xaa in position 2 to 9 is any amino acid
  Variant (10)..(21): xaa in position 10 to 21 is any or no amino acid
  Variant (23)..(26): xaa in position 23 to 26 is any amino acid
  Variant (27)..(28): xaa in position 27 to 28 is any or no amino acid
  Variant (30)..(42): xaa in position 30 to 42 is any amino acid
  Variant (43)..(58): xaa in position 43 to 58 is any or no amino acid
  Variant (60)..(60): xaa in position 60 is any amino acid
  Variant (63)..(63): xaa in position 63 is any amino acid
  Variant (66)..(67): xaa in position 66 to 67 is any amino acid
  Variant (69)..(69): xaa in position 69 is any amino acid
  Variant (71)..(72): xaa in position 71 to 72 is any amino acid
  Variant (74)..(80): xaa in position 74 to 80 is any amino acid
  Variant (81)..(94): xaa in position 81 to 94 is any or no amino acid
  Variant (96)..(97): xaa in position 96 to 97 is any amino acid
  Variant (99)..(105): xaa in position 99 to 105 is any amino acid
  Variant (107)..(107): xaa in position 107 is any amino acid
  Variant (109)..(112): xaa in position 109 to 112 is any amino acid
  Variant (114)..(114): xaa in position 114 is any amino acid
  Variant (117)..(121): xaa in position 117 to 121 is any amino acid
  Variant (123)..(135): xaa in position 123 to 135 is any amino acid
  Variant (136)..(148): xaa in position 136 to 148 is any or no amino acid
  Variant (150)..(150): xaa in position 150 is any amino acid
  Variant (158)..(162): xaa in position 158 to 162 is any amino acid
  Variant (164)..(169): xaa in position 164 to 169 is any amino acid
  Variant (171)..(184): xaa in position 171 to 184 is any amino acid
  Variant (185)..(199): xaa in position 185 to 199 is any or no amino acid
  Variant (201)..(202): xaa in position 201 to 202 is any or no amino acid
  Variant (204)..(204): xaa in position 204 is any amino acid
  Variant (209)..(213): xaa in position 209 to 213 is any amino acid
  Variant (214)..(215): xaa in position 214 to 215 is any or no amino acid
  Variant (217)..(221): xaa in position 217 to 221 is any amino acid
  Variant (222)..(224): xaa in position 222 to 224 is any or no amino acid
  Variant (226)..(228): xaa in position 226 to 228 is any amino acid
  Variant (233)..(233): xaa in position 233 is any amino acid
  Variant (235)..(241): xaa in position 235 to 241 is any amino acid
  Variant (243)..(243): xaa in position 243 is any amino acid
  Variant (244)..(250): xaa in position 244 to 250 is any or no amino acid
  Variant (252)..(254): xaa in position 252 to 254 is any amino acid
  Variant (255)..(255): xaa in position 255 is any or no amino acid
  Variant (258)..(258): xaa in position 258 is any amino acid
  Variant (263)..(267): xaa in position 263 to 267 is any amino acid
  Variant (268)..(271): xaa in position 268 to 271 is any or no amino acid
  Variant (273)..(273): xaa in position 273 is any amino acid
  Variant (276)..(277): xaa in position 276 to 277 is any amino acid
  Variant (279)..(288): xaa in position 279 to 288 is any amino acid
  Variant (289)..(294): xaa in position 289 to 294 is any or no amino acid
  Variant (297)..(297): xaa in position 297 is any amino acid
  Variant (300)..(300): xaa in position 300 is any amino acid
  Variant (303)..(306): xaa in position 303 to 306 is any amino acid
  Variant (308)..(308): xaa in position 308 is any amino acid
  Variant (310)..(314): xaa in position 310 to 314 is any amino acid
  Variant (315)..(320): xaa in position 315 to 320 is any or no amino acid
  Variant (322)..(322): xaa in position 322 is any amino acid
  Variant (329)..(331): xaa in position 329 to 331 is any amino acid
  Variant (333)..(335): xaa in position 333 to 335 is any amino acid
  Variant (336)..(344): xaa in position 336 to 344 is any or no amino acid
  Variant (346)..(351): xaa in position 346 to 351 is any amino acid
  Variant (353)..(358): xaa in position 353 to 358 is any amino acid
  Variant (359)..(389): xaa in position 359 to 389 is any or no amino acid
  Variant (394)..(394): xaa in position 394 is any amino acid
  Variant (396)..(396): xaa in position 396 is any amino acid
  Variant (398)..(400): xaa in position 398 to 400 is any amino acid
  Variant (402)..(413): xaa in position 402 to 413 is any amino acid
  Variant (414)..(422): xaa in position 414 to 422 is any or no amino acid
  Variant (424)..(426): xaa in position 424 to 426 is any amino acid
  Variant (428)..(430): xaa in position 428 to 430 is any amino acid
  Variant (432)..(433): xaa in position 432 to 433 is any amino acid
  Variant (435)..(435): xaa in position 435 is any amino acid
  Variant (437)..(438): xaa in position 437 to 438 is any amino acid
  Variant (439)..(447): xaa in position 439 to 447 is any or no amino acid
  Variant (449)..(449): xaa in position 449 is any or no amino acid
  Variant (451)..(451): xaa in position 451 is any amino acid
  Variant (452)..(452): xaa in position 452 is any or no amino acid
  Variant (454)..(455): xaa in position 454 to 455 is any amino acid
  Variant (457)..(466): xaa in position 457 to 466 is any amino acid
  Variant (467)..(467): xaa in position 467 is any or no amino acid
  Variant (469)..(474): xaa in position 469 to 474 is any amino acid
IXXXXXXXXXXXXXXXXXXXXLXXXXXXIXXXXXXXXXXXXXXXXXXXXXXXXXXXXXLXPGXIDXXIXGXXGXXXXXXXXXXXXXXXXXXXXXLXXIXXXXXXXGXTXXXXTXITXXXXXIXXXXXXXXXXXXXXXXXXXXXXXXXXGXHLEGPFLXXXXXGXXXXXXIXXXXXXXXXXXXXXXXXXXXXXXXXXXXXIXXVXLAPEXXXXXXXIXXXXXXXXIXXXLGHSXAXXXXXXXAXXXXXXXXGXXXXTHXFNAMXXXXXXXXXRXPGXXGXXXXXXXXXXXXXXXXLIXDGXHVXXXXVXLXXXXXXXXXXXLXLVTDAMXXXGXXXXXXXXXXXXYXXXXXXVXXXXXXXXXXXXXXXXXXXXXXXXXXXXXXXXXXXXXLAGSXLXMXXXVXXXXXXXXXXXXXXXXXXXXXVXXXSXXXAXXLXLXXXXXXXXXXXGXIXXGXXAXXXXXXXXXXXVXXXXXXG

SEQ ID NO: 102118 - protein, 45 aa, Artificial sequence
  Variant (2)..(28): xaa in position 2 to 28 is any amino acid
  Variant (29)..(30): xaa in position 29 to 30 is any or no amino acid
  Variant (32)..(32): xaa in position 32 is any amino acid
  Variant (33)..(33): xaa in position 33 is Phe, His or Tyr
  Variant (34)..(34): xaa in position 34 is Phe, Ile, Leu or Val
  Variant (38)..(38): xaa in position 38 is any amino acid
  Variant (39)..(39): xaa in position 39 is Phe, Ile, Leu or Val
  Variant (40)..(40): xaa in position 40 is Ala, Asp, Glu, Asn, Ser or Thr
  Variant (41)..(44): xaa in position 41 to 44 is any amino acid
TXXXXXXXXXXXXXXXXXXXXXXXXXXXXXGXXXEGPXXXXXXXG

SEQ ID NO: 102119 - protein, 56 aa, Artificial sequence
  Variant (2)..(20): xaa in position 2 to 20 is any amino acid
  Variant (21)..(22): xaa in position 21 to 22 is any or no amino acid
  Variant (24)..(24): xaa in position 24 is Ser or Thr
  Variant (25)..(25): xaa in position 25 is any amino acid
  Variant (26)..(26): xaa in position 26 is Ala, Cys, Gly, Ser, Thr or Val
  Variant (27)..(37): xaa in position 27 to 37 is any amino acid
  Variant (39)..(42): xaa in position 39 to 42 is any amino acid
  Variant (43)..(43): xaa in position 43 is Ala, Thr or Val
  Variant (45)..(46): xaa in position 45 to 46 is any amino acid
  Variant (48)..(54): xaa in position 48 to 54 is any amino acid
  Variant (55)..(55): xaa in position 55 is any or no amino acid
EXXXXXXXXXXXXXXXXXXXXXHXXXXXXXXXXXXXXGXXXXXHXXNXXXXXXXXR

SEQ ID NO: 102120 - protein, 31 aa, Artificial sequence
  Variant (2)..(2): xaa in position 2 is Ala, Cys, Gly, Asn, Ser, Thr or Val
  Variant (5)..(5): xaa in position 5 is any amino acid
  Variant (7)..(27): xaa in position 7 to 27 is any amino acid
  Variant (28)..(29): xaa in position 28 to 29 is any or no amino acid
  Variant (31)..(31): xaa in position 31 is Ala, Cys, Gly or Ser
IXDGXHXXXXXXXXXXXXXXXXXXXXXXXDX

SEQ ID NO: 102121 - protein, 37 aa, Artificial sequence
  Variant (2)..(9): xaa in position 2 to 9 is any amino acid
  Variant (10)..(10): xaa in position 10 is any or no amino acid
  Variant (12)..(12): xaa in position 12 is any amino acid
  Variant (13)..(13): xaa in position 13 is Ile, Leu or Val
  Variant (14)..(15): xaa in position 14 to 15 is any amino acid
  Variant (16)..(16): xaa in position 16 is Ala, Asp, Gly, Asn or Ser
  Variant (17)..(18): xaa in position 17 to 18 is any amino acid
  Variant (20)..(20): xaa in position 20 is Ala, Asp, Asn or Ser
  Variant (21)..(36): xaa in position 21 to 36 is any amino acid
AXXXXXXXXXGXXXXXXXAXXXXXXXXXXXXXXXXXG

SEQ ID NO: 102122 - DNA, 1140 bp, Escherichia coli K12
  CDS (1)..(1140): transl_table=11
atgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaa

SEQ ID NO: 102123 - protein, 379 aa, Escherichia coli K12
MIDYEVLRFIWWLLVGVLLIGFAVTDGFDMGVGMLTRFLGRNDTERRIMINSIAPHWDGNQVWLITAGGALFAAWPMVYAAAFSGFYVAMILVLASLFFRPVGFDYRSKIEETRWRNMWDWGIFIGSFVPPLVIGVAFGNLLQGVPFNVDEYLRLYYTGNFFQLLNPFGLLAGVVSVGMIITQGATYLQMRTVGELHLRTRATAQVAALVTLVCFALAGVWVMYGIDGYVVKSTMDHYAASNPLNKEVVREAGAWLVNFNNTPILWAIPALGVVLPLLTILTARMDKAAWAFVFSSLTLACIILTAGIAMFPFVMPSSTMMNASLTMWDATSSQLTLNVMTWVAVVLVPIILLYTAWCYWKMFGRITKEDIERNTHSLY

SEQ ID NO: 102124 - DNA, 1005 bp, Mesorhizobium loti MAFF303099
  CDS (1)..(1005): transl_table=11
atgaccttcgactggccaaccgctctgccgctgatcttcgccggcctgatgggcctggccatcctgatctatgtcattctcgacggcttcgatctcggcatcggcatcctgttcgccttggccgaggacagcgaacaggacacgatgatcgcggcgatcggtccgttctgggacgccaacgagacctggctggtgctggccgtcggcctgctgctggtggcgttcccgatggcgcatggcgtcatcctcagcgcgctgtacattcccgtcttcgtgcttttggtcgggctgatcctgcgcggcgtcgccttcgattttcgcgccaaggtgccgagcggcaaaaagcatcgctggaaccgcattttcttcctgggttccgtcatcgcctcgctggcgcagggctatatgctgggcgtctatgtgcttggcctcgatgtcggcctgggcggcaaggccttcggcgttctggtggcgttctgcctggccgccgcctatgcggcgatgggcgccgcctgggtgatctacaagaccgagggcgagctgcagaagaaggcggtgcgctggctgcgcaccgcgctggtgctgacggcgctcggcatggcggcggtgtcgctggcgacacctttcgccagcccgcgcatcttcgacaaatggttcgtctggccgcagatgctctatctttcgccgctgccgatcctgtcggcgctgttgttcctgtggctgtggcggcagaccttccatctgccgaggcccgacgaccgccatgcgctgacgccgttcctgacgctggccgccatcttcgcgctcggcttcgccggcctcgcctggtcattctacccgttcgtcgtgcccgataaattgacgatctggcaggcggcgtcagcgaccgaaagcctggccatcatcctggtcggcactgttgtggtgctgccgatcatcatcttctattccttctatgcctatcgcgtgttcggcggtaaggcgacggatctgacgtatgattga

SEQ ID NO: 102125 - protein, 334 aa, Mesorhizobium loti MAFF303099
MTFDWPTALPLIFAGLMGLAILIYVILDGFDLGIGILFALAEDSEQDTMIAAIGPFWDANETWLVLAVGLLLVAFPMAHGVILSALYIPVFVLLVGLILRGVAFDFRAKVPSGKKHRWNRIFFLGSVIASLAQGYMLGVYVLGLDVGLGGKAFGVLVAFCLAAAYAAMGAAWVIYKTEGELQKKAVRWLRTALVLTALGMAAVSLATPFASPRIFDKWFVWPQMLYLSPLPILSALLFLWLWRQTFHLPRPDDRHALTPFLTLAAIFALGFAGLAWSFYPFVVPDKLTIWQAASATESLAIILVGTVVVLPIIIFYSFYAYRVFGGKATDLTYD

SEQ ID NO: 102126 - DNA, 1101 bp, Aquifex aeolicus VF5
  CDS (1)..(1101): transl_table=11
atggaactccttcccgtgatttggttcgttttacttggctttataatagccatgtacgccgcactggatggctttgacctcggtgtcgggatagtttatcctttcttggctaaagatgaggaagaaaagaggatacttctgaactccataggacccgtctgggacgcaaacgaggtatggctaatcctggcaggcggagctctgtttgcggcttttcccgtagcttacgcaacgctccagagcggtctataccttcccgtaatactcatactctttatgctgatcctcagggcgataggtatagactacaggggcaagatgccaactccagcactgaagaaaactatggacatggttttctttttaggaagtctcggagtcacgtttttattcggtcttaccctcggaaacgttataaaaggacttcccgtaaaactcgttgaaaaggagctctacggcgaagtggtaaaaacgcacatgatatgtgcggaccaggactgcagttacacgggactcctgataaatatacttgatccttacgccctccttgtagcactcctaacagttagctttgttgcaatgcacggtgctatatatgcagcttacgtcacaaacggagacctatcccacagggcagcctctctggcgaaaaaactgtggttcaactcagcactcctctacttaatcgttcacatactcactatgatttaccacccactcctcataaagaactacttcacaaggatgttcatattccccgcacttcccatagtgatagttgcgttcataacgattatcgttgctctaaacaggcaaaaatactcccttgcattctggtcctcaactgccatgatattcagtgctataggtatagcctttgcaagtatatacccgacgttagtaccttctatatacgacgaaaatccttttgaaaacccggtacattcaataacagtttttaacagtgcttcctctgaaaaaacactcctcaccatgcttataatcgccctgataggagttcccatggttttaacttacaagttcttcgtgtacaggatcttctggggtaaggtgaaagtacctaaggaaggaggctactga

SEQ ID NO: 102127 - protein, 366 aa, Aquifex aeolicus VF5
MELLPVIWFVLLGFIIAMYAALDGFDLGVGIVYPFLAKDEEEKRILLNSIGPVWDANEVWLILAGGALFAAFPVAYATLQSGLYLPVILILFMLILRAIGIDYRGKMPTPALKKTMDMVFFLGSLGVTFLFGLTLGNVIKGLPVKLVEKELYGEVVKTHMICADQDCSYTGLLINILDPYALLVALLTVSFVAMHGAIYAAYVTNGDLSHRAASLAKKLWFNSALLYLIVHILTMIYHPLLIKNYFTRMFIFPALPIVIVAFITIIVALNRQKYSLAFWSSTAMIFSAIGIAFASIYPTLVPSIYDENPFENPVHSITVFNSASSEKTLLTMLIIALIGVPMVLTYKFFVYRIFWGKVKVPKEGGY

SEQ ID NO: 102128 - DNA, 1062 bp, Chlamydia trachomatis D/UW-3/CX
  CDS (1)..(1062): transl_table=11
atggagttttctttagcaacgattcttcctgttgtttggtatgttattctttgcatcgctgtatttgcttattctttaggagacggatttgatttaggattgagcacgatctattttctttctaaagatgagaaagaacgtaggctactcttaaactcaataggccccgtatgggatggcaatgaagtatggtttgtcatcatgtttgctggattgtttgcagggttcccgaccgcttatggaaccctgctttccatcttttacatgcctatttggactatggtcatgctatacatattccgaggctgttctctagagtttcgtagtaaagcagagtctaaccgatggaagctgttctgggatgttctcttttctatctcagggatgtctattagctttttcctggggacattagctgggaatttattagttggatttccgatcgctccagatacttcgtatagttctttatcttggaaactatttttccgcccttatccagtattatgtgggttatttgtagttactgcatttgctctacatgggattagttttgctttaatgaaaactacagaagggctgcacgaacgtttgaaaaataaattttcttatgttctgtctagttacttggttttgtatctttccttgctcattgcgactattttagggatgcctcagaccctaggagtgtgctgtcgtattgaaggcgctcctggtataccagcgtatccactcatcatcttattatcggtagtaacgttgtcttgctgttatgcagaaaagagagcggtctctattggtaaatacgggaaagcttttgttctctcttgtatcaacttgttgtctccaatacttgcgtataacatattgctcttccctaatttattagtatctacggtggataatcgttatactatgactgtgtttaacgcagccgcggaaacgcgaaccttacaacacctagtcactattgttttaattgggctcccgtttgtcgttgcttacgcggtatacatataccgggtgttcagaggcaaaacagatttcccttcgatttactaa

SEQ ID NO: 102129 - protein, 353 aa, Chlamydia trachomatis D/UW-3/CX
MEFSLATILPVVWYVILCIAVFAYSLGDGFDLGLSTIYFLSKDEKERRLLLNSIGPVWDGNEVWFVIMFAGLFAGFPTAYGTLLSIFYMPIWTMVMLYIFRGCSLEFRSKAESNRWKLFWDVLFSISGMSISFFLGTLAGNLLVGFPIAPDTSYSSLSWKLFFRPYPVLCGLFVVTAFALHGISFALMKTTEGLHERLKNKFSYVLSSYLVLYLSLLIATILGMPQTLGVCCRIEGAPGIPAYPLIILLSVVTLSCCYAEKRAVSIGKYGKAFVLSCINLLSPILAYNILLFPNLLVSTVDNRYTMTVFNAAAETRTLQHLVTIVLIGLPFVVAYAVYIYRVFRGKTDFPSIY

SEQ ID NO: 102130 - DNA, 1020 bp, Rickettsia prowazekii str. Madrid E
  CDS (1)..(1020): transl_table=11
atgttaaattttggatcttatatagatttaccacttgtttgtggtggacttatagctaccgctatttgtttatatgttttactagatggttttgatctgggagtaggaatcttatttccttttgcgcctacagatgattgtcgtcataaaatgatgaattctatagcacctttttgggatggcaacgaaacttggttagtacttggaggtggcggtttatttgccgctttccctttagcctattcaatattaatgtctgccttatatatccctattatattaatgttacttggtttaatatttcgtggtgtagcttttgagtttcgttttaaagctcatataggtcatcgttgtatttgggattattcttttcatttcggttctatgcttgctgttttttgtcaaggtttaatgctcggtacatttgttcaaggaatagtgatagacgggcggcaatttgcaggtggaagttttgattttcttacgccattttctgttatgacagggatagcattaatattcggttatgcactcttgggtgctacttggcttattctaaaaacagaaaacaaaacacaagattgggcttataaatctgctttatacattttattttatgttgccctttttatggggcttgttagtttatctgcgcctttcttaaataattatataaatcatcgttggtttagtatgcctaatatttactatttatcgattatacctattataactgttttaatatttatcaagttaataaaggctattaaacagaaaaaagaagtgaaaccgtttatttatacaatcttattatttttattaggatatttagggcttgcaataagtatatggccatatatcgttccatataaagttacgcttgaaaatgcagcagcagtacctgaatcgcagtctttactattggtaggggctctaatctttctacctgtaatacttggatatacattctattgttattatatattccgtggtaaatcatcttctcaacctctgtattag

SEQ ID NO: 102131 - protein, 339 aa, Rickettsia prowazekii str. Madrid E
MLNFGSYIDLPLVCGGLIATAICLYVLLDGFDLGVGILFPFAPTDDCRHKMMNSIAPFWDGNETWLVLGGGGLFAAFPLAYSILMSALYIPIILMLLGLIFRGVAFEFRFKAHIGHRCIWDYSFHFGSMLAVFCQGLMLGTFVQGIVIDGRQFAGGSFDFLTPFSVMTGIALIFGYALLGATWLILKTENKTQDWAYKSALYILFYVALFMGLVSLSAPFLNNYINHRWFSMPNIYYLSIIPIITVLIFIKLIKAIKQKKEVKPFIYTILLFLLGYLGLAISIWPYIVPYKVTLENAAAVPESQSLLLVGALIFLPVILGYTFYCYYIFRGKSSSQPLY

SEQ ID NO: 102132 - DNA, 993 bp, Vibrio cholerae O1 biovar eltor str. N16961
  CDS (1)..(993): transl_table=11
atgatgcagtatttgccagaaatttatttgttgttgttggggttcaccgtgtttatgtacgcggtgttggatggttatgacttgggcgtaggcattttactgccgcgtaatgatgtggcgcagcgcgatcgaatgatcgcctcgattggcccattttgggatgccaatgaaacttggttagtgttggcggtcggtatcttgctgattgcctttcctacggcacatagcctgatatttactgagctttatctgccgactgcgttgatgctgattgcgcttatcatgcgtggagtcgcgtttgattttcgggcaaaagccaaagccgaccacaaagatcattgggatctgtgctttaaaatcggctctctgctggccgcgcttacccaaggctatatgattggccgctatgtcgtcggatttgaatctgcgcctgaagcttatgcttttgcggtgttaagtgcactctgtgtggccgccgcctatgtgtatattggtggcgcttggttggtgctcaaaaccgaaggggagctgcaagtgcgtgccgcgcgttggtcgcgtaaagcaggatggctggcggcgttaggggtgctgtcggtcagtttggtcaatccatgggtgaattctgcagtcgcagaacgttggtttagttttcctgaggtgatcctacttgcgccggtccctattatcgtttttgccacgattttagtggtggatcgctatctcaaacgcgtaccgacggtaaatgatgccggtgtgcaatggcctttctttggtgtggtgctgatttttggattgagtttcctcgggctcgcgtacagcttctttcctgagatcgtccccggaatcatgactgcgcagcaggctgcgtcatcacctgaaaccttgatggtggtggggattggtgtggtgatcgtcatgccaaccattctgctgtacaccttttttgtgtatcggattttcaaaggcaaagcgaccgatctaagctatctgtga

SEQ ID NO: 102133 - protein, 330 aa, Vibrio cholerae O1 biovar eltor str. N16961
MMQYLPEIYLLLLGFTVFMYAVLDGYDLGVGILLPRNDVAQRDRMIASIGPFWDANETWLVLAVGILLIAFPTAHSLIFTELYLPTALMLIALIMRGVAFDFRAKAKADHKDHWDLCFKIGSLLAALTQGYMIGRYVVGFESAPEAYAFAVLSALCVAAAYVYIGGAWLVLKTEGELQVRAARWSRKAGWLAALGVLSVSLVNPWVNSAVAERWFSFPEVILLAPVPIIVFATILVVDRYLKRVPTVNDAGVQWPFFGVVLIFGLSFLGLAYSFFPEIVPGIMTAQQAASSPETLMVVGIGVVIVMPTILLYTFFVYRIFKGKATDLSYL

SEQ ID NO: 102134 - DNA, 1137 bp, Vibrio cholerae O1 biovar eltor str. N16961
  CDS (1)..(1137): transl_table=11
atgtttgattacgagatcttacgactcatttggtgggtactgattggtgtgctcctcgtgggttttgccatcacagatggctttgatatgggcgttggggcgctagtccctatcattggtaaaaatgataacgaacgccgagtgatgattaactctattgccccacactgggatggaaaccaagtttggctcatcacagccggtggtgctttgtttgccgcatggccgctggtttacgccacttcattttcaggtttctatctggctatgattgtgacacttgctgcgctgtggttacgccctgtcggtctagactatcgctcaaaaatcgagagcacaaaatggcgtaataactgggatttagcgatttcagcatcaggattcattccaccggttatctttggtgtggcattcggaaacctgctacaaggtgttcctttccaactgagtgatttcttgatgccgacctaccatggttcattctttggtctgctcaatccatttgctctgctctgtggtcttgtgagcttgttcatgactttgctacaaggctctgcatggctgcaaatgaaaacgacatcgcatgtacatcaacgtgctcgtaatgtggcacaactgaccggtttgctcaccgccgtgtgttttgtggccgcaggcttttgggtccagcacatcgacggttatatgattgttggtgcgattgacggtaatgccgcatcgaatccgctcaacaaagaagtgattcgtgaagcgggtgcttggttacacaactttgaacaagtaccagtactgtggttagctcctgcactgggtgtattgatgcctctactctcggttttggcgtcacgtctagataaaggtggcttggcatttttgacctctagtttaggtaacgctggcgttatcttcaccgcaggtttcgctatgttcccattcgttatgccttcaagtttgaatccggcccatagcttgactatgtgggatgcaacttcaagcaagctgacgctagaactgatgactgtggttgcggttgtcatggtgcctatcattttgggttacaccatctggagttactacaaaatgtttggtcgtctcgatgataaattcatcgaagataacaagaattcactgtactaa

SEQ ID NO: 102135 - protein, 378 aa, Vibrio cholerae O1 biovar eltor str. N16961
MFDYEILRLIWWVLIGVLLVGFAITDGFDMGVGALVPIIGKNDNERRVMINSIAPHWDGNQVWLITAGGALFAAWPLVYATSFSGFYLAMIVTLAALWLRPVGLDYRSKIESTKWRNNWDLAISASGFIPPVIFGVAFGNLLQGVPFQLSDFLMPTYHGSFFGLLNPFALLCGLVSLFMTLLQGSAWLQMKTTSHVHQRARNVAQLTGLLTAVCFVAAGFWVQHIDGYMIVGAIDGNAASNPLNKEVIREAGAWLHNFEQVPVLWLAPALGVLMPLLSVLASRLDKGGLAFLTSSLGNAGVIFTAGFAMFPFVMPSSLNPAHSLTMWDATSSKLTLELMTVVAVVMVPIILGYTIWSYYKMFGRLDDKFIEDNKNSLY

SEQ ID NO: 102136 - DNA, 1137 bp, Vibrio cholerae O1 biovar eltor str. N16961
  CDS (1)..(1137): transl_table=11
atgtttgaatatgacacattgcgcctcatttggtgggggctgatcggtgcattgctgattggttttatgatcaccgatggttttgatatgggggtaggtgcactcttgcccatccttggacaatcggaatccgacaaacgagtgatgatcaattcaattgcgcctcattgggatggcaaccaagtatggctaatcaccgcagggggagcactctttgccgcctggcctttagtttatgccacctctttttcaagcctgtatattgctatgtatttaatactgttggcgctttggttacggccactagcattggaatatcgcgcaaagattgataccccttcttggcgaaaaatctgcgatatctcgatttcgctttcaggtttaattcctcctcttctatttggtgtcgcctttgggaatttaatgcaaggattacctttctcgctcaatgcgttactgatggtagattatcatggatccttcatcgatctcattacccctttcagcgtgctgtctggcggtattggcgtattaatggcattagtgcaaggcagtgcatggctcacgctcaaaaccagcgatattcttcataaaaaagcgcggctaaccgctcaaataagtgtcttgtgtctctttggattattcatcataggtgggtttatggtgcatggaatgaatggatacctgattgtcagctcattagactataacgccatatctaatccgttaaataaggtcgtcttccaacaagccggtgcttggctaaccaattttgaacgttacccgtggatgtggtttgcacctatgggtggcttaatgatggctatgggagtattcctcagtgcgaaatggaaaaacgatgctatcaccttcgtctgcgccagcgtgacgaatgcttgtattattttaaccgcaggttttgcgatgttccccttcatcatgccatccagttttgaaccaagccatagtttaactttgtgggatgcgacatccagtgagcgaacattaaatattatgacgggcgtagcctttgtcatgttgcccatcattcttttttataccgctttcagttacagaaccatgtttggtcgacttgataagcaatatatcgaacgtaatcatcactcactctattag

SEQ ID NO: 102137 - protein, 378 aa, Vibrio cholerae O1 biovar eltor str. N16961
MFEYDTLRLIWWGLIGALLIGFMITDGFDMGVGALLPILGQSESDKRVMINSIAPHWDGNQVWLITAGGALFAAWPLVYATSFSSLYIAMYLILLALWLRPLALEYRAKIDTPSWRKICDISISLSGLIPPLLFGVAFGNLMQGLPFSLNALLMVDYHGSFIDLITPFSVLSGGIGVLMALVQGSAWLTLKTSDILHKKARLTAQISVLCLFGLFIIGGFMVHGMNGYLIVSSLDYNAISNPLNKVVFQQAGAWLTNFERYPWMWFAPMGGLMMAMGVFLSAKWKNDAITFVCASVTNACIILTAGFAMFPFIMPSSFEPSHSLTLWDATSSERTLNIMTGVAFVMLPIILFYTAFSYRTMFGRLDKQYIERNHHSLY
